United States Patent 9,518,277 (GENETICALLY ENGINEERED MICROBIAL STRAINS INCLUDING CHLORELLA PROTOTHECOIDES LIPID PATHWAY GENES) - sequence listing, part 9

SEQ ID NO: 32743 - DNA, 3179 bp, Chlorella protothecoides
  modified_base (1842)..(1851): a, c, t, g, unknown or other
  modified_base (2206)..(2215): a, c, t, g, unknown or other
  modified_base (2282)..(2291): a, c, t, g, unknown or other
  modified_base (2385)..(2394): a, c, t, g, unknown or other
  modified_base (2898)..(2907): a, c, t, g, unknown or other
cctctgcgccgccgccggtccaggcggacggcggcccgggcgctgccgtggggcccgcgctcgccggggccggccccgtcctggccgcggcagacgggcctgcgccggtgggcgccctgcaccttccccagccggggccgtcctccttcatggagatgctgggcgaggtggacgcccccgacgcgcacacggccacgcacgaggcgccccccgcggcgcctgctggtttggcggccccggcagcccctggcgcatcagaccctgcgccggtgccagaggctctcgacggcagacctgcccccgacccggcgccggcgcagcccgcggcccccgacgcgacggttgctggggttgcagcgcctgcgccaggcgcggcatccattccagacgctgcaccgagcacagacgcgacggccgactccggggcctccccgccaccagacgcccgccaggccaccgagtcacccgagccgccggcaccctccgccatggacgtcgacctgtcgccgcccgtgagcttgccctcgccctactccatgtccctgtcccccggggagggggcggcgggggtggcgcaaccggccgccgagccggggaccgtcacgttgccggggggcgaggtagtgcgtgtggcctcgctgagcaattgggtgcatggtggcctggtgcagcccggcccaaaaggccccgccccccaaccagaaagcatccccgaggcgggcccaggcctgtcggagggcactgaccaggcgccacaagagggctgagcctgccgaacccattgacctgtcggaccggaagccgattcaccactgtacacacaccagccacagggtgtggaatggaaggaaaggggggtggtgtccgcatgggtgtggggggtggcgaggagcatgattccccaggtggacatgtggcgagagagattcgccgaggatttcgtgcgccctggtgccggtgcctgcactgggcctctggaagcttgagctgccgtccgaacccatcgcatctaaaatatacattgggaattgaacacccgctgagggtgcaactgctcgcccagatcttcgccatgaagctctagcctgccgcatggccagctcacatgcctcctcatcatgcagatgtgcacgggtagatggcagcacatgcgaaggcccttgactctacaagctgattcccagacaatacgtgcaatcgggcgggggcatgttgtggcatccgtcgcgcaggggcccggcagaggtgctcggcaggtacgctacatgcaggcgccccagcccgtgttccgggccgctccctacctcatggagctgcaccggcagcgccagcagtccagcggatgcgtgataatgtgtctggacgaaggtatgactcacgcccggaggtggggaagtgcctgaggagtcgcattcctgcgcccatcagcttcggcgacgtgccatcacagtcccgggatcggcacccaccctttttagcccggtcccaaggcactgcaagcacaccaatcctttctgcatatgccgtttcggtcagcacttgccacactcccaccattctacccctcgccctcctccctgcaccccctgcaggcgagtcgtgccggagcctgctcaccgccgccatgctccaggtaatgctggcccggttgccccatctggacgtggcggtgaccaccgcctccatcggccctgccatccccggtatgcgctcccccaacctggaggcggtcgcctccgaaatggaccttgtgctgcccgcggtaggcaggctgggtgacggcttgccgacagggggaagctgtgcgcgcacgcaggggtcctcatgatctgggaatctgcnnnnnnnnnngccgagatggaccttgtgctgcccgcggtaggctggctgggtgacggcttgccgatagggcgaagctgtgcgcgcgcgcaggggtcctcatgatctgggaatctgccccctctccatgtcctttctttcatctggcgccctcctttctacctcccaccccagggcacactgcatgagtttgacgagctgcgagacactgtgcgctgcgacctcatcctcaccatggatcgcttcgaccatgctgaggtccagaaggaggtgagcgagattgctgggtggccatttgcatctcagagcatagagtaagaggatgtggagcacgagtttggtcaaggggaagcatccttggcgggcnnnnnnnnnnactcagagcgtagagtgaagggatgtggaggacgaatttggtcaaggggaagcatccttggcgggcnnnnnnnnnntgcacgcctccgcactttccagcccccacccccccttctcatcccccaacccaaacacaatcaaaggtgtcggtgctggaccgcatcaacagcnnnnnnnnnnagcacgcgtccgcactttccagcccccaccccacccttcccatcccccaacccaaacacaatcgaaggtgtcggtgctggaccgcatcaacagctccggcttctacacccagcgcatacgccagctgggcagcttcggccccggcgggctggcggcgcgccccgcgctggacatcgccgaccccctgtacgccaagatgacgcacggcgccgagcacgccgcgctccgcgccgctgtgcacgacatcgccgccgcctgccggcacctggtgcgcagcttggcccagctcaaggcgcggtgcgttggatgggtggggaggaaaggacttgatcggctgagaggcgccatattctttgtaagacttgtgcgtgtggctgggcggaggctcatgcacagtcgcggtccccttccccccatcatgtctgtcctcctcaccctgaaccggcacccacccgaccacccaccaccgccatcattatccacagcgcgggtgcctccacgagnnnnnnnnnncccccttcccccccatcatgtctgtcgtccacaccctgaaccggcacccactcgaccacccaccttcgccaccattatccacagcgcgggtgcctccacgagcctgaggatcgcgctggcctgcctgctacagtgcccggcgctggacccgcaagtgctcaccgcccggcgccgcgccgcctcgcttcgtcgcccgctgtggcgctccgagggcgggcgcctgctcacgctgcgcacgctgcggggcgaggggcgcgtcgtggcggcgcgcc

SEQ ID NO: 32744 - DNA, 61 bp, Chlorella protothecoides
ccccgccccagaaaccgacgccacagcggcacatcgcgcggctgttcagcctcctgtccta

SEQ ID NO: 32745 - DNA, 70 bp, Chlorella protothecoides
gcagaacttgatgagcaggagagcggcgggtcagcaaagtgtacagggcgccgccgatgctcaccggcac

SEQ ID NO: 32746 - DNA, 102 bp, Chlorella protothecoides
tcgcttgtgcggccactgtcctggaatgtgctattcaggtgtaccagcagtcaccccagggaggactggggctgatctcacagtatggcgagttggcgaagg

SEQ ID NO: 32747 - DNA, 61 bp, Chlorella protothecoides
ctgctggggtgaggcaggggaggggggggggattgaggcgacactcagcaaaccaacctac

SEQ ID NO: 32748 - DNA, 63 bp, Chlorella protothecoides
ccagagacttacaaacctgaacacatgagccccactcacctcagcacacttggcatttgccct

SEQ ID NO: 32749 - DNA, 215 bp, Chlorella protothecoides
agggaggatgcgtcaggacagggctgaaacgttgatagacctctcccctctgtgctcacttccaaaagagtgagtgacgacttgcatgatgtcttttatcaacgtcaccccagccagtacatacgaaccccagacctcctcgccacccctagtccacgcgcacctgatcaagaaggatgtcccgtaggaagcagcccatggtcaccgagtggccc

SEQ ID NO: 32750 - DNA, 61 bp, Chlorella protothecoides
acatatcctcggggccggtgtggctgagggggcgcctgtgtgcgattttgtgggggagacg

SEQ ID NO: 32751 - DNA, 77 bp, Chlorella protothecoides
gctggagaaaatgatgcgtgggagagggggaagtggttggggatgctgaaaggggtgcatgcatctcgggctgtgtc

SEQ ID NO: 32752 - DNA, 79 bp, Chlorella protothecoides
acaccgcgttgggaggggccgacggagggcaaacacacctgaaccctagtgcctgccccctccatcgccgcatgcaagg

SEQ ID NO: 32753 - DNA, 79 bp, Chlorella protothecoides
acccatctcacagggtgccgtagctggacccatcaaagcttgagatcaggggagcaccagcatagaaagaaatgttggg

SEQ ID NO: 32754 - DNA, 61 bp, Chlorella protothecoides
ggttacaggatttgctgactgagatgaaagaacagatctctggagctactcccatcatcgc

SEQ ID NO: 32755 - DNA, 90 bp, Chlorella protothecoides
ttcatcatatccctttgcaactatccatgcattgcaatgcaggtcatccctgttcacccaccgatgctgccctgcacctaccagctcttg

SEQ ID NO: 32756 - DNA, 458 bp, Chlorella protothecoides
  modified_base (152)..(379): a, c, t, g, unknown or other
tgtggtgtataccagcagcgaggtgcaccccacctttcctacccatccattcccccaccaaccacccgcacttgcctcgctccaacaacacacctcaccaaaccccaccctcctatacacacctctgcaggcgggacccccctccagaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtggagtgtatgcagtgacaggcccctctggggacctgtgtcacggaccccctgccactccaaacacaccgacctcc

SEQ ID NO: 32757 - DNA, 108 bp, Chlorella protothecoides
ccaccctgctgaccgcttcctggcagtctgtgggtgagagatgggggtcggtcagccttgggaccaatgcgaggggggtcagcctcctccgcctcctgcacaccccaa

SEQ ID NO: 32758 - DNA, 61 bp, Chlorella protothecoides
caacgttcgcctccccacaggcgtgtacattcccaccgcccagtatgatgaggagtgcgag

SEQ ID NO: 32759 - DNA, 121 bp, Chlorella protothecoides
gactgtccctgagatagaggacaagtgctgcaatggcagtcggcttcccaccaatcttccgcctcccagaagaaagccccacctcacccgcaggagcacggccaggcgctcctcctcgatg

SEQ ID NO: 32760 - DNA, 181 bp, Chlorella protothecoides
gcactctagtttgacccaggcatccccagcatgcctcgcacactgcagcacaggccgtgtcaacgcacgacctttttatccgcatcatccagtgcatgacattgagcgcagcatggcaggggtcagggggcatgccaaggcttcattgggtgaccaaggggggggcccccctctttaagag

SEQ ID NO: 32761 - DNA, 74 bp, Chlorella protothecoides
cgccgcgccgtcgccgatgtcatgccagctgaggcatgtgggggtgccggcggcgccgctgcaccgtaggctgt

SEQ ID NO: 32762 - DNA, 118 bp, Chlorella protothecoides
ggagaggatgggcttgcctggtgtggcagatcaggtgcgtgagggtgtgtactcaacctcctaccaagccgtacgatcgccgccagcgccaccaatctcctgcaacccctggcagggt

SEQ ID NO: 32763 - DNA, 61 bp, Chlorella protothecoides
agtgtccctcctgcactcgcgtgagcggggtgctgacccttttctaggctaatggcacgac

SEQ ID NO: 32764 - DNA, 120 bp, Chlorella protothecoides
gccgagggcagaggcgcaggggaggcggaggtgcaaggagctgaggacgcagtagatgcggaggttttggaggctgctgcgcagccggatgggggtgtcggagaggagcatgaagtcctt

SEQ ID NO: 32765 - DNA, 75 bp, Chlorella protothecoides
gctcatctccagcagagtgggacgatggcgcgcacaccgtgacccctgaggcatgcgaaccgcagcgggtgctgc

SEQ ID NO: 32766 - DNA, 141 bp, Chlorella protothecoides
ggcggtcaggggctccgacttccggtgggtacctccgtgctggggggagggggggtgcacttgggcgcttggctgctgcaccgccgccagccgccggtgacacggtggtcgctccctccacctgcaggctgtttgcggatg

SEQ ID NO: 32767 - DNA, 61 bp, Chlorella protothecoides
tcatgaatgcaacaggcgcgggagggagccgttcctctgaaacacggtgtcacccggtcac

SEQ ID NO: 32768 - DNA, 80 bp, Chlorella protothecoides
aggcttgcgccaccagtgtgccccccccccccaacaccaccaccaaacagaaaccacacacatgccacaggccggaaggt

SEQ ID NO: 32769 - DNA, 61 bp, Chlorella protothecoides
gagcggtaccggacacgctcagcacgcggtacctccccgccatgcccggcaggcggtggaa

SEQ ID NO: 32770 - DNA, 74 bp, Chlorella protothecoides
ctgatacctgaacaggcacagcccagcccgaacaaagggttctatcaagcaagaaactccatggcggtgggcaa

SEQ ID NO: 32771 - DNA, 113 bp, Chlorella protothecoides
ggccccacgagtggctgcatcagtttccccggcgcatcgttctgcaactccccatccctcccggacctgacagggtgatgtcggaggtggtgatggcggagctggagcggccc

SEQ ID NO: 32772 - DNA, 61 bp, Chlorella protothecoides
gttcttgaaggagatcttgcccgtctcatcatcgtcaaacagacggaacgccttgatgatc

SEQ ID NO: 32773 - DNA, 99 bp, Chlorella protothecoides
gtctgggagctccctggtgtgtcatgctgagtgctggtctaccccgtcgcatcgccaggccccctactgccctcacctgtcatacacgccctggtcgtt

SEQ ID NO: 32774 - DNA, 65 bp, Chlorella protothecoides
ctcctctggggcgtcaagggtcggagccagggcagaccaggggtctgagcacagctccgcgcggg

SEQ ID NO: 32775 - DNA, 61 bp, Chlorella protothecoides
caccacctcggaggagacgtgaccgaactgttcaccatcaatttcacacctcagacttctc

SEQ ID NO: 32776 - DNA, 76 bp, Chlorella protothecoides
ctttgcatgccatgatttccgtctcccacccacccttgcaccccgccaggctgtccaccaacctcatcctgtacct

SEQ ID NO: 32777 - DNA, 134 bp, Chlorella protothecoides
cctggaccgcatcccagatgagtacctcatcgccgccagctacgacccggtgcgaacgcatgatgaggagggctgggtggtgggacctttcgccatcgcgtgtgtggagctgtcagaccctccctgtggccaag

SEQ ID NO: 32778 - DNA, 76 bp, Chlorella protothecoides
catcactgtctcctatgtatgcctgtttttaaaggcgatgaagatttgagatcacactcccctgctcgacctggaa

SEQ ID NO: 32779 - DNA, 66 bp, Chlorella protothecoides
ctcggattgggagacaggcaatatggctggggggggaaaatagggttccactcgtctttgatcagc

SEQ ID NO: 32780 - DNA, 103 bp, Chlorella protothecoides
ggccatggccaggtgaaagcggtgcctctggaaagcgcagcacagctcagaggccgtggctaggtgctgacaccctgtcacctgtgagagggcatggagaatg

SEQ ID NO: 32781 - DNA, 406 bp, Chlorella protothecoides
gcggagggcggcgaagggccgtcggcggggccggggacggggacggggacggggacgggcgccgcaaacgccgccggcgccgccccggccgacgccgctctggcaacacccggcaccgcgccacggcgccagctggtctgcgtggccaacacccacatccacagcaacccggagctgtcggatgtgaagctgtggcaggtgcacacgctgctcaaggggctggagaagatcgcggcctccgccgacattcccatgctgctggcgggggacttcaacacgctgccggggtccgctgcgcacgccctcctcgtgtcgggcggggtgcccccccaccacccggtgggtttgggggggggggagttttgggccctgggaccgggcatgggagcggaggggcggcttgagc

SEQ ID NO: 32782 - DNA, 8073 bp, Chlorella protothecoides
  modified_base (134)..(143): a, c, t, g, unknown or other
  modified_base (327)..(336): a, c, t, g, unknown or other
  modified_base (829)..(838): a, c, t, g, unknown or other
  modified_base (2169)..(2178): a, c, t, g, unknown or other
  modified_base (2553)..(2562): a, c, t, g, unknown or other
  modified_base (3147)..(3156): a, c, t, g, unknown or other
  modified_base (3561)..(3570): a, c, t, g, unknown or other
  modified_base (3770)..(3779): a, c, t, g, unknown or other
  modified_base (3887)..(3896): a, c, t, g, unknown or other
  modified_base (3977)..(3986): a, c, t, g, unknown or other
  modified_base (4481)..(4490): a, c, t, g, unknown or other
  modified_base (4709)..(4718): a, c, t, g, unknown or other
  modified_base (6798)..(6850): a, c, t, g, unknown or other
  modified_base (7352)..(7361): a, c, t, g, unknown or other
tgggaggaggtcagcgggggggcggggtggcatccggcgggcagcaggccggagcgggggcgggcggtgcggccaggcacccgcgttcactcccccggcggggcagaggccccggcacatgccccggcccgcgnnnnnnnnnngagcgggggcgggcggtgcggccaggtacccgcattcactcccccggcgggacagaggccccggcacatgccccggcccgcggagggagcgcgggtgggggggtatcaccaggcagtgggtcgattcggccgcattcaccgcagcgcctctcccccccatcccgggatggcacgacccggcgannnnnnnnnnctgggccacattctccgcagcgcctctttcccccatcccgggatggcacgacccggcgaccccacccgaccacccaccctccgctcgataaagtcaaagtactccttggcctcgaagaagggcccggccaacaggttccccgaggcaaagcagtagctgtagtactcgagcagactgggcaggcgatcgaggcgcatggcagcccggtacgggcgatcgtgctgcggtgtggagtaaggggggagggcggcgggcgagtggagggggggccatgtggcgaggggcaggtgcgttggggggaaagggtggagtgggagggcccagaggcttccagcatggggcgcgcctccacgcgccatgcaaggggtggggagcctttgcccttgcagcgcaggctcgatgacctcccccccgaacgagccgcgcagtcgccggccggcgcaggccatccacaccctggtggcgcaccacaccggcggcagggtctggaggnnnnnnnnnntccccccgaacgagccgcgcagtcgccggccagcgcaggccatgcacaccctggtcgcgcaccacaccggcggcagggtctggaggcccgagcggcacgcatcgagtgccgcacccgacgccgccctcctgccagcccaccttgtctgcgtgggtgcggccgtcctggtagcacacgccgatggcgacgagcttgagggtgaggaccatctgggcccccgtgaagtcgagctggccctccttccatgacagaccgctggcctggaagacgtggctgcagggacaaggggggggggtggcggggctggcgagccatcctctcggccatcgagcaccagcaagccttcctctccagcctgccctccttgatggacaccatctggcgaccccccctgatccacccctcgcacttcatgatgaggtaggggaaggcgatcagccacgccagcgtcccgcagtgggtggggaaggcgcacatcgccaggtatatgagggaggatgggacgagggcgtggagcacccccgtcccaaaggggtagtagatgaggaggaagcccgtgatcacggcataccagtgccgagctgttcgggggtctagggagggacttgttgttcacggggccgctgcacgcaccccgtgcgactcgcaggcacattgaagaaccagtgcatgccatgcaaggggtcaggttcgcgtccactcgcctttggtggaccgcacgtgccgcaggccgactcccaccagcacataaaggacgaaggcaacaacgaagcgcatctctgacagcgacaaagccagggaggaggatgctgcgagttcccatgacatgggcttgatcaggttatgtgtcatggcgcagggttgcggtcgctaaggagcagggttgagactggcttgaccccaccagatgaacggggagcctggccggcctgaggagctcagtgggccttaatcctggaggtagtgggccccgtggcaggtacgaagcacgcttagagtgagagaaaccctcacaaggtgattgtgcaccttggtgattgtcatttggtctgggctgcatggcatctgacctgagggggggtggatcccacccgcagcgcgcggggccggcttttaggatccgccatctgcccagattgcccgttgtttctcatgccatccccaactataaggcgtcaagacatccctttgcgaatggcaaacttgatgagacattcgatagggatactgaggtaaccttgtagactagggtggttgactttgtagttcatggaagacttcttcggctactgacactcatgcccagccacaactctgagccaggcgaagannnnnnnnnnatggttgacttaataattcatgaaagacttcttcggctgctaacatttacgcccagccacaactctgagccaggcgaagacaagttacacttcaggctcttgaaagcctaacatgaacatgattggcgaagaggtaccgtatcctctgcacctttcctttcacattcttgatccagtgaaagtctgccaactaccaacgttccagcatggattgatttgcctaggtcccctaagtcttgaagtccgggcacactgtaatggatcctcagctttactctcagggcaatctttggtgccgtcatgttggattccttccaagttcactactatgggcctccccatcttttcatggtaaaataccaggcctccctgccnnnnnnnnnnggtgccgtcatgttgggttccttccaagaccactaatatgggcctccccatggtttcatggtaaaataccaggcctccctgcctcgagcgccttgcgaataacggaatccctgctagtattatttggtgttcattataatacacgcgatcagccttgcagctgccttatgttcctgggagctccggtcactgattctgatgtatcaggcgcacacaaaccgctgtgattgtcactcaagagcaggcatcgacaagcgagtctcctccggaccgcacccatgctcaaaccgtgccgaacatgcctacactccatgcgctaggcgcgactgaagcaagtctaacttgttccatgggtgttctggtacggaatgatatcccatcccctcacaagtatgatcgtgggcagctctcttggtcgaatcgacaactagctcgaagcttcccgtccggatgaaggatactacaaaggccgccgactatagatattgagctcacccggaccttgaacagatgataaaattgtaaaggggatgttacagaggagttttgtgtttcgtgtttgggtctctgcagagtgtctggtgnnnnnnnnnnggaccttgaacagatgatagagttgtaaaggggctgttacagaggagttttgtgttccgtgtttgggtctctgcagagtgtctggtgtcggcatcttgccagcatgcatgtcctgctgcgcaacggcgcatgggtcaccgtagtcggtcttgcacttgcccttctttcctcggcggaggcaatgtgtttaagagtcgaaaaactccacaagcattacctcaatcacacactgagcattttgtgccgcaagatcattccgaggaaaccgtccggatactctgacctccatccccaatgcaaatcttccatcggagggtttcctgtaaccaatccacaagaccctggtctccgcctcagggatggcgtctggatccgcttcgggcattagagcacgggctgcgtcgnnnnnnnnnnagcaaatcttccatcagagggtttcctgtaaccaatccacaggaccctggcctccgcctcaggggtggcgtccggatcggcttcgggcattagagcacgggctgcgtcgactgttcaggcgaccagctttctcgacgtctcttccgtgaaagggtcctgcatcgggcaggtacagtggaggagctgtggggttgccgggnnnnnnnnnnacttctttcctctgcggaggcaatgtgtttaagagttgaaaactccacaagcattaccccaatcacacactgagcgatttgtgccgcaagatcattccgaggaaaccnnnnnnnnnngcgattaaacacctcatttccaaggcatgctgcccacttgcagcgacttttgaatgccctccatgttcaccctaccgagcnnnnnnnnnncgaatatacacctcatttccaaggcgtgctgcccacttgcagcgacttctgaatgccctccatgttcaccctaccgagcagggctcgagtgatgggtttctgcctgcgtcacccacaggaggcttcgtaggaagctacagtgacttgggaaggtttgcaagctcccctgcgcaggcgtccaccaccatctcccatccaggacttgccgaggctcgtgtcactggctcctttaccagtgacagctccaagaccacggtgagttcaaagggtactccttgctctatttaacaggggttgcaaacatacaggtccacaagtattcgctggcatgtttccttcatagatgtcacacgctttgttccctattcgtaacgcaggccgaggcagggtgcgtcaggcgcactccaggctctttggacaccagcacagcagcagacgcaggcattactgttacagtccagtgtgctgtggctgccagccccagcaactcacccnnnnnnnnnngagcacagcagcagacgcaggcaatactgttgcagcccagtgcgctgtggctgccagcatatgtttgggtaaagccccgcaccacatttcccttgagtcaccacaggcgcactcgagcattcaacgactgggatgggggagggctgggaggaggagacagcggtgggggggatggtggaggagatggtggagggctggggggttggtggcacatagccnnnnnnnnnngactcaccatcaccaaatgggcactgggcgatcatcggagaaaacactaggtatttcttcttccaggccttggtgtttaccggattcgcgtccacctcggtcagatgtttgcttcgaggatccaacaacaatgtgatttaggctttcaccatggtcctcaaccctgcagctgaacaggccttcatctaggaggaggtcggacgttgcatccttaaagacgccaggagtgcacttgcactgccactgacgaaactttaacaattgtcctatgcttaccctgacggactacaatgagtgacaccagtgtcatgtcagtaatccgagggctgaggttttcgatggaaatgaatcccatccatgcgcgatgtgctcttccaaaccccgtgccatcctatcctattatggtgtgaaacactccctgaaagtcaggtatgcagcaattgggcaaagtatgcatgatttacagaaggtgttcttgccttcagtgcgagacggctgaaaatgcattggacggagacgcaggtgtcaggctttggctgctagagcctcagcacaccatcgtactaaaccaacatcctatgaatcattccctgagtgaacaatgccggatcgctgagactcacgtctgccttccttacggagtactttgttgaagtacctgttctaagtgatgtgagaaagtaacggaccgtactgactgcgtctcaagattgctgctctgccaacatgcaacctcaacggtttgcagcaaagtatgtgaagaagatggaccagctcccgacgctcaacccaaccctgccccaggttcttccttttccccctcctccactgaacatgccaagtgcatcgttatatgccaagcctcaaaccctgcgcagagcaacctttgtacagccgactccatatcggtgtgcaatggtcctcatttggtcctttggggcatcaatggcaatgttttcgggggatgccttcagtttctcccgaattttgcataagatcacacagtccgagaggagcgttcaaaaccccaggtctggtgttataaggacactgcttgcactggagcaaaacctggtggtcaggatcaatctcttggcacggggatgcagtcgtcaccggtttggctctccatccagtgtattcattcggcccttggcagcacttggcttcccctttgatcgacgagaaagccataaaaacagaagccccacgctcctctgagagcaatctccggtccagctttttccgcaggtaatggaaaagcatgtggatgtgcgtgaactaagaaatagatgtgaaagagaaggcactgtaaggtgcgcgcccgggaccctacggctaacctttttgcatgaatcaacgtctggctcagctttgggtttgcgtagactgaaaatggtaattgtactggatcgtcgctgatcatccatagcaagtcccttacagtacatattcccaatggcaggttgtccttgcatacactgtttctttgtcctctgtccacgtgtaaatcgtacctcgctgcctccctacgacacctctcaccgtgtgggacgacctgctcgcatgccatctgttggagcaggtatccgtcttcgtctgatcccaagtacccattgagttataatgtattggccttgccctggacaatctgcggattacgttgcggcattagaggacaaggcccttggtgaatcctcgaagtcaatacggagagacccccttgaatttgctgcctctcacgccctgacgcctttcacctcttgcaaagctgtctggggcgagaagtctggcgtatcgggagcaggggtactggccccgagctgggcggggcagcgcttgctcaagccgcacccgagtgtaaggatttcaatacagtcttatcagccctaagtcatgttctcatccaaaagtgagaattgcctggttgtactcgcgggttcaaacacaggtgtagcccaagaagtaaggacaagcagatgttgcacgtgggcagtaagccccattacaggggtggcatgggttttaggggtggggtgacggcatctgtttggggggggggggggggggggcggggggnnnnnnnnnnnnnnnnnnnnnnnnnnnnnnnnnnnnnnnnnnnnnnnnnnnnngtggcaagggctgggaaggttgtgggcttgctaggggtgtgctagggtatttcgtggaacacagccctgtgtatgttggtcggttgggccacctgaacgcaaatgagcacggtgggatagtaagaatcaccgcatgtgccggcggaccgtgatttgtagtctcccgcgcacgccgagactcctgttggaaccgtcgcgatgcagacggtggtggggacaccatcgcgtgtgcagctgtgcggataacgaccaccgttgcatagagctttgcccgcaacaggtgcactcaatcattcagcaggtgaaattggttgagggctgggaggtggaggcagcggcggggggggaggtggaaggaaatgcggaggggatgtcggagagctagggggaggagacggcggcggtggggatggtaggggagctggtggagagctgggaggaggagactgcggcggtggggatggtgggggggatggtggaggactgggaggaggaggtgacnnnnnnnnnntgatagtggagggaatggtggagggctgggaggaggggacggcggcgggggcgatggtggggggaatggtggagggttgggaggaggggatggcggcgggggcgatggtggagggaacggtggagggttgggaggaggggatggcagcgggggaaatggcggaggtgaaagtggaggactaggaagaggagacagcggcgcgggatatggtggggggctggaaagccctgtgcaggggtggtggtggcacacggcccagtatgtgatggtcggtttgtaagcctgaatgcagatgagcagggtgggatagtaagaatcaatgcatgtgccagcggacgttgctgtgtagtctcctgcgcacgccgatacgcctgttggagctgttgcgatgcagacggcggtggggacgccatctcgtgtgcagatgcttggataaagccccgcgtcacattgcacttcagacaccacaggcgccgtccagcattcatcaggtggagatggtggagggctgggaggaggaggtgacggtggaggtgatggtggagggaatggtggagggctgggacgaggggatggcggcgggggcgatggtggagggaacggtggagggttgggagggggaaatggcggcgggggcgatggtggcgggaatggtggagggctgggaggaggggatggcggcgggggcgatggtggagggaacggtggaggg

SEQ ID NO: 32783 - DNA, 157 bp, Chlorella protothecoides
gggggaaagggactcgtccttgcctcatgcgcatcacacaacaaggaatgtggctggcgcctccctcctttcgtagaggaaggtcatccatgctcggaacgaccacagtttttgttcaggtgtctaagccccttcttgcatcagtgactcactggga

SEQ ID NO: 32784 - DNA, 80 bp, Chlorella protothecoides
aggagcacggtatgtgatcgatccccccctccccccacccacacaatcctcaccaggccgtgctgggtggcccagaccac

SEQ ID NO: 32785 - DNA, 453 bp, Chlorella protothecoides
  modified_base (160)..(372): a, c, t, g, unknown or other
atctgctgcatcgacgttgtgtgatggatggagtttgaggagatcacggcaggggctgcgacgtaagacccccttgggcctgcaggttgtcgaagagaagccctcgccctgcaattctcgagaatgatactctcctttcccacttccctaacagcttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggtgcctcacccattctctgtgattccattggctgcagagtccacgaccgtgcttggcggaaacagggatctgcacaa

SEQ ID NO: 32786 - DNA, 130 bp, Chlorella protothecoides
gacaagcggatgttcacacccaggaacatactagaacaacatggtgtgcatgatgtggaggttggaagaagaatgcgtgtcctgagcgggcactcaggcggtatgaggaaactccacgcgcccattttgc

SEQ ID NO: 32787 - DNA, 126 bp, Chlorella protothecoides
gactggcaatggcccttgtggcatggactgagggtcgccaagtatttaacagcagcggtatcatgtcatcatcccgagattggcaggtggccctccttcagggcgcctcaggctctcgagcccatc

SEQ ID NO: 32788 - DNA, 73 bp, Chlorella protothecoides
gtacggatgaacgcagaatatcttcgccgggagcaccaatgacagtgggattacaggctgagtgcgaaggcct

SEQ ID NO: 32789 - DNA, 69 bp, Chlorella protothecoides
ttggtgagatggtagttccctggcaaagcattctggccctgtgcccatcacggtcgtttagtcgggggg

SEQ ID NO: 32790 - DNA, 153 bp, Chlorella protothecoides
tttggctgggtgacggagggtgcaggggggcctgcatgcagggggggctgcatgcaggcgtgcccagcagtggggaagaggtgcaggacttgagggggaggtgcgggatgctgaagtcgtgacggtgggagtgggctgatgcccttgctgtgc

SEQ ID NO: 32791 - DNA, 79 bp, Chlorella protothecoides
gattcggtgtctgacactcagcactcgctgttgaattgtctggcttcaaggtggaggcaagattttctcgattgcactc

SEQ ID NO: 32792 - DNA, 16156 bp, Chlorella protothecoides
  modified_base (140)..(200): a, c, t, g, unknown or other
  modified_base (1565)..(1574): a, c, t, g, unknown or other
  modified_base (1760)..(1769): a, c, t, g, unknown or other
  modified_base (2230)..(2239): a, c, t, g, unknown or other
  modified_base (2718)..(2727): a, c, t, g, unknown or other
  modified_base (2933)..(2942): a, c, t, g, unknown or other
  modified_base (4500)..(4509): a, c, t, g, unknown or other
  modified_base (5505)..(5514): a, c, t, g, unknown or other
  modified_base (6041)..(6050): a, c, t, g, unknown or other
  modified_base (6588)..(6597): a, c, t, g, unknown or other
  modified_base (8024)..(8033): a, c, t, g, unknown or other
  modified_base (9279)..(9403): a, c, t, g, unknown or other
  modified_base (9757)..(9766): a, c, t, g, unknown or other
  modified_base (10663)..(10672): a, c, t, g, unknown or other
  modified_base (11170)..(11179): a, c, t, g, unknown or other
  modified_base (11668)..(11677): a, c, t, g, unknown or other
  modified_base (12684)..(12693): a, c, t, g, unknown or other
  modified_base (13436)..(13445): a, c, t, g, unknown or other
  modified_base (13715)..(13724): a, c, t, g, unknown or other
  modified_base (14200)..(14209): a, c, t, g, unknown or other
  modified_base (14300)..(14309): a, c, t, g, unknown or other
  modified_base (14472)..(14536): a, c, t, g, unknown or other
ggcggggcgggcgggcacggtgccgctggggcgggcggggagcgcggagggcaggcccttgggcgcctgcttgggcagggggcggccgggcagggaggggaggccgcggggcgcggactggggctcccccgcccctgagnnnnnnnnnnnnnnnnnnnnnnnnnnnnnnnnnnnnnnnnnnnnnnnnnnnnnnnnnnnnnggcgatgggctcggcgcgcgtcctcacgggggttctgggctgcagggagggtctgggcacctgaggcaagtgcttgtcgcccgcgctgccctctactccagactccgagcgagtcgcgcgctccaagatggccgccacgtcgatggggcaggacgaagaagccccagactcccgcccaagatcgtgcggcggggcgctgtgcacgctgcgaggagagtgcccgttggtgctcggggctgtgacacctgcagagaacatcatgagggggatcacttgaatgttgtgagatgggggagcacgagcagggaaacaagtgacggggacactgatgcctgatgccgtgctcatcaggggtgttcgggcaaatgcgagggcattcgcgtgtgactgatgtgccagcacccaggcatttgcttactctatttcctgaaaaagtacatgcccaggaggggtccctccctgatccctccgcctcccaagctcctcacacacactgagaagctaaaacaccctctgtaactcaccgccaccctcgatgaggacgctaacaccctcgccgaagcctccgcgaggagtaaccttgacgctgacggcgggcgagttcacaaaagagtcctggttggccgggtgatactcgtagtcctgggaatgaaggaaagtggtttcatgaagatggcaggccagaacagggcccaggtgcatgcatcatttctcgactctgacaaggacccttgcagcaccttcccccattccattgcagatcctcgccctaaagtccttacatcctcggtcttggcgtcagtgtcgagatccgatggcgggtcggacaggtatacttcctcgtcactgcatcgcgatgggtggcagagcgtggtgtggtgatgccgtctcgccccgggtatcctctgccggtctcacccgcccacccacgcgagcttccaggcacggccacactgtagcatcgcacctgctgattggagtgtggctcatagcgcggagggccacagatcagccctggccgcaagattcacctgcaacgcgaggtgcgcccggcgggttggagaaatcagacccggccctcagcgaatatattcaaaggtgccagcatgtactagataggtatgaggtgtagggggatgccgatgatgactgtcgggaggtgggtctcccgacgcaatgctcccatgcaaatgggcagccatgatccattcaggctggcgggacactcgttgtaccgcctcccttatcagcttgcatgcatgctattaccctggttggcaggccaaacagacgagattgttttttttaatacatgaatctactgtgatttacaagatttttattcctatggcccactagagtagnnnnnnnnnngttttctcaatacatgaatctactgtaatttacaggatttttattcctatggcccactagagtagatataactccatgcatcaggggcacaagtgcctgtttggaatcttgcattgacagcaatacggcagcatccgccatgttccccacaaggcagcgaggaaagttgacaaactttgtgaaaannnnnnnnnntttgcattgacagcaacacggcagcatccgtcatgttccccacaaggtagcgaggaaagttgacaaactttgtgaaaagcacatgcactgcacttgtttatcgtatcaacggattgcacgccctcaaacctctgcttctgttcttgagcacaaagcacgaatggctggcaaacgacagagtcattttccctgaagttcaaattactgcagctgtggagggtcatcacaaatgattagtgtcttgaaagtacaccagaggaatactgccacgttgtaaagattgtgggtcgaagtttcacattagcccatgcttgttttagtaatgctctgccgggctcagcacgttcccaccctaaaaacctactcacaatacccgctcactctgaatactgcgaattccaccgggccctgacaaaaaacccttttggaaaacgataattatagaaatcagcgaacaccannnnnnnnnncttaacccatgcttgttttagtcatgctctgcctggctcagcacgttcccaccctaaaaacctactcacaatacgcgctcactctgaatattgcagtccaccgggctctgacaaaaaaacccttttggagaacgataattatagaaatcagcgaacaccagagccgtccaagcctgcccgatagtcctggccgccgccccgcggacccccttgtcgccatgacttgcagatgtatcttgctggtggccctcgtggcctcagcctccgcagcctctgtcttccagcggcccatcaacagcgactgtgtgagggtttcgaccgcgtccacggatgcctccctcttccccaatgagtttcagatttctgggaccgcagtggtgaacagcgacgattacaccgaggtgcggccttgatatgggatttcaggcgaacttgcacctctatgtcccacatgggttgcgaattggggggtgactggnnnnnnnnnnaggggaaatttcggtcgaacctgcacctcaatgtctcacatgggttgcgaattggggggtgactggcagctcctgtgtgtgtgaggaggccttggcgcaggcgatccgaacctccttttgcggaatggacattgccccctgcagtcatgacgctgtcccagccaaatgaaggtgcaccagacctccaccaccacacctccactccnnnnnnnnnntaggcgatccgaacatccttttgcggaatggacatgtccccctacagtcatgatgctgtcccagccaaatgaaggtggaccagacctccaccaccacacctccactcctcctaggtggagacctctaccgggttcaccgtgacgtactacgataattacaaggtgccctggcgctgagagtgggcgtctgaaggacagccccatgcatgcagccaagccgacagcgccatctctgaggagcagcacctcgactccaggtctcgacttcccctcaacttcacctccccactgcgcaggtgctgaacaacaccctggccggggaggcgtacaccctcacccagtgcggcgtgagcgtggccgctaatgagctcccctccgacgcccgccccttctccatccccctgatcagtctgtccctccctgagacggtgccctacgccttcctggagctgctgggcgtgactgaccgcgtatacgacgtctccgagtacgtggtggcgccctgcggccagcggctggtgcagtcctgcaaccgtgtggcgcccgactccctcagcctgaacaatgccacgctgctgagctccaccatcggcgcctacacagacggcctggtcacatcctccaactccgcctggcccacacagttcaccttctcggccacggaggatccgggtgagtggcgcacgaggcaagcgcggcgggagggctgtgtgatggggtatctatgtggaacaatggaggtcagggtgggcacagaggtaccctgtcaccgctaggatcccagactatgaaaccacagaccccgcctgcaccccaccccccacaggtctcctgcagagggctgagtggatcaagttccttggcgtcttcttcaacctggatgcctactcctccaacctcttcaccgccatcaagaacgagtttgagcagaccaaggtgggtgtgctcgaggcgattgttgcttgcctggcatggagcgaagggcaagcatcgtcgtcaggtacccacccaaacagagtgccgtctttatgggtgatttctcatgctccatcgctgatgcccccgccgctccccatgcacaggccgcggcactggcccaggagggacccaagcctgtggtggcctggatcaaccacttcatgtacggcacccaagagtggtaccagctgtcctttgcggcctacaagaccgagctggtggaggccgcgggtggccagaacctgaactacaccgacatcctggagattgagggtgtgtgtgtgtgtgtgggagcgtgccgcggggaacgagttcagggcacggtgcctgtgggatttgtgtctttggggcatctacctggagttgcagtgcccactttgaactcctgcaaagggtcttggcaaagcaacgcatctgaatgcgtttcaagctcgatgccacctgccgcgcagggttgtgcattcctctgtaccccctcaaccaccacaccgcaccgcaactctccctcctccctcctttcctccaggcgtccagcccaccgagttctccccttccgacctggcctttgcctggggcaccnnnnnnnnnncgcaaagggtcttggcaaagcaacgcatcttgatgtggctcaacctttgatgccacctgccgcgcagggttgtgcattcctctgggcccccccaaccaccacaccacaccacaccacaccgcaactctccctcctctctcctttcctccaggtgtccagcccaccgagttctcgccttccgacctggcctttgcctggggcaccaacgagacctttgccaaccagaccctcgccctggaggccttcctgtcagtcctggccgaggtcgacatcgtgatcgacgagacctttgttgccgacccctccacctaccacctgggcgagttcctgctgcagttctccagcgaaggcgtcttccctaccgccgaggacgtctggttctctgccggaaaggtcagctgggatttgtgggcactcattggctccagagcatgctctcgcgggcgatgcatggttgggtgtctgtcgtcgtgtgttttggaggcactgcggggtgcgactgctcggctgctggccaaaatcacagccctaggcacaggccagcgatgccactgtgaaacaaaaagaataatgcttgcagcctgccatcacccaccccacctcaccacatccgcccctccccacacatccagatcctgcgcacggacggcctgatctccgccgccgccggcctggactggtacgagggcgccatcccccgccccggcaaggtcctgctggaccttgtgtcaaccacccgccccgaggccctcaccgtgagcggcatcgtgcgagggaggggtgtgagtgcgtacttgattgcatgcccatcgcgatgcttgggtgctgcatgtgcttcggccaaaaacccctgcaatcgggccgccttgcggcgtgtggtctttgctgccctgtgctctctcaatggattgcccttcaccttcacaccaagacacccacccacatctcgggccccttgcaggcaccgcacacccccatctggctgcgcaacatcannnnnnnnnntacatctcggccccctcgcaggcaacgcacacccccatctggctgcgcaacatcaaggacgaccccgtcgtggtgaccgccgccgactgcaccaccgccgccaacggctgcagtgccagcccctccaccatctgccccttcatctctttctgcggcaacgggtcgcccgtcctcctggagaccaacctgacgacgggggcgctgcccacggggggcaagtgcacttacgccgcctgccccgccgcatgagctgagctctggaagcacagagatgagcgccagcccacgacgcctgcgttgcaagcagctcttgcgggcgacgtgcgcagccagcagtcacgccccttcccacttgtgcttgtgtgttttctcaagatcgtgacacacaaaaaaaggcagtcggacagccgacacatgttgccgctccggtgctgccggggacacgggctcatgtgcccgaccggctctgctcgccaagatcatgcctccgtctgcattgttcatgcgccgtggaggtgccagttccnnnnnnnnnncgtgtgttttctcaagatcgtgacacaccaaaaaaggcagtcggacagccgacgcatgttgccgatccggtgctgccggggacgcaggctcatgcgcccgaccggctctgctcgccaagaccatgcctgcgtctgcgttgttcatgcgccgtggaggtgccagttcctttccattccctattacccatggtgatgttattgtgctacacaagcttctgtaatgagtggtgctgagacggtaggacaggtatgatcaatttcaatggggcagaccatcactgcagatgggtccttgagaagtcgtccatgtgctcctccatcctcagcagctccgacagctccaggagctggaaagggagtggcattagaggatgtttggagagggagcgaggaaacgcttgaggcaccacagagacaaaaatctgagcaagtgtttgagagtggaagactgtagtatagttgctgtgcttcctcagcttgtgtcatctaaagtatatccgcctccctacccgctcaatgcaatcggtggtgatgaggnnnnnnnnnngagtgtttgagagtgggagactgtagtatagttgctgtgcttcctgggcttgtgtcatccaaagtatatccgcctccccacccgctcaatgcaatcggtggtgatgaggctatcagtccagatcagaaaaatgaaccccggggcccgcacatcggcgactcaccccgtccttattgctgtcaaatactctgtaaaggaggtttatttcatcggtgctcatgggcttgccttggacagactgcatgtggggatcagtaagggatgtatttggtgcatgtcctgggcatgggtctctcctggatcgactgtaacgagatcaaggcttgcaaacttggacaggcatcatggttgtccctgatgcagagagggagatcactggttgctaagcacgacccttgaacactaagcttaggcccaaccgcaaggaatggcatgatcctcacctctctgacgatctgagcaaattcggtcttggtcacttgaccgcgttgtttgatctcctggatcacatcgtccatgtcgtccatgtggaacaccaggagatccctgggaatgacaggggaagcctagtgaaagaccggcccaggtcacagccaagtgccaagggtaatgtgcatggatccctgctggtacccagacagggatgtgcccgccaggatgatcgtcacaaccaactcgttccagatggctctgtcccacatttctcaatcttcaccacacagctgcaccagcagccaccccacctgagcgagcgcatgtccctgagccgggccttgtagcgccgcttgggaccgaacttgtagtacacatagaccatcccgcccatgagcagcccggtgcccatggagcagttcaccacaaacatgaacatgcccggtgcagcctgggagagggacttgcttgggaatgtgtcagactgggtgcatcaggcggggctttggagtgggagtgcgggtgggccgtgggatgcaagagcccaaggagggccaagggcacctcgctcaaggagctcgtgaagcattcccgacttcatcaccccactcagggtcgccgcccccacttgcacacctccaatcggttgtccaggttcatcccgaagaaggccgccggcaccgtcatggacatggccgcaaaggatgcgatgctcatcagcaggttcacccgcagcacccggttccgctggtgatccagctgcatgtgccacaccgtcttggtctgctccatgctggcctccagctccgaaaggtagccctgcatggagtggggttggatgggttacttgtggtgatggatgtggcatcagttgggtggggaaaggggaaggggggaggtccagcgacagcctcgtgcagttgtgcgagcagcggtacgtacctgtagtaaggccctccaggaacgcccccccccccccccccccccacccccannnnnnnnnncgacttgtggtgatggacgtggcatcagttgggtggggaaaggggaaagggggaggtccagcgacagcctcgtgcagctgtgcgagtagcggtacgtaactgtggtaaggccctccaggaacgccaccccccgccccgtcgcaagccagctacaagatctacccactccacaatatcactcacgtgcacggcagtgagtttgaactcgtaggactccaggatggccgccgccatacgcatggcggggctgcgctgcccagcgccgtcccccttcctgctgtacccgccctccgcccccctcagctccttgaaccccggcttgtgcgtccgcttgccggcgaccgccccgggccctgccgcccccggcacgctcgccagggccgccgcgcggtccgacaggcacaggcgcttgagctgcacgtcgtcctccacgatgcaggtcagggcctccagcaggtccttcacgtcctgctgcacctcagtcagcttgcgctggatgggcagcaggcgctgcagctcgcccgaggagttactgaagttgctgttgatgtcgttcagcacagtttcggccaccacgctcagccgccgccccttgccctccagcccgcgcacgctctccgccatcagcgcctccagcacctgcgtcggtgtgtgtgtgtttgggggggtggattcttttgggtattcctatcgccgcccaacgtcgccacgacaggttggggtgctgcgcgggagcccaggcacaacctgccggcagccagcaggcatgcatctgccaccagtaccctcttgcccctccccccttgcccccaataacacatcaccgtgccttgagctcgaagggcaggacagagcgctggccgacggcgctcttgacctgctgtgcgatcctcagcgtggcccgcgtcttgtgtgcggggaagagcacggcgcggtcggcgtacagcaccgcgcgacaggtctccgtcttcagcagcacagcctggttgcgcaccgccagcatcgcgcgctgagtcagcgtgctgtcggtggcaaagaccgacacgtcgcgcgggtgcagccccagcacatcgggcgtcttccacgtctccagcaccgtgccgtcgggcctgaactccagcacctgggtgggatgagagggggtaaaaatggggggagtgggttgagagtgtggtggctgaggccagggggaaaggggccagtggaggtcaatcctccgccggtgctgcaccaggatgaacgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcccggagaggcggggagctggatggcaccagtgtccttcatctgatccacgacccccagggccgcgatctgagaggtgaggggcgtgtggaaagcgcgacacgccggcttgacccccggcatcatgcgctgttgccttggccctccagctggtggagtggctgtggtggtgccaggcggctgcggccggtcggccagagtggcaggcaagcacatcagccacttggtagctgggggtgccgcctggctcattgctttacttgcatccatgctggcccatgcgcccactctccagcttgggtttcttccgactccagacgatgaaagggcagccacatggcgctggaaagnnnnnnnnnngtgctggcccatgagcccactctccagcttgggtctcttccgactccagacaatgaaagggcagccacatggcgctggaaagccgcggccaggttccggcccctatccaccaagagtttcagcctcatgggaaggggaaactaagtcctcctacgcctgctttcgctcagcgacgagaagggcgtcatgcatggcgcgcatgaccgctcttgatcacatgaatgagctctaaagcgccacacatcatgttgcattgtactttgtgagcctccttgatccgagcataggtgagaccggggtgcggcacccctgggtgtcgaagcttggagggaggagggtttcaagccgacataaaactcacacccaagaattggtgttcagcttgaaaaagcctttttgaagtgcctgctgccccttgatggccagactgtgcctggagccagcaggtcatgcaccccggccttcaggacccccccggcgacccctcttccgagagcgccgagtcggagggcgcgaagtccgaaatttgattgcgcagctgatcgcgggtggtcttcaggaagacctgatgggcaggtcacatatacaaaacgcggaatcttactgagattgctttcactgaaagcataggaatggcgcagcgggaacagggaggcgccacggctggggccccgaagacggtcggctgctacaaatgtgggcaaacaggccactgggcacgagactgccccgggagctcgggcgctgctcgacttcaaggcggggcagcagtggccgatggtcagctgggactcacgcccgggtgagaatgtgcctggagtgggccatgttgggaggagctcccaagagacccaacattgtcagcagagtcactttattctggaccatccaggggtnnnnnnnnnntgggtgagaatgtgcctggagtgggccatgtcgggaggagctctcaagagacccaacattgtcagcggagtcactttattctggaccatccaggggttcttaccccaggacacagagggcacgtgccatgtcatgcttccctcctcttcctgcacagatccacccctcccatgacggacgccggcaaccctccgccggcggtggtgaaggagaagcgcaagaaacggaaattgaccctggacctgctcaaggagacacggggtatcccagacgtcttccacaccttccccgacaccttccgaaagcagtgccgggggaagggccatgaggcaggggacctgcgccgcctgctggagatgtacatcagatggcaggtgggagtttgtgaagtgcatcaggggcttctggacttgcttgcctgcatgccaggccgacgaccaggagatcacggggacagcaaaagtcatcctgaggagtatgcagagggtgtgtgcagcnnnnnnnnnnatgtaaagtgcatcaggggcttctggtcttgcttgcctgtatgtcaggcccatgactaggagatcacggggacagcaaaagtcaacctgaggagtatgcagagggtgtgtgcagcatgctcttcttgcctgaggctgtagtgaatggaacagcactcactcccttccacccactgtcgaccccaggaccgggtgttcccgggcgtgccctttgacaagttcattgcggatgtggagcagctcagcggcacgcatgccgtcaagcatgagctgcatgagatgcggatgtccctcctccaggtgctgtcatggcagaacttgagacctgctagcttttgccttgcctgtttgccccacgggctgggggaaagaagtagccatgaacgcagggtgggggtcctgctctgcatcccagattttccctgggcttctgcgcaaagcacaccaggcaacctcctcacctcctcgcttcgccctcccccacccccannnnnnnnnnacgaagcacatcaggcaacctcctaacctcctcgcttcgccctcccccacccccagatggcccaggccaccgcccgcaagcccggcggcggagacggggccgacacggccgccgcgccgcacgcctcgccacccccgcccggcgaggagggggagctgctggcgctcgccgaggatgacgaggacctgctggagctgctgggcgcagagctggtgcagcaggcgctgccggcagtcgaggacctcgccgacaccgaggccgaggagctggccatccccgacgctgatgaggacgagctggccatgctggccgcgctggaggacgaggagctagtgggcctggcctgaggcgggagtttggggggccgggggtaggggcagcggctgcctggaggccagggtggaggggtggaatgtcgggaccacgaagccccgcaggtggtactggaccgtgcacatcatccatcgcatagagcaggcggactgaaagagagtcgcagcatgccagtgcagcgaggggagcagcaagcagagggacacagaggaggaggcaggggggaagggcagcgagggcggccacgcctcgctcgggacttgcagcgctcgctaaccccgctcctccacattccagcggcagctctgggccagctccacgacgtggcccgggcgcgagcccgtcgcccctgggtcaaggccgtccctgctccccagcgccggcatgaagtgcacgctgggctccgcccggggtgccccgcagtgcgccaccgccagggagtgggagcagtgcgccgcgccaaactccaccctgacctcgcagccctgatctgggtgcgctcgctcagacctctgggccaggacgcagatcaccccggcgtcgtttggcggcggtgtctgcggtgttgagggatcgggggcgagaaatgtgtgtgaggcgggccggcgcagggagtgcatcttgccggccctgggaatacacgatgggtaaggggtacccttctgcaactcctnnnnnnnnnnagaatcttgccggccctggaaatacacaatgggtaaggggtacccttctgcaactcctctttgccactgcgggcccagacgccacacctttagaacggagcgtctcaaggcgctgcgcagtgcgccgctcaccccttggtcgcccgcagcggcccgcacagcgtcagcggcggtcttggagaggaggcaggcggccactcgctcgcccaccccggtggtgctcaccgcgacgccgtgcatgctattggttttggagcccagaggcgccgcttcggaggccccagtctctccgcgcaacctccttcccccgcttttctccttggtctcacgctgctgctgctcctcctctcctgccccttcctcctctcctgcccctccctcctcctcctcagcccagcaccccgcgccgtagagcgccgcctcgccaacccggccctcctgcttcagtgcaatgcctccgctgctgacgcccgaggccacgtggcccctgccgtccaccaccaccgcgcccacggtgtcgaagagccgctgctgctgcgagtccggcaacaccaccccggagtactcgccggtggcatcggccaggatggctcggaaggtctgccactggcgcaccgcgcgcggcgtcgagtgcatctggtggcagggtggatgtttgtggggaacatggcggaggctgcagctgtgagtcgtgggcctcgcttgcatcaggatgggaattggcacaggcagctttgcacatnnnnnnnnnnagggaacatggcggaggctgcagttgtgagtcgcgggcctcgctcatatcagtatgggaattggcacaggcagctttgcacatttgcaggtttgccccacctgggctgcctgctcacggctctcagcagcctccagcccacgctgtgccgcccagacgcgcgccccttcgccagccagcatcctgcaatggggcatggcgagatggggctgggacatagcacaacacacaatggcccatgccgtgcatgtggcggccctgcccttcattnnnnnnnnnngaatggggcatagcgagatggggctgggtcactgcacaacacacaatggcccaagccgtgcatgtggcggccctgcccttcattccacatgcagtcacagggtctggcgcaaggtgtctgaatcttacgtgggtcggatcaggccacatggcagcggctccagggtttccccggcgagcaggctggcagccttcacggggttgcgaatcccgggcacggccgccaccgctccatagcaggcggtgccagccatgaccgaagcgtcgcactccacgctgccattgaaggtgaggttcgaccctcgtcccgcattgcatgaagggtcatcctgcttgagggtaggagcggagggatgggacgggcttgcatggcatgggaagtggggcacagaatggagatgacggccgggcagacagtgccccgcccacaccccacgaccacaagcgctggccctcactcgcacctcgagcacagannnnnnnnnnaaagtatctcaggattccaacatatccggcgtgcgcatgattcaacacttcaaagcatcagttctatcagccctgtttctcactgcctgannnnnnnnnntgcagacagtgccctgcccacgccccacgaccacaagtgctggccctcactcgcacctcgagcacagagatggcgttggtgacggcctgcagggcagtaccaccttctcgcagggtcttccttgcagccctgcatgctgccctgagggctggaaatcttgcannnnnnnnnnnnnnnnnnnnnnnnnnnnnnnnnnnnnnnnnnnnnnnnnnnnnnnnnnnnnnnnnagcattgacttggctcaccgcgggctactttaggctgtgacgacttgctgtggaagcctgcacctgcatgtacggcgatgaagtagccaggtgatgcatggctgccaagcgctgcctcggtggcgcgcctttggcgcttgcctagcgtcatggcatcttttctgggagtgtggccatcgatcgagctcaggaggaggggtggtcaagctgggtcgtgctctttcacacgcgcagactcgcacagcaccttggcgtcgatgtcgttcacttgcagtacatcttactgttatagaattaactttagcaattttggcacgctggactaggccaaaattcgatcgccattgcagacaccattcgacgatctcgacaatgcgcgccccatgaacctactagtgcatgtcttggtcaaacaatacatgcgattctttgttatagggctgatcgaaattgccacctgtatatctaggtattctactattgtatcaggagcggagcaagggctcgcaaagttgacttggttgcctgtagagtccaacccttgtcgctctggttccgagcacgccgaccgtgtcagccctcatcacaaccccgcatagactgattacaggtacttctccatgagcgaagccgtgcgagcgtatcgaagtctgctccgagcggtgaagacgcacgtcagctcctccaccggcaacccggccttccagcaatacatcagcacgacattgaagcagcgagcacgggcaggaggcgaccccgagctcgcccgagactatgcattcctcctgaacagcattaccgagcataaggtgtgtgccaggcgagcatgaattgtgattcagccttggaggggggggacaccttgcacaactcacttttttccctcggaacaccccacaccaaccacaggacttgctcttgtcatacaacatcggcatcgacccggagcagcggcaaaaggaccagtacaagaaggccgcgtcgcgtgttggtctgtccctgccagagcaattttcaggctagaggatttcagcagccatggtgctcaccaagcacatttacggtgtggcaatcaggtaacgaaagcaagctctgctctgccttgacaattgaaggacattacaccaaggagctcagtgtgcaaggtcgcaagctgtacagtgccgacgctggcccaaacaggagggcgcaggggggaacgaacacaaacgtgaatggggtgcattgcaaggaagaggccgcactggtaaaggatggtaccgaggggggagaggtccacgcaaacgcatcgggagcatggcaggttgtggcagcattaaagcgggggaatgcgcgaggtctaggtacggcaacgggggaggtgctttggagggcaccatttgcagcaactgcacctcgacggttgcagggaagaccgacacggcaactccgtcgggtcagtgcccggggcaccgagcatccccacagactcgcacctcactccgcgccaccgcgcccgcggggcgcgtccatctcgcgcagcatggcctcgacggcggccgcagcgaaggcgcgcctggggctggccgggcccgcggccgcgggctcggcgccctccctgggccgcacagcgcgcagcgc

SEQ ID NO: 32793 - DNA, 77 bp, Chlorella protothecoides
agagagcgaggaggttgcctcggtccagggacaggtgtgcctcacttgggttgcgcactcgtacctttcgatggcca

SEQ ID NO: 32794 - DNA, 92 bp, Chlorella protothecoides
tttttgcaaacgggtttgggctagggtggcattagaccgggaatcaagtattgacccgggttggtctcatttcgcggtgaccaagatcctcc

SEQ ID NO: 32795 - DNA, 462 bp, Chlorella protothecoides
  modified_base (104)..(346): a, c, t, g, unknown or other
atagcagaagtacatggatcctgcttcgagtaccattcacttcccatatgccacatcaataaatgtgttgtatgaacttttattcatttcctttcctcaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcggcaggaggctgctgtgctaccacttgtggatttgggtgggcaaagttgattgctgctctgccctttctgccatttttcaacgtgcggcctcattcgatgcaaacctacttg

SEQ ID NO: 32796 - DNA, 61 bp, Chlorella protothecoides
aagacaatcacgcaatattttgttgatcatgtcattcgctccacattgccgtggctccaga

SEQ ID NO: 32797 - DNA, 61 bp, Chlorella protothecoides
gtgctgggcagcggggagtgtttggtggccttgcccgaggtgcaggggttgagggctgctt

SEQ ID NO: 32798 - DNA, 73 bp, Chlorella protothecoides
aatgtagacaaccccatgccaagaaacctcacttaagcctcccaagcacccacttggggagcagggaggactg

SEQ ID NO: 32799 - DNA, 61 bp, Chlorella protothecoides
ccgcgcctcggccgcgggcgtggccggcaccttcctggtgctgatgaccaacctgagccac

SEQ ID NO: 32800 - DNA, 68 bp, Chlorella protothecoides
agatgcggcccgcgccggggtcgggcgaggtgatggatgtgccgtggtccgctgatcccgggagctgc

SEQ ID NO: 32801 - DNA, 77 bp, Chlorella protothecoides
tacttgaagcagtgcaaacgactgcaccccggaagtcctgctccccccacaccacgtcggtgacgagggaccgctcg

SEQ ID NO: 32802 - DNA, 61 bp, Chlorella protothecoides
accgcccacctgcggtcggagcttgctgtgagtgggccagctgccacagtggcgagagcgc

SEQ ID NO: 32803 - DNA, 86 bp, Chlorella protothecoides
acataccaagactgtgtacttggtaacatgtaccaggatatgttggcacacacaatgttgtcatgaattgggagcagtctgcattt

SEQ ID NO: 32804 - DNA, 80 bp, Chlorella protothecoides
agatcttcacttggaagagtgcgtggtcctggagggggcctggcacacgggggggactccctctgtgttgtgcctcgccc

SEQ ID NO: 32805 - DNA, 80 bp, Chlorella protothecoides
accctcggtaggcagccgctggcgaggtgcaggggttccctgggggagcacggcgaccggccgccccctcccagtgtgcc

SEQ ID NO: 32806 - DNA, 74 bp, Chlorella protothecoides
gaaccccaatgagcgaagatttggacactgtatgctacagtactggatactcttcaacttgtacgtttcggttg

SEQ ID NO: 32807 - DNA, 79 bp, Chlorella protothecoides
atggtgttgatgcccgttcaagcctgtcatcgcctcagggaggtgagttcctgccgctgctgcagcctgagtggcggca

SEQ ID NO: 32808 - DNA, 229 bp, Chlorella protothecoides
agcggcctcggccaggttcgccgcactggcaccaggccccaacgtggtgagctgggggcccgacgcccccgcctccgcttcatctgggccgcggaaggtgagaggggaggctgtgggtgagcgctgagaggccaagaagggggttgtagaagggacagacgacagtgcctgcatgagtcttcatgctgcggactcggcacccgaccggatcgcccggctcacccccatc

SEQ ID NO: 32809 - DNA, 73 bp, Chlorella protothecoides
aagagcgtgaaggctgtggttaccgaagacaccgcatgggtccctcgactggaaacgactggtgctgggaatg

SEQ ID NO: 32810 - DNA, 74 bp, Chlorella protothecoides
ccctccctgcaacaggttaccaaggcagtggccaccggcccccgagtaccctccttcaacctaggagggcggga

SEQ ID NO: 32811 - DNA, 72 bp, Chlorella protothecoides
tcggggtgcaaggtcggaaggctttgcgagcagcaccaccagccagaacatggagaaacacacacctacctt

SEQ ID NO: 32812 - DNA, 61 bp, Chlorella protothecoides
atcccgccagcagggcgaattgctcgggccggtcgagcgtagcgatcacgctggccaccag

SEQ ID NO: 32813 - DNA, 80 bp, Chlorella protothecoides
actcgccgcgacgggggcaagctttgtttcggttggtgcgtggggaagaaagggggtcttgtgtggaggtgaaggggacg

SEQ ID NO: 32814 - DNA, 61 bp, Chlorella protothecoides
cggcatcgccctggagctgcgcaagttccccaagaccctggccgtgggcctgcgcgtcgcc

SEQ ID NO: 32815 - DNA, 61 bp, Chlorella protothecoides
cttcttcacgccgcgtagcggctgggccgccccgctgcgcgtcgagaacgcggcggggttt

SEQ ID NO: 32816 - DNA, 72 bp, Chlorella protothecoides
gtacgaatccgagagcgatagggcgcaaggtcgcgccttggcggcgagacggactgagctcatccgaaactg

SEQ ID NO: 32817 - DNA, 61 bp, Chlorella protothecoides
tgcgaggagaggaagttcctgaacggcaggggggacttgagagcttggcgatgtaatgctc

SEQ ID NO: 32818 - DNA, 61 bp, Chlorella protothecoides
tgcagcccagatgccccagccctggaaaatgactcgctccaccctcctcgctcctcaccat

SEQ ID NO: 32819 - DNA, 76 bp, Chlorella protothecoides
cgatgcgtcggcggcggctgggtcggcccacgcgtcggcgtgcgggccgcgcggccgcccggcgcaatccagcgcg

SEQ ID NO: 32820 - DNA, 78 bp, Chlorella protothecoides
tcatgccctgccaaggtgggggggtggaggaggtgtgggcacctgtgtcatcgccggcatcgcagtcgtgctgctgct

SEQ ID NO: 32821 - DNA, 77 bp, Chlorella protothecoides
gacagcaggcccaagtgcccggtgcttgggtgcactgctgccgggtgcacagcgctgtcggcctctgacaatccgcg

SEQ ID NO: 32822 - DNA, 65 bp, Chlorella protothecoides
ctcgcgcaaggccctgctggcccgggaggccggcggcggggagggcgcggcgggggccggggagc

SEQ ID NO: 32823 - DNA, 101 bp, Chlorella protothecoides
ccgtcacagggtgctccacctgttgatgttgtttgagagaggagaaggggggagaccgtgttaaagtgttaacctggttgagagcgcctgtacaaaatggg

SEQ ID NO: 32824 - DNA, 73 bp, Chlorella protothecoides
cagctcgtagcggtagccgcggcacacctggtgagagattgtggagggggaggggggttgactccatgaccgt

SEQ ID NO: 32825 - DNA, 61 bp, Chlorella protothecoides
tagtgttgccacaccctttgagaggtgagtcgacagtggtgctgagaccaacacttccctt

SEQ ID NO: 32826 - DNA, 1233 bp, Chlorella protothecoides
  modified_base (238)..(481): a, c, t, g, unknown or other
  modified_base (623)..(769): a, c, t, g, unknown or other
  modified_base (873)..(1015): a, c, t, g, unknown or other
cctggatggcattcaggtgggcatgccggcatggccatgccttggacgggcaatgctcattgcatatcgggcatcttcttgtaaattacaaagcttgcttggctgtcactggccggcaatgatacatggcaccagagtcgttctggtgtgtgctgttctccaacctgcaggtgtataaaccagcttgtgccgtttcccaccccttggcatgctgcccacacacaactccaacccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagcttagcctggcacattgtcgcgggagattgcacttagtcaccgcagggcagccactcaatggacctactgcccctggcagtgacgcggctgcagtcaattgcgcactactgtgcagtctccatgacactcctcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcaccgtctacacctctgcataccttatctggtgctggcacatgcgcctttcctggacaccagtccatcttagcatgaagcagcagttcctgctggacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggagcgctcatcggtgggtgcacgacaagtgggtgggctccattgctggcgcaaatcgagtgctttcaaccgtagagtgactggggctcattggcgagggcctaggaattttgaaactgattgtgtcccgaacctgatgtcgcacattcacttgggcttgccgggccgtgattgctcctcagcccactcataaccacccccatttgggcaggcatc

SEQ ID NO: 32827 - DNA, 69 bp, Chlorella protothecoides
tctgctggggtctgttgaatgaatctatcaacagttgacagctgtgagggcagttggaaggttcgtttt

SEQ ID NO: 32828 - DNA, 83 bp, Chlorella protothecoides
gcttccagcctgacccctcccagttcggcgtccttgggctggccatggacacgggcgcggcggccgccttcctggcggcggca

SEQ ID NO: 32829 - DNA, 67 bp, Chlorella protothecoides
gttggccccatgcctggtgtggattctgcatgcaaggctgtgcaggaaccagtgacgaccaggacgt

SEQ ID NO: 32830 - DNA, 65 bp, Chlorella protothecoides
gttgcccaccagggacacatcctatgaagggctgcccccctgacgcacagactcggcctcagcca

SEQ ID NO: 32831 - DNA, 61 bp, Chlorella protothecoides
ctcctccaggctggactcgtcatcgccggagaggatgggggcggactcggcgtgtccactg

SEQ ID NO: 32832 - DNA, 73 bp, Chlorella protothecoides
tcgcttttatgttattcatgacaatgagattcagatttgggcttacggaggggttgcacgcatcgatgctggt

SEQ ID NO: 32833 - DNA, 74 bp, Chlorella protothecoides
ccaggtacgccgggaagactgcgaggactatggccggcgcatccccaggttccaatactcccagccgggccaag

SEQ ID NO: 32834 - DNA, 89 bp, Chlorella protothecoides
ccacgtgagtttggcgggggagcatgctttttggctgttgcggattagaggacctccacctctctgcatcagggatcataggggctgtg

SEQ ID NO: 32835 - DNA, 78 bp, Chlorella protothecoides
catgcatggggccatgaggtcgggtcggcaggggggggggccagttttgggcggcactcgcacaattcccgccgcagc

SEQ ID NO: 32836 - DNA, 79 bp, Chlorella protothecoides
accgcagtggtacctgaggagggtggcgagattgcaaatggaaatagtggactttgactgaaatgaaaatgacacactt

SEQ ID NO: 32837 - DNA, 75 bp, Chlorella protothecoides
cgcggccgcgcgctttgccatgccaggtggaggggacgtggaaagagattggtgacgcattgtgtcagtggatcc

SEQ ID NO: 32838 - DNA, 143 bp, Chlorella protothecoides
ctgcttcgcgcccgcgcccttgaggccgggagtgcattgtttcagacgaatgggcattggtctgtcaatggcacggcgtccagcacgacctctacgctgagatatttccacttttgtcgagcgctggtggacgtgcgtctcat

SEQ ID NO: 32839 - DNA, 127 bp, Chlorella protothecoides
acgatgtttcccttcatgcacgcccggtgacaatacagtacgtgtgccagagccccgcccccccagcacctcggatcagcttctccgccgcattcggccgccctccttccattctgctggattcctg

SEQ ID NO: 32840 - DNA, 78 bp, Chlorella protothecoides
gatggagggggaagagagggcgggggtcgatgcagatgttctgacgatacaacaggcatgcgtcttgatctataacta

SEQ ID NO: 32841 - DNA, 73 bp, Chlorella protothecoides
agcgctcgatgggcttggggctggactcggtgggggggtgtttggtggagaaagggttggactcggtggagga

SEQ ID NO: 32842 - DNA, 74 bp, Chlorella protothecoides
ccccgccatggcatcctagaggactgggaaccacaatcctgtagactgacatccatctctattctcccccaggg

SEQ ID NO: 32843 - DNA, 61 bp, Chlorella protothecoides
cgagctgcgggccctggagacggagcgcgacgagctgcgggccctggagacggagcgcgag

SEQ ID NO: 32844 - DNA, 70 bp, Chlorella protothecoides
gcaaggaatgtggagagatgctcatgaaagatggcctcggccaatggtgatctgtcggcccaggccctcc

SEQ ID NO: 32845 - DNA, 182 bp, Chlorella protothecoides
gggggggcgacagcgtgcatgcatgcaccacggcagggtcccaggcgcgcggagcgtgcctccccgcgatcccttctgtgaacgatcaccgaccatctcagatgacgacctgatcgccacaccatacccccccattccgccgcacctcctttgcctgcgccttgccctcggccacgtcccgg

SEQ ID NO: 32846 - DNA, 200 bp, Chlorella protothecoides
ctggcgtgctcaccaggtaggcagcatgtacaatggacacccaggctgcaagtggtagaagagggtactgtctgtatggacctggtttcccacatcctcctgtgcaatgtctctgatcactcgtgacaaccttgtcatgctgaataccctgcagatcggacatcaacaagttcaaggagctggagatccagtaggctgca

SEQ ID NO: 32847 - DNA, 151 bp, Chlorella protothecoides
gcctggtgaggaggtcgaaaggcaggagctaagcagcggtgtgaggagcaggcccagtcgtgagtccatccagatcctccactatcattgagtttacttcagaccaccaccccttacagaaacacaccagcagacgacacttgtgtgctgg

SEQ ID NO: 32848 - DNA, 61 bp, Chlorella protothecoides
cagctgaccctcttccacccctctcgtccttcttagcattcatgcctgccaaacatccaac

SEQ ID NO: 32849 - DNA, 88 bp, Chlorella protothecoides
gcgcccggtcaaggggaaaccccacaacactcgagcccttccacagcgacatcgaccaccacccgccgcccgtcttcgtcgacgatag

SEQ ID NO: 32850 - DNA, 638 bp, Chlorella protothecoides
cccctccatctcctccacccccccctccgtctcctccaccaccctctccgtcgcctccaccctcccctccactgcctccaccatcccctccgccgcctgcaccaccccctccgtctcctccaccccctcccccaaactctccaccaccacccccagctgatgcatgcacgggtgcgccagtaatgacctatctcgtatgcagcagaggcctttacccaaccatctgcattcgaaacggtgtccaaaccgctttctgtattgcaacaattccaagcactaccttggaatgcgcaggtcagtatatcgacaccgccaacggtgtatgcaatatcccctcacgccccgtcatgaaggtctgcgtacaagaggagagctactatgcggagtgcttcgcgtcttaagtagcccccacactgtgggctgctgtcaccaatatgaactggaaatagtacaggacatatccccagaggtggtgtgcgcattgggtgtcattgccatgggcgcatggcgggggcaatgtgcggtggttgggtacatgtagagagggaaacgtgcctagtcagggtgggcccacgacatcctccctcgcctggatggcaggcctgtcctcagcctgcgctgcattgagaacggcgagg

SEQ ID NO: 32851 - DNA, 62 bp, Chlorella protothecoides
cctttgatgcccgaggaagaacacctcggtcccccgtcattctcctgggcggatgccacaga

SEQ ID NO: 32852 - DNA, 109 bp, Chlorella protothecoides
gagagcatgtagagcttgtgtaatcagcagccatgggattttttatgcagcttcgaatgcagaacctgggtgcaaggtgggtgcgaggccgttggatgtcgtcgagggc

SEQ ID NO: 32853 - DNA, 62 bp, Chlorella protothecoides
atcaggcgctcccaccacctgcccgagcctctcccctcccccacctacgttcccagctgcag

SEQ ID NO: 32854 - DNA, 121 bp, Chlorella protothecoides
gcatttggggagccggcggccagcccgcctcccccctcctccagccagaaggtgggtgggccgtggatagggccgggactgtcgttaaaactcctctctgatgctggactctcactctcag

SEQ ID NO: 32855 - DNA, 2224 bp, Chlorella protothecoides
  modified_base (672)..(681): a, c, t, g, unknown or other
  modified_base (825)..(834): a, c, t, g, unknown or other
  modified_base (1312)..(1321): a, c, t, g, unknown or other
  modified_base (1855)..(1945): a, c, t, g, unknown or other
cgggaccacgccgcgcggcgcgtcggtgccgcgcgagacgcgattcaacggcgccgggcggacctgcacgtggccgactccctgtcgcggggtgttgcgcgcggcaaggccgagctcgccgccgccctggcgcgggcacgcgtcgcggtccgcgcggtcgtagacaaggtccacacctgggcgcatgaggccgtcaggcgggcgcgcggagcggtcccttcttctcccgccaaggtgtgtgggaagagagtgcgcggggccgggagctgtcgacgggaggctgaagggactttgatgagtgtcgcctgtgatgggggcactctgacgcggcatgccatcccatgactggctcgtgagggtgctgacctgaatgcgccccgccacacctatcacttgctctccctcacacaggccgtgagcggtccggcggccgcgccggctgcaggcgggccggcgccgaaggcgggcgccccctgccccgccgaccccgccttcctgcagacgctggtgccgcccggcgagcagtggcgggcccagctggacgccgccagcgacatactggacggggagaaggtgcaccatgccaaggtgcgtggctgccccgcccctgtgagggagggtcctgctctggaaggggttcgcacagcgggcgcgtctgggtggaggtctggnnnnnnnnnnatccctgcgagggagggtcctgctctggacggggttcacacagcgggcgcgtctgggtggaggtctggacgagctcgatggtcctgcgctcccctccccagcaccctgcttgaatcgtttgaaagtggcacctgccaccccggnnnnnnnnnnggagctggacgatcctgcgctcccctccccggcaccctgcttgcatcgtttgaaagtggcacctgccaccccggccgtctgcccgaacgctgcactcccctgcccccacccccgtgccgaagacgcaggccacggtcctgctgctggcctatggaggcgaggagcagaggtcggccagctttcctcagttggccaccgtggcccccaagggctgcgtcaggaacatcgacgtaagggtggccttgctcccaggctgcatgacgggtgcgcatgcctgctgtatcgacagtcactctgaacgtggtgacccaaatgtcgctcacatgggggggcccaagccttctgcttctatccccctcgcctgccctctgcgcgccctcctcacgtgcccgttgcctctcccttccaggcctggatgtttgctgagcctggcctcctccagcgcaagctcgccaacgacctcaccgcccagccctcnnnnnnnnnntccggctgcatgacggtggcgcatgcctgctgcatcgacagtcactctggacgtggtaacccagatgtcgctcacatgggggggcgcaagccttctgcccccgtccccctcgcccgccctctgcgccccctcctcacgtgcccgctgcccctcccttccaggcctggatgtttgccgagcccggcctcctccagcgcaggctcgccaacgacctcaccgcccagccctccaccatcttccacgtgcaccgcgtcgagatggtgaggcgcaggctgttgtgccccagccttgttcccgcgagctggtctggcatggcagcaaacttgtaggggccgtccgcacgtccccgcccccagtgcctgaagcggggcgatgactttcgcgagatttcgccgccccagtctgaccccctcaccctccaaaccgctcccataccccgactgcagctcccccccgcatccgtccccgtgctggtgaatgcattgtctgagggcggcggctttgagtattcggggaccgtctccgcctcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgctttgagcccggggggatttcctggcgaggcctggggtgtggcgtccgccggtccctggcggaactgtgctccgtgcggctttggcctgggcacacccctgtcgttgcattctcttggatcaacccctgtttcagtcccaggcaccagcaagcatgccgctgcaaggcgtccaggccagaatgcccacccccccaatcgttgtgttccctgcatcaccatggtgcacccctcgaccccgcatacacacaggtcgacggcgacgcgtttgcgacc

SEQ ID NO: 32856 - DNA, 91 bp, Chlorella protothecoides
ccgatgcagattccatcaccatcagctttcgggccgcgacgggttagtgggaccggaacaccgcctgtcctcgtattcgccgacgaggaca

SEQ ID NO: 32857 - DNA, 61 bp, Chlorella protothecoides
gctgccgcccgtgcctcgagccacgagcccaccacccctcccacagcggactacatggccc

SEQ ID NO: 32858 - DNA, 126 bp, Chlorella protothecoides
acgccgggcccacagccggcttgtaatttttgtgagagtagaacggacaaggatgggtgagaagtaagtttgaaatcctcctgcaccaggcattgctgcagccatgcagtggggatgccggaaaat

SEQ ID NO: 32859 - DNA, 127 bp, Chlorella protothecoides
cgcttcaatccatcctgcagggggggaggtttggggacgagtgtgggtatcgattcagaatgtgcccagaaggggcccgacaattatagacatggcggttgagaaggcagcttgcggcatcgcctgg

SEQ ID NO: 32860 - DNA, 61 bp, Chlorella protothecoides
tcacctgtcaggagttggctaccctgaaggcagaccttgcaaattccatccccaatcccag

SEQ ID NO: 32861 - DNA, 576 bp, Chlorella protothecoides
  modified_base (166)..(175): a, c, t, g, unknown or other
gcctccgcggccgccgcggtccacgtcgccccacccggcggcttccacatgcccgggctgggcgcgctgcccggcggcgacggcggggacaggggcgcggggttcgcatccctgggccacccctcgggccccctccgccccggccaggagatcgcggcggaggtgnnnnnnnnnngtccctgggccacccctcgggccccctgcgccccggccaggagatcgcggcggaggtgctgtctgcgctgaagcccctctcccccgacgagttcaccacgctgctgaccaacttctaccgcgggctgaagggcaagtacaaggtgcccacctttgcgcatcgcgacctcgacctgcacaccgtcttctgggcggtgagcgcgcggggcgggtacgagaccgtcaccgccggcaagcagtggaaggagatctgccgctgcctggacgtggacctgacggggcagacctccgcctcctacaacatgcgcctcaactacgagcgctgcctgctggactttgagaattacctggccagcgggaaggtgggttggatgggtgcagggttggtgggggcgggggggg

SEQ ID NO: 32862 - DNA, 102 bp, Chlorella protothecoides
acatgctggcggcagttgaggggcctggatgtgattgtgcgtcaacctaagaaaacctctgctctcttctaccatgcttcgattctacaatgctgtcaagct

SEQ ID NO: 32863 - DNA, 66 bp, Chlorella protothecoides
gcatgtgctggcgcacgagtgccgagcgatacagtccctggctgatgcagcccaaagcccgcgtgc

SEQ ID NO: 32864 - DNA, 70 bp, Chlorella protothecoides
tctcccaggcactcactgccagtccccttctccaaacagtccccccctcacctcctccggcgcctccacc

SEQ ID NO: 32865 - DNA, 75 bp, Chlorella protothecoides
aagcccgagaacatcatgctggtggatagaaagcgcagcgacgtcaaggtaggggctccgggacggccatgccgc

SEQ ID NO: 32866 - DNA, 2134 bp, Chlorella protothecoides
  modified_base (108)..(117): a, c, t, g, unknown or other
  modified_base (1343)..(1352): a, c, t, g, unknown or other
ggcgaagaggccggcgaggcggccggggaccaggccggcgccgctgacgcgcgtggcggtgctggcacgggacgaggcgctggcggtgcgcgaggcggaggaggcggnnnnnnnnnntaggccggggccgctgacgcgcgtggcggtgctggcgcgggacgagccgctggcggtgcgcgaggcggaggaggcggaggaggcccccgtgcgcggcgaggccgagccggggaagaagaagaggtccgacccggcgtccacactgcgcagcgcaaacccctcctcctcgtcgtcggaggcggcctcgtcgtcggaggcggccacctcgtcatcggccccctccccctcctcgccctcgccctcctcacgcagcgagtggcagcgcgcggcgtcgacctcgcgccgcgccgcgtagcagatgcgctccagctcgctggcctcctcggccatgccgatgagggggcgcgtcatgacgcccgcgatctcggccaggctcagccccgccgcggcgcagcgctggagcaggagggtggacacctccaacaggcgcagcgactcctcgcgcaggctgggcagctcgccgcgcagcatggcggcgtcggcgcgggcgtccaggtcgcggatgtactccagctcctcgcggccgaagggcatcatggcctgcggccagtgctgccactcaaagtagggcggctccagctcctcgggcagggcgaagccgtggtcgatgggcaccagctcgtaggcgggcacgccgcggtccagcatgcccttggacagcgggcaggagggtggcggcggggggcagggggagccggcgcccgccgcgccggccccgcccacgacgccgctgggcacgcggcggaccaggatgttgcccgcgtggcgatcggtgttgaacaggcggatgtccaggatgccgatgcggtgcacatcgcgcacggggaagcgcgaggcgcccagctcgctggtgtcgcactcgtgcgccacgaatgcctgcaggctgcccagcttgcggggcgggtgcgacgcgggctcggcggactcggggacgggcgccgccgtggcaccggaggacagcgaggaggaggaggaggaggcagcggtggggggcggggcaggggcaccctcctcgcgcggggctacgtggaagatggggtggctgatctccaccatcacggtgtggggcacgcgggagaagtggccacggtcaagcaggtaggcggccacctgagagggggttgagagaaggggagaggggggaatcagacaaacaggatctctcctcggaaatgacactgtgtgcacgaaaaaaggggccacactcaggctgcctttcctcaccnnnnnnnnnncgagagaaggggagaggggggaaatcagacaaacacgatccctcctcggagatgacactgtgcgcgcgggaaagggggccacactcaggctgcctttcctcaccgggtcccacttccctcatcccaaatcccctgcagaaggcacacacctcgcgtgtcgcggcctcgccgactcgcacggtgggcttgagtcccgggtcgcccagctggcgcccgacgaagcccttggggttgttgggcgccagtggctcctcgtcgcagggcttcatgatgccgcagcgcgcgccgtcctcgtccctgaagaagtaggtgccgccaaagccctcggccgcggcctccggctcctgccaggccctcagcccgcgcactacgcccttgatcaggcgcttggctccgggggtcagcttggcgcattgcgccaggtgcagctcgcccgcgtccccgcccgccgccgccgactccagggagccggaggcggggggggtgagcagggggctgaccgtgcggcggccaaaggagcccaggctcagcagcgagggctccgccagcgagccggccgaggtggacttgagggcgggcggcgcggcggccccgcccgccttgaccacgaagccgcgctgggtgacagtgaccatgccgtccatgggaggggagacgagggcactggcggcagccatgacggagcggatggtaggagaggggggcgggggccggggacgggagggtgtggagagcccagcctgatggtgccagtgagggggggggggggggggggggggggg

SEQ ID NO: 32867 - DNA, 7628 bp, Chlorella protothecoides
  modified_base (1426)..(1435): a, c, t, g, unknown or other
  modified_base (1851)..(1860): a, c, t, g, unknown or other
  modified_base (2377)..(2386): a, c, t, g, unknown or other
  modified_base (4075)..(4084): a, c, t, g, unknown or other
  modified_base (4278)..(4287): a, c, t, g, unknown or other
  modified_base (4597)..(4633): a, c, t, g, unknown or other
  modified_base (4829)..(4838): a, c, t, g, unknown or other
  modified_base (4918)..(4927): a, c, t, g, unknown or other
  modified_base (5268)..(5277): a, c, t, g, unknown or other
  modified_base (5568)..(5577): a, c, t, g, unknown or other
  modified_base (5922)..(5931): a, c, t, g, unknown or other
  modified_base (5999)..(6008): a, c, t, g, unknown or other
  modified_base (6066)..(6075): a, c, t, g, unknown or other
ggcttgcgcgaccaggccgacgcggagccagccggcgcgccgccccgcccccggcgcgtgcaggccgccagcgaggagcagggccagggccaggccggcgcccagggccaggcacagggtgcgcagcgcgtaccctgccacacgaacctccaggaaccagaagtggtggtgcaggaaccaggccgcggccaggagcgtgcccaggacgaacaccccgtagtcgcccgcccgccgcgtctcggcccaccctgccagccccgccgccgcagccagcggcgcgggcatgacccagagcggcaggcccagcgccagtgcgccgaccgccgcgcccaccaccagcaccggccccgccatcgcgcgctccacctcaggttccagcgcccccaccgcgtggagcaggagcagggcggcggcgccgtacaccgcgaccgtcaccgccaggtagctccagggcgggggcaggcgcaggtactgcgcgtaggagcggaagaccacgcgcgcctccagccccgccagcgccgccgccagtgaggcgaggagcagcccggcgcgcaggcggcgtacgcgctcgccggcgcccagccaccagaggccgcgcggcatgcaggccaccgccaggagcgggagcgaggccaggagcagcaggctccaggcgtgcacccagtgcgccaggtccgccgcctccgccactgcgtacatgcccgcaggcagcgtggccaccaggaagaaggccgccgcgccctcccccggctcctgcaccgtgccggcggaggagggggggccggcggtgcccggcctcggccctgcgtatgtaagaaggggttgggggggggttgggggggggagtgtggaataggtggctcggcgggtacatgaaggtgcggggtgccttgcggtatggccaagggagtgacaatccatgcatgtaaaggcaggtgcatgcggtgcttcctcccccttgtcatgcgttacccccccaccccttccacccccaggaatccaccaaaccacgaaaccccccacccacctcgcccgcgcggcgccaggctgggctccaggggcagggccagcaggtggtacagcgtgcacagcagggccacaaggaggaagggcgcagcatccacccccgccgcgacggtcagcgcccaggactgcactgcggccgccacggggaagctgccgccaatgagcgtcttctcaaagccggcgaccaccacggggtactgcagctggatccagcggaactggatggagatccagaggcctgtcaggggatcagtgcgggcgtgtgtgtgtgtgtgtgtgtttgaggagcgaggggcttggggttggaggggaaagcgtggcgcggcagaggtggcgcagaaacgagtgcagggtggaatgtcccccgcaaacctcgcacccgtgagggccaggcacgctnnnnnnnnnnagtgcgcgcgtgtgtgtgtgtgtgtgtgttgaggagcgaggggcttggggatggagggggaaagcgtggcgcggcagaggtggcgcaggaacgagtgcagggtcgaatgtcccccgttaacctcgcacccgtgagggccaggcacgctgcagtgatgagcaagacgagggcggcgaggatgcccggcatttcgctggccaggaagagtttccccgacgcggcggccaggagggcgaggcccagggtggcccaggccgcgccaaaggccatctccttctgcctcagggtgtccaggatgtacaccgccatgccccccacctgcacggtggttgagcaagggaactcgcacaagttgggggaggggtgcagtgggagagtcccttccgtcaggtccccaaccccatgccagtagggtnnnnnnnnnntgggacctcgcgtaactcgggggagaggtgcagtgggagagtcccttcggtcaggtccccaaccccatgccagtagggtgacgtcgctgaagccccccatctcgttctctcctcaaagccaagatgccgcaaagtcgcctggcgtagcacccaccatgaggatggaagccatggaccctccatcaaatccggccaggataatgagactggggagcagggccgctgccaccctctcgttgtaggcgaagccgatcggttttgggggagtgctggggagcgggggcagggacccccgccccgcggctgccaggctgccagccccgaacatcagtgcttgcaggtgtgagtcagtccctgcggaccctcatggccactgcttgtgggaatttcggatcactgcttcaccgtgtctccgcatgctttcatcgacatatcgatcaagtactgcatgtccgctcggaagggaacacaggtgcaatttcaatgtgtgccggagtaagaactgggcgcgcgcagnnnnnnnnnnttgcttggaagggaacacaggtgcaacttcaatgtgccggagtaagaactgggcgcgcgcagatcacatcgacatgtgaagaccgacaagaaggtgcaaatacgacatcgcccaacgaatttctgtgcatgctacgtggtacaactggagataagagcgaagacaagagctctgtgcagagcatgtaggttcccagaggagaccgcgaacacatacgcctctgccaagtgtgaaattagagagtggtgaccggcacaagccctgatcgcctgagacgctgtcgacatgcgttgggcgtatgcccttggaggcagtctgctggtcctgggcttcctcgccggcttcggggtggacagggtcgtgcaggaaattgacaggcgcgtggagtctgccatctcggagcaggtcatctggcgccccgactccccacccagcgtccacggtgcgtgggactcaggcctggagtgggcacagtggcctctctcccgtctttcatggtgcccgtcatgcttctctctaccctccctccaaggaaacctagcctcccaccatccctgcagaccggtatgcagccaccaatgcctcggtgcacgtacgctactacttcttcagcatcaccaacatcgtcgacgtccgcgccggcgcaaagcccgtcctggtgaggccagggccggatcattgttagctttggcatgattggtgttcgcgcggacccatggattggtggtgccaggaccccttgacccgctcctcaagggagtcttacgcaagacctaccgcctccccacctcctccttgtcttacgctctgtgtgggagagtttgtgtgagcatgtggcccgccgcctgttattctcgatgctaggtcccccgctcaaccaccccccgcctgtcttcaccccccctcccctgcaggaggagatcggccccttcacctacaccaagcacgccatcaagcagggcatcaccttcctgaacggcacagtgtccttccacgactacacctactacctgccctgccccgagctgacgccgctgtccctcgacacccccatcaccacgctcaacctgccccttgtgggcgcgctggagaagatcggcggctacgcgccggcctccgccgcgcgttggctcagctggctggcgcgcgcggtggaggcctggtccggcgccgacgtggagggcctgtttaccacgcgcagcgcgcgcgagctgctctggggctacgacgaccccctgctcaagcgcctgcactggtttgcccccgggctggacccccacttcaccatcgtgcataacatcagcggcgcggcggccgcggcgacccgccccgccaacgtcatggccacgggcgcacgcgacccgcgggaggtctggcaggcgcgggagtggcgggggctgacccgggtcaccgcctgggcgccgccgcacgtggagcgcgtgcgcggcggggacgggctccagtttcagccgggcgtgacactgggccagagccacgtggtgtgggttggcgaggccttccgggccgccaccctgctggcccaggaggaggtgggctggggaggggtggaggatcatgggagacggggtggcaggtgtttcgggatgtggtttcggagcatagtgtggttgatgcgaggaggcgaggctgtgcacgttgcttggtaccgaggtagcatgccttcgtcgnnnnnnnnnnctcgggaggtagtttcggagcatggtgtggctgacgcgaggaggcgaggctgtgcacgtcgcttggtaccgaggtagcatgccttcgtcgacctgctccagccatgcctgcacagacaatcgtcccatgaaaactgagagcttccactctttgcagcacgcgcgctcacccccccccccccccccccccccccnnnnnnnnnnctgcctgcacagacaatcgttccatgaagactgagggcttccactctttccagcatgcgcggtcaccaccccccatgcactccacacgcaccgcagacgagtctgcacggggtccccctgatccggctgcgcacagacccccaccagggcgacatcaacccgacctacttccagtacatccagggcctgatgaacatcaccgggcccatggcatcaggcaggcagcgggttgctggaggggtgggcaagcgtgtcttctggggtcatttgactgcgtggggaggaatgatgcactctcagggatgctccnnnnnnnnnnnnnnnnnnnnnnnnnnnnnnnnnnnnncggggccgcccctcttcctctccatgccacactactgcggtgccgacccggcgctggcggcgggggtggtgggcctcaagtgcgaccctgcgcgccacaagctgcacctcgacgtcggtgggttgcatggcctggtggtcaggagctgccgttggtattgattaaatgtgcaatctgcctctggtttctcagcacnnnnnnnnnnggcatctgccccagccgtggtttccaaccctcctcttcccccataatccccacagggccgctgggacaggcaggaaagannnnnnnnnnagtcaggagctgccattggcattagttagatgtgcaatctgcctctggtttctcagcacagattgcccacagcccttgttcaccccttcctctccgtagaaccacacaccgggatcacggtgcggggcgcccgcaggatccagctcagctcctggtttgggcccaggtggaagccgatcgatggcggtgtgacacccacctacctgcccatattctgggcggacgaggcatcagaggtcagtggggctgggtcgatcgaggcgtctagactgtagctttcaaaccaagtgcctgggactgcattatgtcggggtgcagctgcgccagggtccggaggtacnnnnnnnnnnatgggtcgatcgaggcatctagattgtagctttcaaaccaagtgcctggggctgcattatgccagggtgcagctgcgccagggtccggaggtacctgaattttctggctgaccagtcgacctttcgtgtggttgggatgggtcctctgccttcatgtagttcccttcatgcgtgatgttgcacgtgcagctcagtgtacgaggtagagcacggacaagtaaacagccccagctaccacccaacgcatgcacaggcaagcgaggagcagatgcaactcttcaagcccctgcnnnnnnnnnnggttcccttcatgcgtgatgttgcacatgcaactcggtgtacgaggtagagcatggacaaggaaacagccccagctaccacccaacgaatgcacaggcaagcaaggagcagatgcaactcttcaagcccctgctgagagctgatcaggccaaggccctgctcatccactggcactggcacctggtggcggcgctgacgacggcaggcgcggcactgctggtcttggccgccacccttacgccgccagaagaggcaggggtgaccagggccggcgccctgccgtctcgcgtgacgacgggggaggtggacatggaagccgttcctctgctggaccaagggccagannnnnnnnnntgcccggccaaatttggagccgagagagaatcgattcgacgggcgccccactggggcgggaagtggtnnnnnnnnnnttgggtggccggatgtacattatggaggggtgcctgatggttctgggagctcaaaacnnnnnnnnnnctgggtggctggatgtacattatgaagggtgcctgatggttctgggagctcaaaactccttgtttcattctcagttgtatgtacgaatcaatcacgatccgttgcccaagcccgcccaaatttggagccaagaaagaatcgattggacgggcgccccactggggcgggaagtggtgcatatcgcgcccctgcatcctgcctgccagggcacagctcctgtgtgcttcgcttcccagtacagtaacacgacgaaaatgggtgctgcgtggatgctgtagagcctgtgctggtggcggagcctgctgtcgacagcgatgggggggagcgaccgtgccacctccttgcgggccagggtgcaggccgatccatacgaccaggatgcatgggacgatctcttagatgaactcaagacacagaaggatgtcacagcagtgcgcgaagcatacgaggccttgcttgcagagttcccgacagcggtgagggtggcacgatggacccatcagggcagcagggatcttgatatgttcgcggatctcacagcgatgtcactgagccaggcacagacgattcgcgggcgccccacactcggcgcaggccctgtactggaaggactttgccgagttcgaggttggccacggcggaaacaacgccgccaaagtggtgtacagccgctgcctgctgcagtgccccaacaccgatctgtggcggtcgtacctccagctcgtccgtcgggtgcgtgggtgggtgtgtagggacgtcggctggtggcctgacgggttgttggtcatcgctcacagctcgcaaaagagttgggggcgtgggaatggatggagcgcctgcccccctctgcaacaacgccattccccttttccaactccacccaggtgaacgagaagcgcggcgctgccgggctgggcgaggtgcgccaggccttcgagtacaccctggatcgcctgggccaggacgtggggtctggcgccatctggcaggactacgtggccttcctgcaggtgggggtgctgttggtcttgtttggttcttgggagagatgactggagtggtcagtggggcttgggatcacgcggtcctgttgagtgcctggttgcccagttccccagtctgcacaatgccttcatggaggggctgatgctcccacgcactggtcgcctcgcgggtgtgggaaggggtcatggttcaagcccccctccaccacgaagacccaacccaagtctcggcgcacctctgacaccccaggccccacgccttggctcgcccgagctggcggcgctgttcggcggcgccgacgcctcgcaagaggacagcgcgcggatggtggccctgcgccgtgccttccagaaggccatcctggtgcccggccccgcctcggacgcgctgtgggccgcctacgaggcctttgagcttgcgggcgccaacaaggcgctggggcggcgtgcggtggacgagtggcgcccgcgctggcaggccgcgcgcgcgctttccacgcagcgcgcgacgctggcggggcggctggcgcaccacgcgctccccgcgcc

SEQ ID NO: 32868 - DNA, 77 bp, Chlorella protothecoides
cacgctcagcgtgaggaagctgcgaaggggtgtgtgtgtgtgggagggggtgcgtcaccattgcaacaggcgtcgct

SEQ ID NO: 32869 - DNA, 61 bp, Chlorella protothecoides
ggtctcttcatctgggtcgtggtatcaacccgctgccatgcaaggctgcagcagcacaagc

SEQ ID NO: 32870 - DNA, 71 bp, Chlorella protothecoides
ggagagcaatgcaggacactgcccctccccccactggtgcactgacagctccatgctgctcattattgtta

SEQ ID NO: 32871 - DNA, 66 bp, Chlorella protothecoides
aatttggacatggggttgttcaacagctgaccctggcgcagagccctttcgaccgtccactcaccc

SEQ ID NO: 32872 - DNA, 61 bp, Chlorella protothecoides
tgaggcagaggatgatgacgacgtggccggtcctgctccaacctctggttgccttgccatg

SEQ ID NO: 32873 - DNA, 61 bp, Chlorella protothecoides
tcatcaaaggtctccgagttccgcggcaggtgcatgcacgcctgtatgtaagatccagtgc

SEQ ID NO: 32874 - DNA, 61 bp, Chlorella protothecoides
aagccaggcccctggtagcgacacctccctccccctgcaatctgctcggcactggcctgcc

SEQ ID NO: 32875 - DNA, 65 bp, Chlorella protothecoides
atgggatggggacaaactaagctggatggcagggtaagccgtcctggtagcaatcagacagccgc

SEQ ID NO: 32876 - DNA, 6416 bp, Chlorella protothecoides
  modified_base (151)..(201): a, c, t, g, unknown or other
  modified_base (1048)..(1158): a, c, t, g, unknown or other
  modified_base (1440)..(1449): a, c, t, g, unknown or other
  modified_base (1530)..(1539): a, c, t, g, unknown or other
  modified_base (1620)..(1814): a, c, t, g, unknown or other
  modified_base (1868)..(1877): a, c, t, g, unknown or other
  modified_base (2378)..(2387): a, c, t, g, unknown or other
  modified_base (2444)..(2453): a, c, t, g, unknown or other
  modified_base (2581)..(2590): a, c, t, g, unknown or other
  modified_base (2957)..(2966): a, c, t, g, unknown or other
  modified_base (3365)..(3374): a, c, t, g, unknown or other
  modified_base (3899)..(3908): a, c, t, g, unknown or other
  modified_base (4132)..(4333): a, c, t, g, unknown or other
  modified_base (4456)..(4465): a, c, t, g, unknown or other
  modified_base (5210)..(5219): a, c, t, g, unknown or other
ggggggggtgtcagggaatatgtgagtgacactgatggggaggtgccgcagaagcaggcgtctcccgctgcatggacatccacctgctcaaaattacacagtgtgctccacttgctcccatccatcacccccccccccccaattcccaacnnnnnnnnnnnnnnnnnnnnnnnnnnnnnnnnnnnnnnnnnnnnnnnnnnngatcatcacgatgaaggggattgctgcgggcatgcagaacaccggctgattgttgctgtgcattacaagaatgatcccactgtgtggcacgccccattgccgtgctgtcgcggtgcttccacccccaaacttttgtgggtgtgggcttgccggcggggagcaatggtcgcggaagctgctgtggcgaccacattccaggtgcaatcctgcaaaatccctcttgttcatggcgctgcagccttttgaactgcatccctgatgctggcaccaagctccgattgagcggcccactcgcatagcatccctctcttgtgcgtagtcaatgaaattgaaaccataacgatgcagcgcacatgcctcgacttcagcctgggatggggaggaggagatggaagaggtaggtgctctgagccttctctgacacctgggctgacccagcagggtgatacgggtggcgtcgacatgagcgatgcgaccatacaacgtatgtgggaggtgcagtggatgactggaagcaatgctaccgtgcaacttgcggtctgctcatcacgattttcgtctgcaaatccggaccgcgtccggatcttcggcgggttttagatggatcccctcgtggaggggaagacgagtagacgcatgcgaaacagcaacaccatctggaatcgctggcgggtcgttctgggactgaaaggggagaagcagcatcaggcatttccaagtgcattaaataccgcatccgagggtcgtcgtcacggcaaacgagctcgggcagcatcgtcccatcatccggtttaccaaaccatggccgtggaacccaccagcaatgtctacacggcagcgtgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattccctcccttgttgcatcattgcaggaagaacaaccccgaagtgctggggaggaggcgacgacgggttgaggccctcgaatcaaggatgacccagatggtgaccgagaactgtcgccggagacccagctggcccgaagagaagatccgccaggtaccaagcctgtgtgcttgatatggtgaccgtgcatgtaagtgggagcagattggcatgatgtgcaggtccagtccaacatctgaccaccagcctctcatgctccatgtagatggaccagcactgnnnnnnnnnnatgccaaccgatacagggctacttcagcgttaggtttcgtggatggagcgagttgtgatcccaatggaagcctgtatgtgnnnnnnnnnnctgccaaccgatacagggccacttcggcgttaggtttcgtggatggagcaagttgtgatcccaatggaagcctgtatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcctcaatgggctgcgctgcatcatgtgggacgatgaagccgccggattctnnnnnnnnnnccgccttaatgggctgcgctgcgtcatgtgggacgatgaagccgccggattctacctggtgggtgactgaaatcctgcctgtgttccatcaggagctgagccatgcgccgctggtgcccgcttgcaatatatcctgcgtggaccaggaatgagcaggcagcttaccacccagcccgccacacccaccggtcacagctgctcaagtgggactgggtatgcaacaggccagcccaacctacagaaggctcagatgccaatggccctggctggtaggtttagtaaaggttgggagaagggtggcccatggagcgagacctggagtgggtttgccacaaacttcgatgcacatacacatcctccctatacctccaccatctccaaaggtggtgcaacgtaaagcgcatcgtgggactccccctcctggatcccagcctgccagacgagggcctggccgcctggatagatgagcacaccatggccatccactcctgacccattcannnnnnnnnngaacttcgatgcacgtacacatcctcccctatacctccaccatctccaaaggtggtnnnnnnnnnntttttatatgcccactcatgctcctcaaatgtgctcgctgttgggtcttaacttccacaagtaggagtgtcatgggtttgcagttgggtctcaggtgtaggcggcacctgtccagtatccagactcannnnnnnnnnccttatatgcccactcatgctcctcgaatgtgctcgctgttgggtcgtaacttccacaagtaggggtgtcatgggtttgcagtcgggtctcagggctaggcggcacctgtccagtatccagactcagatcgcgagggacggccatgccaggccatgttgggagggaatgcaatgcagtgccagggttgcccagaccttggcacctgaacacaggggcgttgcagtcgtccagagagggggtcaggggtgggtaaacttgaggcccatcgtcagcgccatcacccaaagtcgagcgccgtgccgccaggaccggtggggcctccttcctcgaaccgcgagaggaagaagcggaggtccaggtggctcnnnnnnnnnngggaccgctgggccccccttcctcgaaccgtgagaggaagaagcggaggtccaggtggctctgcgctggcaggagggagaggaaggtgcggaagtggcgctcgtatgcggcgtgggcctgccacatggcaccgtgcagctccgtcagcgcctccgcctcgatttccggggagttgtacacctcgtccgtccatgtcccgctggtctcgctttccttgacgcgggccaggtagccgcgctgcgcagccacggcctgctctaccaaaccggccaggccgtggatgggctcctggcgcatggggagggggagtccaaggcttgctccaacttgtaggtctcgtctcagcaggcaggcacaggcattgtgctggccgccagacaggctctcaccgagacaacnnnnnnnnnngggtctcgtctcggcaggcaggcacaggcatcgtgccggccgccagacaggctctcaccgagacaaccacacagtcagtgcgacatctgcaggcctgactggacagcgcagcgcactcctcaccagcagggcggccatagagatgagcgccgctcggaggccagtgtgcgggtccggggccgcagatgccccctgctgccctcccagggagctgccgcccaggcctgggcccgtgcctcccaggaacaggccctggagtgggtgtgaatcgggagtgtgtgggtgaacattgcaacgcgagaattggccagctggagtgagctgtggacgtgagtcccactcgcgaaacacccgcaagacagagcgggaggagtggaagaccatctgagaagctctgcgacgccggccacacgcatccagccccacagggccccccgcatccctcacaagacccgctccagactcccctcacctccaccagcttggcgagcatgccctcgtgcagtcccaccacctcgtccaggnnnnnnnnnncattggccagcaagagtgggctgtggacgtgagtcccaacagcgaaacacccgcaagacagagcgggaggagtggaagaccacctgagaagctctgctatgccggccacacgcacacagccccacagggccccccgcatccctcacaacacccgctccaggctcccctcacctccaccagcttggccagcatcccctcgtgcagtcccaccacctcgtccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgctggcagggcgggtgtgaaaaacggcggctggatccatccagggatttgtccctgccaggaggaccactcgatacccagcccgtcgcgtgccccaccgcctttcacaacccaagccctnnnnnnnnnntcccgcgccttccccaggcaggccccgaactcggcccaggcgggctcgatcacctccagcgcgatgtaggactgcaggctggacgcaaactgcgccgcctcgctcctccaggagtggaaggctcgcagcattgtgggcaccttttgagaattgaaggggaggggcatgccgagggggttctcaaacgggaatattcgctggcagggcgggtgtggggaacggcggctggatccatctagggatttgtccctgcgaggaggatccctcgatacccagcccgccgcttgccccaccgcctttcacaacccaagccctaccttctcggcgccggagacgtcgacgccgtgctccttctccagagctcgcagcgtggccatggcgtgtgcggcgtcgttgaggcgcgcccaggcacggccgagcaccctttccacccgcttgatcgtccagagcaggcggaagacccggaggtaggctgtgacatggaggagggggagggtatggagtggggtgcaggcacactttgcgaggtttgcagctgccattgcgaagattcatccggaaagtgaagcacttggctcctggaggcacaccaggagaggggagtggatagtttgggcgagggcaggctgccagcccacgaccctcgtctccccccccaggctgcccaaccccagccacgccacaccctcccttacaacccgcccccatcacaagatcccctcccccagcctcacatgccatggcnnnnnnnnnngcgaccctcgcctcctcccccaggctgcccaacccccagccacacgccacacccttccctacaacccgcccccatcacaaaatcccctcccccagcctcacatgccatggcgctgggggcgagcactgccgccagcgcgccgtcgacggcatactgcagggaaaacacgtcccagcccgagtcgccctccagcgcccgcgccaggcgcacggtcagccggtccgccacgtcggtgtcctggctggaggcggtgctggcgcgcagcgcggcatccaggtgtccctggcggcgggtcgtgggtaatgaatggatgactgatcgggcctcatgtcgggctggcaagcagggatgcatcgagcggtggcgttcagccccgatgaagatgatggcgctcggctcgtcgcagcccccctttcccatcctcggccccaaacccccagatgcgagcccttctggcgctccccctctccacccaaacgtcccacccattatgcgcattacctgcagtacgtattgcgacacctggcgtgccggcttgtccagctcgggctccgccaggtccagcagcgcgctcacaaagtcgccccgtcccatcagcatgtggtgcttcagcgccagcaggtggcgctccaggccgtgcgcgcggtgcaggtgctgaagcagatgggcgctggcggcctgctgcacgcccgtcaccgcgttctccagccacctgcgagggcacttggatgaggagatttttgtggggggggggtcccgaggacaggcagtggccggccggcaatagcaggttggcaagtgaaccacaactcagagccgagcccagggaccccaccaatgtgcagtcgctgaacatgccggcacggtcatacaaacacaagcaataccctacccccccctgcacgagaaagtcctccgcccacaccctcgacccacttgagctggaggcaggagccccagggcgggcagagggcgcccgcgtgcgcagccacgccctcctcccagcccacgtccccgcagacatgcttgaggaagttgacggtgcgccccgcgtccaggatggagcgggccagggcacccggcaccaggcgcggctgggcgtcggggtcgaggcagaagccggtgcgccagcgcaccgcggggtgcgacgcgcctgaggccgcggccgcggcgggggcgggggcgccgccgcgctcc

SEQ ID NO: 32877 - DNA, 80 bp, Chlorella protothecoides
tgggtatggcagagtgtgggctgtttttttgtcagagtatgtgctggttatggtggggtgtggctggggcattcagggcg

SEQ ID NO: 32878 - DNA, 468 bp, Chlorella protothecoides
  modified_base (264)..(366): a, c, t, g, unknown or other
taatgtgaattgggacaccctactcatctgaggttaatgtcacattatcatgtgttgtggcccaacgtgcttatggttgtacccttacacgccctctcctacaacgcatgcgtaggtgggacctggtgcgatacccgcggggcatcatctgcacgccgtttgtcattgactggcagaattccgatgactgagtgttcagagagcttgagctgcagttgtcgtttgagtgtgtaaacttcatattgtattatatcgttgacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccagtcggaataacaccgtgaaaacgatgtcggctcctcattgtatcgcattgaatagagcgcacaagaggacattacctcaggagtgaatgcatactc

SEQ ID NO: 32879 - DNA, 67 bp, Chlorella protothecoides
gctggctgtgtggggctggggtgggtttggtgccgcgccgcggcacctcgccagtgcctgcgcgacc

SEQ ID NO: 32880 - DNA, 69 bp, Chlorella protothecoides
cgccgtcttccggctgctgggccgaggacccggtgcccgcgtccaggcccgcgcggagccctgctggag

SEQ ID NO: 32881 - DNA, 68 bp, Chlorella protothecoides
cgctgggatcccaagcatggcagcaaaaatgacattgcgcgcagggaaaatcgggcgagatcgacctc

SEQ ID NO: 32882 - DNA, 124 bp, Chlorella protothecoides
cttcttgtttgcctggtgggcggtgtatggtggggcgaggggtgatggatgggcctcgctgtgagggtgcaccgcagggctcctcagcgggaaagacactgttgggcacagcccgggcacgtgg

SEQ ID NO: 32883 - DNA, 75 bp, Chlorella protothecoides
gggctcgaggctgttgctgcggccccaccaacccccgccaggcatggcgcggcccttggccgggctggtggcagg

SEQ ID NO: 32884 - DNA, 82 bp, Chlorella protothecoides
gcatcacatgacgctgacacattctttgttgtacatattcaactatcgatttcccctgcagggacgtcagggtgtcacagcg

SEQ ID NO: 32885 - DNA, 97 bp, Chlorella protothecoides
gggggtctctggcaccctagttcagctgaagggctgggcatgtgacatgaacgcgtctcccaacaagtcacgcaggtacgggtggcaagcccgagct

SEQ ID NO: 32886 - DNA, 79 bp, Chlorella protothecoides
ccaccctggacggcgacatccgcatcaggcgagctaacacttttatatctgtggtcggatgtggcaaccaggccaggga

SEQ ID NO: 32887 - DNA, 7976 bp, Chlorella protothecoides
  modified_base (94)..(103): a, c, t, g, unknown or other
  modified_base (447)..(531): a, c, t, g, unknown or other
  modified_base (1362)..(1371): a, c, t, g, unknown or other
  modified_base (2104)..(2113): a, c, t, g, unknown or other
  modified_base (2254)..(2336): a, c, t, g, unknown or other
  modified_base (2491)..(2500): a, c, t, g, unknown or other
  modified_base (2850)..(2859): a, c, t, g, unknown or other
  modified_base (3435)..(3444): a, c, t, g, unknown or other
  modified_base (3600)..(3609): a, c, t, g, unknown or other
  modified_base (4620)..(4629): a, c, t, g, unknown or other
ggggaggcacatgcacagcctatggaccgtcctggtgtcccagtagctcagattgcgcatctacagtgccttcagggaaggaggagggctcgtnnnnnnnnnntgtcgtcctgggaggtgggaagcgatggatgcacgcgcactattactgcacctttttcacgttacgatggcatagaacgctctcctgcagtgatttggggggcaacggaggctcaagccttgcgcctgacccaagatgagggcgcacactcatcccttgtccaatacaacggtctgcttcagtcagtctgtccctcatacatgatggcggcctcctcggcactacccgtgcaggaacatcaacccgctacgactacatccactatggcttcaagggggctatgaactatacaagccccaagttgcactcggtggtcgccgaggacctccgccccaacaccaccnnnnnnnnnnnnnnnnnnnnnnnnnnnnnnnnnnnnnnnnnnnnnnnnnnnnnnnnnnnnnnnnnnnnnnnnnnnnnnnnnnnnnttgttctctgcaagcgcgccccttttcaagatgtgcaaagagagccaaatttttgattggcacaccctatccaggcgatggaatggagagcacctcccaacacaccccttgctccacgcctggcttgcaggagttcagcttcaccacccttcctgccggcccaagctaccccctgcgcatgggcctcattggggatgtgggccagacctacaactcttccgacaccttccaccacctcgcagccagcaagccccaggtgctgcacgtttgatttggcggggtcaccaggatcacgctcctgggtttgggttgacttccctgcgcacacgagtcctcatagtcctcataaacccatcaaggctccaaatttcatgcgctgtattgatcaaacatgcgattgcaataccagtggtgacgagggatcacctagcttctgcattgctgccagcctcgcactgtttgagattcgcccacatgcattggacatgggctgacgctactcaccccccctcgtaggtggccctgatcgtgggcgatctgtcctatgccgacaagtacgagtctaatgggacgctgtacccctcggtcttcaatatctcataccctggagaaaacgtctgggttcccttttatgttgatcatgggaccttccagccacgctggtgagttggttgggtgcagattttgtgaagaatcatcctggtatctagtgggtggtgcaaaggcgtggagcgagggacctccctctccaggagcccctcagccttcctttactgataccctgtggacaatatgcgccgcccaatctctgaagggacacatggggacgcnnnnnnnnnncaccctgttgacaatttgcgtcccccaatctctgaagggacacatggggacgcctggccgagcctgtgacctcgtccgtcccattcttgttcaccgttggaaaccacgaaatggagccccagagtgatggtcgcaagtttgtgtcgtacagggtgggtgcaggagggggcggtggatgtaactgggtttgacgcagcgtctgtgtgtgggtggtgggcttgagtacgaggcagactcaaggagtggcaggttgctttcacagccacaggctgagcatcaatttcaggcaacaagcggagcatctaccctgacccaatggttcgtgtcagccctcttattggagccatgccccacggctgatgtctacctcgaggtttttgcctttgggggctccggttcatcccttccacatcccacgagcaggcccgtctcccgcccaaccatgaggccagcggcagcgacgacaaactctggtattctgtgaatgtcggccctgcccacattgccttcatcacttcctatgctgactacgacgaggattctgctcaggtgggtccagaatctctttgccagcttcaggactggcctcagatactgagcttctcgtgtgcagtttcatcatctctctccgcatccatgacgaggctgagcttcctcaaactctgggagggcaaaatgccacaccctatcattcttctccttggttgcagtaccaatggctggctgctgatcnnnnnnnnnngactgagtttctcatgcacgttttcatcatctctctccgcatccatgacgaggctgagctttctcaaactctgggtgggcaaaatgccacaccctatcattctcctcctcggttgcagtaccaatggctggctgctgatcnnnnnnnnnnnnnnnnnnnnnnnnnnnnnnnnnnnnnnnnnnnnnnnnnnnnnnnnnnnnnnnnnnnnnnnnnnnnnnnnnnncaccggcacccagagcagggaggatcagtgcaggatcttcagcctcaaagtttggcgtttgccagctgccatgtgctcttgaccgcattttccattcatcacgcaggtacgcgtcctacgcaggccactggcaggaggccaactgccagaggctnnnnnnnnnnactttccatgccccctggtatgaccgtgtcttgcatgtgggcaggagtgccagtagtcgagtgccaggccatggcatgcaaccggcacccagagcagggaggactagtgcaggatcttcagcctcagagtttgccgtttgccagctgccatgtgctcttgaccgcggtttccattcatgacgcaggtacacgtcctactcagcccactggcaggaggccaactgccagaggctggcgatggagccgctgctctacgagaacggcgtcgacctcgtgttcaatggtgagggatggacctccctcctgcccaggcagattggggtagcgtcgtggtctgtgtgctaggtgtnnnnnnnnnntggcgtcgacctcgtgttcaacggtgagggatggatctccctcctgcccaggcagattgggtagcgtcgtggtctgtgtgctaggtgtcaaaggtgtgcacccaagctggaacctggctgagaccaacctggtgatggattgctcgccccactccccactcaggtcacgtgcatgcctacgagcgcaccttccccgtctacaacaacaccgtgagtggcaggatgcttggggggctgtgcgtcagatttgagttcccaactcgcaccaagggcgaccggaccacagggacctcccagctcacaccccacctccttcctgtcctctcgcaacacagctggacgagtgtggccccgtgcatctcaccctgggggacggcggcaacatcgaagagtgagtgtgtttggatttgctgaccgtcgccattcccagctcggtctgtgcaccgcttgcggcgaatctgtgctggggatggggctgtgatcagagccacaggttgggaggagcccgcagcatcgtggcaatggaatctcccaatttgcaagctcaaaccccctcctccccctccttcccgctgnnnnnnnnnntgattctcccgatctgcaagcccaaaccccctcctccccctccttcccgctgcgctcagcctcgcagcgatctttgtcgactacccgggcaaatgccctcccgtgccccagcacggacccacctaccagccagaggtttgcaaccagctgctctannnnnnnnnnaacctttgtcgactacccgggctactgcccctccgtgccccagcgcggacccacctaccagcctgacgtctgcaaccagctgctctacgacggcgagtattgccccacctcccagcctgagtggtccgccttcagggagccgtcctttgggcactccatgcttgagttcctggatgacacgcatgcccgctttgcctggtaccgcaaccaggacgccgatacatgtgagctgacttgggtgggggtttggaggggtgagagggctgggttgtggtctcggggttccctggtatggacggctgcccttgcctaccttgccacgacccgcgaagtcccacctctgtgcatggctgctgaactttgctcgtcccagatgtcctgctggggtgaaggggattcggccaaagctttcccgctgccatgtatggcaatcaggattcaccttccgcaattgagccacccctcactcggtcccctgctgcagccgttgctgatgaggtcatcctggtccgcaacccagagaactgcggaatcccggtcgagggcctcaacaacaaggccgactgacatgctggatccagggaggaggcggcacacgcctgcctgcactgaaaaccaacatcagtagaataaaggggtgacctgcaaatgaccggagtgccacaggcccttcccccactgacaaggtattgcttgccagtccccggctcacctgacccgtagtcagggatgctggaaaaccatccatccttggccaaaacttccttccagctgcgggtggttcgtcaccgacacctcagcacccagcactgctcctgacccccaccatccttaccccttttgagtgtcagacttttgcaagttgaggggtgcagcaggagggtgccaaggctcgcagcagggttgtggggacttcccctcaggaatcaagaaacgttggtggtgcgttgctacggtggcaacaaaccgtgcaccacgggaaggcagcgccgcatggggacgaagagggannnnnnnnnnccttcccctcaggaatcaagaacgtcggtggtgcgttgatacgatggcaacaaaccgcgcaccacgataaggcagcgccgcatggggacgaagagggatccccgggtgcccatcccggcagaggtacagatgctcgttgaagcacatgagcacccagcctggccacagaggggcccatccgaggactgagcccctggaatgatcgtcgcgctgcgcttcatacccaccgcgacgagttggcccacagccccttccacacaggcacatccccgccgcccctcaccgtggcggcatgccaaacacgtgttgccaggtcgacggcgtccgcaggtcccgtgctgccagccccagccccagcgcctcagccgccgcccccgccagctccacggcatcggcggcgttgttgccctcggcagcaaagcgcagcagggcggcgacggggaggcccaggtcggcgcaggcggccgcgagtggccagggcggcaggctccactcccgcagcgcctgctcctcccaccacgactcctccagcgggggcaccgcgcccgcgtgcagcgccccagacagcacgccctcgcccgcctgccagtaccgcagctgctgcgcgccgtccagctgctcgccgcggcggagcgtggcatccaggccccccagcagcagtacctgaggcggggaagggaaagagtgggtgcagcgccgcagcggatgggcagagagccactcgcctgagctctcatgcctggttcagtgcattgaagggaagcaccagaagggagtgcaggcctgcagcggatgcagggagcacggctgcaaggcacatgtcagctgcccccaaatcccaacctgtgcgccattgtcccacacctgtgccaacccctgctcctgagcccaggacgcgatgctctgtgcaaagttcgactgacacccggcagccaccggcgccctttgctggaggaggaccaggtcgcctgacctgtacacctccatggccagggcgggaccagcgtccttcacgtgatcgaaggacttggatccggcacagggcagcaaggcagtatgatgtagattgccgattttgtctgcctgctgggtctcgatcagcacgtctagggcgagttggcccaggctggcgacggtcacggccgggatcaccagcgtcgaacccacgatggagacatcgtgggagtgactccaaaactccatcgccgctgcgattcacatggatgtttataaagaatctggtaggggaattgcattgcagggaatgatggggatacacttgcatgcaacccctcgcaccccctgctgggcgcaaagtttgactccccactttctcaaatcgaaccatacgaaaatccccattttgaactgctggggcaaataatctgcaagtcgcgccaaaacttcccctcgcgaagtccagctttggacctcggatgctgcagggccgggaagtggtttgtgtgtccagcaacgccggacgtgacctattctatcagagcgccggcctctttcaacgtccatgaccgagcccaagccgaagtcgggctttcggaagctgaagaaaacggtgcgcggcggtggcgaaaacttgcaatctctacatggaaggactgttaatgttttcccaccgtctcacctggcttcgctgccctcttcgcagatgtcccgggccttcagcctgtcgcgcacgagcagcacgagcgggaccggctcggtcggagcgagtgcgcgggacggccctctgacaggacgcgccgagtccatgcacagcgcggtggaaacggccagtctgttgggggacacggattgcggtgagagccacgagcctgtcgacccgccatctaccctcacgctcatgcggacggatactcaggattcgggggtggtggggtccgctgccggacctctgcaacctcaacagctcaaggagctggacaggctgcgccaagagaacgcgcgtctccaggtatatggatgtgtcatggctgtctctctcaggcattctgtaactccatcagtgtccgttcactcttgtccacctgatgcacgcctcatcgtctcttgagcccaccaccgccgcttcccccacttgcctgacacccacaccctgcgccgccctttcctcggcgcgcaggacacgctgtcggcggccaaggccgccattgccgagctggaaggcagcacggaggcgctgcagtcccgcgccgcggtgggacaggagctgaactccgccaccaaccgcgtgctggtggacctgacggagcagaccgaggcactgcgcctggagcgcgcacggctggaggcggagctggccgcgcggcaggcggaggtcgaggccctggccgcctcctcggccgcagtgtcggcgggcgagctatcgctgcaagaggaggccaacgaggaggccttccgcagccaggagcagctggcggccctgcgcgcggagcttgactttgccgccgcgcgcgagggcgcgctgcgggccgacgtcgccatcgcgcgcgccgagctggagcgcgcggccaaaacgagggacgaggccctagccgccgcggggcgggggggcgcggaggcggagcagcggctgggtgaggcccagcgcagcctggtgaggtgacggcagggttgactgagtggggggttccttttggtcgggaggggtcgcgtcatggttctgtttttattggagggtgaggacagaaggggctcgatcctgatgctgtcttgcaaagacaccggagtcgaccgggcccaccaccaaattcatacaacacagcacgcactcactcatgcatggactccctgtcaccaggctgtggcggaggcagagtgcgagacgctgcgcgccgcgctgcaggcggcccgcgacgagcaggccgtgacgctggcggcgctgcaggccagggacgcggagctggaggccctactggcgagcgagggggaggccaaggctgaggctatgaaggcggccttcgacctggaggcggccgtgacgtgcgctgggggtgcgggaggggaaccaggatactcgatgggcagcagcaggatgcagcgatgccggtaccacaaactggcggcattgtgtgagtgcagtgctctggcaggaatccctgtcctgtgtgcaggcggccctgccaaactgcacacaggtatcttacaccctccctgcacctcccagctcacccctccccaccaccgccccccaaaccgcccctccaaactctcgcagcgagtcggccgccgagctggaccgcctgcgtgcggccctggccgagacggagtcccggctggccgaggcgggcgccgagctggcggaggagcggcggcacgcggcggcggcggcc

SEQ ID NO: 32888 - DNA, 7335 bp, Chlorella protothecoides
  modified_base (111)..(120): a, c, t, g, unknown or other
  modified_base (400)..(409): a, c, t, g, unknown or other
  modified_base (1051)..(1156): a, c, t, g, unknown or other
  modified_base (1748)..(1757): a, c, t, g, unknown or other
  modified_base (2713)..(2722): a, c, t, g, unknown or other
  modified_base (3430)..(3439): a, c, t, g, unknown or other
  modified_base (6740)..(6749): a, c, t, g, unknown or other
  modified_base (6924)..(6933): a, c, t, g, unknown or other
ccaacgcctgggaccccaggttggtcggagggggggggggaagggggtcttatttgtgtgtggtggtgggcgaaaggactgcgaatggcggctcccggtgtgagcgctggnnnnnnnnnntggggggtgaaggggggcttatttgtgtgtggtggtgggtgaaaggactgcaaatggcggctcccggtgtgagcgctgggcaaaggtggtggtgcatgacggttcgccctcggcacgcttctaggttgtgaactcctgggctcggctgcgatgcctcttctcggtgtcctgccgggcgatgcccgcttccttgcagcgcccgctgcccgtggcgtcaccctgttcacctcgcagtcggcaccccccctaacccccccaaccccccttcccctccagggannnnnnnnnngtctcggcgtcctgccgggcgatgcccgcttgcttgcagcgcccgctgcccgtggcgtcaacctgttcacctcgcagtcggcaccccccctgacccccccaaccccccttcccctccagggacccggccccgctggagggcttcctggcggagtgggagccgttgctgccccctcccctgctgcagcacgtgctgacgcacctggtgctgcccgcgctggagcgcgcgctggcggcctgggacccgctgcgcgacacggtggccccgcacacttggctgcacccctggctgccttccctgggcccggcgctggaggggcagtggcccggcgtgcggcaccgcctggcctccgcgctggccggctggcacccgtcggacggctcggcgctggcgctgctggcgccttgggcgcgcgcctggggcgccggcgagtgggaggccttcctggcgcgcgcggtgctgccgcgcctggccgccgcgctgggcgccatgcccgtcgacccgggggcccaggacctggcgccctgggactgggccatggcctggcacggcgccgcgccgccggacgcgctggcgcgcgtgctggacgtcgccttctggccgcgctggcacgcggtgctggcgcactggctgggcggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctggcgctcactgctgccgcgcgagctgctggcgctgccgcgcgtgcgcgcgcacatggcctcggccctggacgccatgaacgccgcggccgacggccggcgcccggggccgacggctggggccggggccgcggcggcgggggcgggatccgccccacccggttcacggagtagcgccgcccccgcgccgccgccgcctgcccgaccaccaccacgcggaaggcagccctccgagctgagcctgcgcgagctgctggctgcacacgcggaggaggtgggcgtcgccttcctgccgcggcccgggcgccggcacctgggcctgcaggtgtacctttacggcgccatcagctgcgcggtggacgcggtgggcggcctcatccatgcgcacatgggcgagcggggctgggtccccatctccatgcagggcctggacgaggagaacgagcggcgcctggccgcgcgcgccgcgaagaagtgagcgcaaggggctgcgcccttcctcgggcacatgcgcctacgattctgcacatttggtgcgacccccagtccgagttcttccttgtcgccgccgctctggcattgccatgccnnnnnnnnnntcgattctgcacatttggtccgacccccagtcccagttcttttttgtcgccgccgctctggcattgccatgccattccctcgctcgcgcaagctcgaaaacacgaggggcagatcgcaaaagggtaaagggccagatgcagcgagcaaacagcgctggcaagggcgacgatgctggcatgcatgccaatgtcctgcggcgccttttcttagactctgccactcacgcgcacaacctaggctttccgatccctgacctcgacgccgttggcgcctgcaatgatgcagacatccaccatgtccaggaagaggccgtgctccacgacaccctccactgcggcgatggccttggcagctgcgcggaaggtgggcgggcggggggagtgggggacattggcaggacagcgctatcagaagtgccaatgctgggtacgaagttcaccatactccgcacgccaacacgtagatgcccatgttatgtttaaaatggacctggagaagccacagaccacgcccagcgagcaggccagttcccactgtcacacctgcatggggctccttgaggggctcctggaagtagaggtccacgatgaaattgtggttgtcggtaacgtacggcttgcccccatccatgcgcagcttggcctcggcgccggccacctctggcagcgcctggagccgcttcagagtgtactcgtggcagaactgcacgatctcgaccggcatcgcatctgcaggtgcagatgtgttggtttctcggggtgctctcatgtccagcgctcaagacgatcccacaaaaaggggagcagcagcgacaaggcctgttttgaagcaccaagcaccagcgagccacccacctcccaggctgcaggtctcttcaacgggacaaacaagatcctggacccacggccccacacacgatgaccgagacaaccctcacgcgcacctttgctgcccnnnnnnnnnnacagcgctcaagacgatcccacaaaaaagggagcagcagcggcaaggcctgttttgaagcaccaagcatcagcgagccacccacctcccaggctgcaggtctcttcaacaggacaaacaagatcgtggacccacgaccccacacacaatgaccaagacaaccctcacgcgcacctttgctgcccccgaggccctcaaccagcttggagtcgtctacgatgcacacaaacttggcagacgcctgctccaccatctgcagaggaggggccaggctacatcgagtcagggaccacggcggaggcagcatagatcgacacggtgctgggcatcatcacccgccccgcctcaccttctcgcggaggagcgcgccgccccggcccttgacaacatccaggttggggtccacctcatccgcgccgtcgattgccacatccagcttgggctgctccgacagggtcgccagagggatgccgcggcctgggcagcgggtggaacgagggtaagggcagagaattgatggggcagctgaagaggagactgccgagcgaccacctgcccgtatggcaagttatatctggcgctcctttgggaccccccacccacaaaagatcacatttgccccacctcgagcaaggccccccatcatgtccctactcagtataaaatcagaagttcatctttatttattgaacgcatagtctcgtctatnnnnnnnnnntacatttgccccacctcgagcaaggccccctatcatgtccctactcagtatataatcagaaggtcatttttatttattgaacgcatagtctcgtctatgcagtgccgccccacctttggcctgctcataggtccgcacagatgtggggacgcccacgatgtccttcagctctccagagctcagcaggtcgccaatgcggtccactgcgaatgctgcagtggatcctgtgcccaaacccacaacatcgccgctcttcacgtactccacggccttccaggcggcctgcacgagggggtggcagggttggctgctgggcgaggcaaaggccgagctgcggggacacacgccgcaaagaatcctgtacgtacctgtttcttgagctcgtccatgttcagagcccgagtgaccagggcccgcctggcttgggtggcacgccgcagcaccggccgcgtcgtgaagaatgacctgctcgctgcttgtgaactcaggctggcctgcatcaggactttaacaccggcacgcctgccttgcgcaacctttcaattgtctagtcagagcaagagggggagcagggccgggaatgggtggaaactgtgtccctctccctcctcgcgatcaggatgatggcccacccccgggcggcacacgtggacccgggtcccccctcttgcagcaaagagtctttggccggcatgggatgctgggtagggaccatgactcgacgcacatccatccactaggttctcacattaccagcacattgcagtgtgtggttgggatcggctgcttgaggcgcttgtgccgactctggtgcaaggagcagggactggcaggggctgcaaccaaactcaaagcgacgacgagggcattggagccgacgcgcactcttcactcgggttaaaagaccccgtatgatgtgttgctagcccttcgtgccatcgggacgcttgcgtgaggagaaaacgcagcggcctacaccgcgggcgaggacatgtcgcaggccaggctgagggaggccctcagcgcaggcggccccactaccaaggataggggacctccagtatcagacgggactctcaccgtgaccccagacacaccggaggcagtggagtggcgggctcggcgatcaatcatcgacagcatcgcctcctgctcgacctacctggacgatgatgacgatggtgagaggggacaggggtgcgatggggaatgtgtgcgtacctgcgtcattgcccccgcgcgtgctgctgggggggatgagtggtggagagaggacccagtgctgccctgcccaaccctcacgttcccaccgccacacagcatccaccaaccccggggatctgtacggtagattcacctggaaaatcgataaatttagcgacatcaacaagcgggagctccgaagtaacacctttgaagtcgggaactacaagtggtgagcaggttgctgtgggctcgatttggggaggaggaaatgacagccaactgtcgccagcccgaaattccacatggaccacccaatggtggcttagttgcccccaccaatgcctgcaaggcgcatgcccctgcgcggggaccgacgctggggccgtccttgcccatcggttcggcccacttcccgctctccctgcaggtatatcctggtgtacccacaaggctgtgacgtcgccaaccacctgtccctcttcctctgtgtggctgattacgacaagctgctgccaggtgaggaacgcaggtttgaagttagaggttgaatgtgggcggctgtcagggtgggtgagttatgtctgtggaggtggggtggggcccagcggtgctgcgggcatgctggcacaagggcccactccagggttgcatgggccatggcctgggaggcacttccacccccccttcccctctcccaccccctttacaccacaccaagatctcacacctccccacccccaaacatgaaatcccaacacataccagggtggagccactttgcacagtttacgattgcggtggtgaaccgtgaccccaaggccagcaagtactctgatacgctgcaccgcttctgcaagaaggagcacgactgggggtggaagaaattcatggagctgggcaaggtgggcgagggcttcaccgtccaggactcgctggtgatcaaggcccaggttcagatcctgcgcgaccgcccgcaccgccccttccgctgcctggacgcgcagtaccggcgcgagctggtccgtgtctacctgagcaacgtggagggcatcgcgcggcgctttgtggaggagcgtcgtgcctggctggcgcgcctgctggcgccgccggcgagcgccggcgcgggcgagggcttccgcggcttctgggcaggcctggccccgcccgcgcgcttcgagctgtcctgcgacgcagcggggccgctgctgaaggccgcggtcaagcgcttcttcaatgagaaggaggtgacctccacgctggtcatggatgggctggtggcggggtgcaaggcgctggaggccgcagggcgcgcgttcttggccggcgggcggtacgagacgccctccggagtgctcatcgacgccgtgcgcggcgttttcttcttcgccggcgacgtcgtggcggtactggaggcgctgctgggcgacgcgctgccccccgccccggcgcccgaccgtgccgcgggcgacgccgcggcgggcacgcgcgcggcgggtgagccggacgatgtcagccgcgactcggtggagcgtgacgagcgtcgcctggcggacctggggcgctggatcatggagacctttgccgctgcggagatcgcgcgcttgcgtctcgaggtgcggctgcagatttgtgtggagaggggccttctgtatcgtttttgttgaaggggaggcagtgttgctggggctagggtctgggctctctatcgcgtgtgcaccaaggggtgggtgggttgggcagaggagcaagacagcacaagaggctggctggagacgctgtcggggccgctgaacgcttgatggctggcggcaggcgggcctggggttctgcaatgtggcggccattccttccacacatgcagcaacctctgctccttgaaacaaacatcagtgtgctgccccacaacacccacgtccacaggccgcctggatcgaggcggagaccatcaagcgccaggacgcgctgatcagagaggaggagctgctgagccaggaggagcagctgaaggccgccctgcgctcagaggtgggtgcaggagggggtgcgggggaggttttctgtgttagaagtggcgctgggtgtgagcgccagggcnnnnnnnnnnggaggtgggtgcgggagggggtgcggggggggtttctgtgtcagaagtggcgctgggtgtgagcgccagggcttcgctgcgttgggatactgactggcgcatggcgtttttgtctggggacgtagattgcaggggttttggaggattgccaggcacggggttgtgcacggtgcannnnnnnnnnttggcatttttgtctgggggcgtagattgcaggggttttggagaattgccaggcacggggttgtgcacggtgcagtcttggcgctcctccgttaattatcagagcacctctgacatcgatgtctatctcccgtccactgccatccacctcatcatgacaatgacatgatccccaccctctacctcaggctgagcgcgagcgtcgcgtgcgcaagaaggagaagctgaagcggcggaaggaggaggagcgcacgcggcgcgaggcggaggaggcggcgcggcaggaggccgaggcggcgcgcaaggcggaggccgaggcgcgagcgcgcgaggcggaggagcgcaggcggcgcgaggaggaggcgcgcgaggaggagcgcgcgcgcgcggtggcggaggcacg

SEQ ID NO: 32889 - DNA, 80 bp, Chlorella protothecoides
gtgaggaggagacgggagtgcggaggggggattgagtcgatgtgtccactcgaccagccagtcctgcaacatggagagca

SEQ ID NO: 32890 - DNA, 142 bp, Chlorella protothecoides
tggcctccggatgagcaccatcttaagcgcatgagcaggcaaacagggcgggcagggtttgtgggtggccagcattgatggaaaattgacaacggtcggagccaagggatgcagagcagtctgttgcccaagctccagagcg

SEQ ID NO: 32891 - DNA, 61 bp, Chlorella protothecoides
aggtggcgaatttatcgagggcgaatatttctacaggaataagcgattcaagaagcagcaa

SEQ ID NO: 32892 - DNA, 64 bp, Chlorella protothecoides
tgcgggcgtgggggtgggaggggacaggtctgcaggggggggtgccttgtcagaggtatggctg

SEQ ID NO: 32893 - DNA, 98 bp, Chlorella protothecoides
cgaatcactgtgccaaaaaggatctgtaggtaatcaacacccccatgtgtgcctgccttgttcacaaccacgacaatgggcacccaccgtttttctag

SEQ ID NO: 32894 - DNA, 77 bp, Chlorella protothecoides
tgcaatccagctgaccaacctcacatgcaacgtcgccattctgacccccccccacgccgcctcaccaatggtgggcg

SEQ ID NO: 32895 - DNA, 87 bp, Chlorella protothecoides
gtcccgaaagtcccagctcaggggctgagcacgtgcaaggcgcggtgggccatgcccttgtccctcctggtgttgtgcagatccaca

SEQ ID NO: 32896 - DNA, 61 bp, Chlorella protothecoides
aggcgacgttcatgatcgggcctgggagggggacaggagtctgtacagcaccctgcgagtc

SEQ ID NO: 32897 - DNA, 73 bp, Chlorella protothecoides
ctccaggcccagagtgatcgccaccccaggacccccccagacacacccctatcaacgacttcaggcgtgggct

SEQ ID NO: 32898 - DNA, 36443 bp, Chlorella protothecoides
  modified_base (183)..(192): a, c, t, g, unknown or other
  modified_base (268)..(297): a, c, t, g, unknown or other
  modified_base (630)..(639): a, c, t, g, unknown or other
  modified_base (1650)..(1659): a, c, t, g, unknown or other
  modified_base (2198)..(2207): a, c, t, g, unknown or other
  modified_base (2911)..(2920): a, c, t, g, unknown or other
  modified_base (5065)..(5074): a, c, t, g, unknown or other
  modified_base (5608)..(5617): a, c, t, g, unknown or other
  modified_base (6251)..(6260): a, c, t, g, unknown or other
  modified_base (6385)..(6394): a, c, t, g, unknown or other
  modified_base (7109)..(7118): a, c, t, g, unknown or other
  modified_base (7979)..(7988): a, c, t, g, unknown or other
  modified_base (8731)..(8740): a, c, t, g, unknown or other
  modified_base (9195)..(9204): a, c, t, g, unknown or other
  modified_base (9892)..(9901): a, c, t, g, unknown or other
  modified_base (10526)..(10535): a, c, t, g, unknown or other
  modified_base (10878)..(10887): a, c, t, g, unknown or other
  modified_base (11959)..(11968): a, c, t, g, unknown or other
  modified_base (12158)..(12167): a, c, t, g, unknown or other
  modified_base (12545)..(12554): a, c, t, g, unknown or other
  modified_base (12702)..(12711): a, c, t, g, unknown or other
  modified_base (12886)..(12895): a, c, t, g, unknown or other
  modified_base (13483)..(13492): a, c, t, g, unknown or other
  modified_base (13860)..(13869): a, c, t, g, unknown or other
  modified_base (14032)..(14041): a, c, t, g, unknown or other
  modified_base (14423)..(14432): a, c, t, g, unknown or other
  modified_base (15764)..(15773): a, c, t, g, unknown or other
  modified_base (16148)..(16157): a, c, t, g, unknown or other
  modified_base (16493)..(16502): a, c, t, g, unknown or other
  modified_base (17283)..(17365): a, c, t, g, unknown or other
  modified_base (17554)..(17563): a, c, t, g, unknown or other
  modified_base (17689)..(17698): a, c, t, g, unknown or other
  modified_base (17824)..(17919): a, c, t, g, unknown or other
  modified_base (24292)..(24301): a, c, t, g, unknown or other
  modified_base (24739)..(24778): a, c, t, g, unknown or other
  modified_base (24938)..(24947): a, c, t, g, unknown or other
  modified_base (25005)..(25014): a, c, t, g, unknown or other
  modified_base (25074)..(25178): a, c, t, g, unknown or other
  modified_base (27352)..(27361): a, c, t, g, unknown or other
  modified_base (28737)..(28746): a, c, t, g, unknown or other
  modified_base (28807)..(28816): a, c, t, g, unknown or other
  modified_base (28977)..(28986): a, c, t, g, unknown or other
  modified_base (29100)..(29262): a, c, t, g, unknown or other
  modified_base (30189)..(30198): a, c, t, g, unknown or other
  modified_base (31993)..(32002): a, c, t, g, unknown or other
  modified_base (32519)..(32528): a, c, t, g, unknown or other
  modified_base (32715)..(32724): a, c, t, g, unknown or other
  modified_base (32798)..(32807): a, c, t, g, unknown or other
  modified_base (33180)..(33189): a, c, t, g, unknown or other
  modified_base (33732)..(33741): a, c, t, g, unknown or other
  modified_base (35399)..(35408): a, c, t, g, unknown or other
  modified_base (35948)..(35957): a, c, t, g, unknown or other
  modified_base (36334)..(36343): a, c, t, g, unknown or other
cacgaggcggcccatgctcttcaagtcggcaccgccctcgcccttgaagctggcggcctgcggtgtgatggggagttgtggggagggagggcaggttgctggtgttatatcgtatgcgatccagtgcatgacctcacgtctcggtatgcatgggtccctgcagcatgcatgctctgctctggnnnnnnnnnngccgccctcgcccttgaagctggcggcctgcagtgtgatgggggggttgtggggagggagggcaggttgctggtgnnnnnnnnnnnnnnnnnnnnnnnnnnnnnntcggtccagttcaccccagactgaacaaatcgcgcaccttgttcttctggcgaaactcgtccaggagctgggagatgcgggtggtggcctccgcaaagtgggtgaacctgagctccgagaagagggcgtcgcggtcatccagcacatgctccttgcgttctgtctttcctgcaagcagttgaggaagggcgagcgggtggtgaaggcacgatgctgcagaggggcatggaccaggcaaacgggagctcgctttcctgcactattccccgcacgaagcgattgtgtttgccgcgcagaggattgagcatgagtgtccatcaatgtggatgtctnnnnnnnnnnctccccgcacgaagcaattgtgtttgccgtgcagaggatcgagcatgagtgtccatcaatgtggatgtctcgtggaggcgcacccaccctgatcctccacctcacttcgtcctgcgaggtctcaacccaaaagcccaacaactcctgatatccgcagcatgaggtatcacctcaccccctcccaccccccccacctccttgcgtctccgcctcataggagaagacgttgttggagcccaggtccgggcccagcaggtcgtgggccatggcctcgtaggtccactcgtggatgatgggcgccacggggtcggcgccgcgatcggtgattaccagctcacaggtgtcggcctcagggaccagccccgcgtgctgcaggatgagtaggcgctcatggagctccagcgcgacgcgctgagcgaccagcagccggatctccagccccggcgggaagtcgtcgccgggggggatggcggcgcggaagcggatggctggcatctccttcaggctggcgaacagcgaggccaggcgcgtggccgccaccgagatctcgtaggcgtaggcgggggccagctccgcgccggcgccgaagaaggtgcgcaacgcgccgtcctgcgcagtgctgaaggtgcggcggttgagcaccaggtattccaggttcacctccttgatggtgcgcaggcgggctagcaggcctgggcagccacgcaggcgctggagcagctcgggagggaggggggaggagaaaaagaggtaggcgtcgcggtacagcggcttgcgcgaggtgccaaagtcctcgatgatccgcgccacagcctctggcgtgggggccacgaagtagacgccgctgagcgtggtcagcggctcgcgctgcttcagcacgtcatccaccactgcaggcggtgagggagggcgttggggaggtggaggggttcgacgctcgtggggatggacatctccgagtgcagccagaggccgagccggcaacaggcaccctgaccctgcaggcgcaannnnnnnnnngttcgacgctcgtggggattgacatctccgagtgcagccggaggacgagcgtgcaacaggcaccctgaccctgcaggcgcaaccaggggcaaggggcgtgccatgccgaaccgagctgagccatgcacacgggcaccaaacccaagagagctgcactcacgggacacgccgtagtccaggaggtcagcgatgcccgcggcggaggagaacactcgggtggtgaccgggtcgaggagcagcaccgcccaccgcttcacgccatcattcccggtggaccccagcatctcgtcctggggtagatttcgaaggcagtggagggaggattacagcgtgccccgacacgcagccctcggttcaagttgcggagggcagtacaccgacggagcgccaggaatcctaccaggaggcgagagcgggtcactcccgtaagcaccgtttcggacgacatttataaaggtgtgtgagttgatcgcggtacgccaagcacgggcttaggggtggactctcttttcagctgtgtcccatcgccgagagtctcnnnnnnnnnngagcaccgtttcggacgacatttctaaaggtgtgtgaggtgatcgcggtacgccaagcaggggcttaggggtggactcttatttcagctgtgtcccatcgccgagagtctcaacgcggtcaacgaggcccgaggagggcgatagctctgagagatgttgaatttccaagtcgaggtggatgtgtatcgagctcccttgccccaatgcatcccaatgcccgaccatcgcacggcgatgcaatccaacggagggggcatacgttccgtgcagggcgcgcatgcgacagttctgggtcacaggccttgagatacagttacagtgcctgcaatgcgaggcacaaaagcaattggcaaagagaagaggttgctggtctcacaggcaactgatcatgatcgctgttgccaataatggctgcatatcctcccccacgcatggactgtcagtgacccgaccagtcgcgtctgctcggctcgcaccgatcgcccggcgcagcattcaccgcgccattgcaaggtgtgcccctcacgagagcctagtgaacgggatgcatcaaggcatggccggtgcgaagctacgctcccggaaatcccgatcatgggcggcatgcatggctaccgggcagcaaaaggaggagggggtggcgtcccccaaaccaccccctcagaccaacattctggccacagccgggctcttcacgatatggnnnnnnnnnngggtggcgtcccccaacccacccccccagaccaacatactggccacagccgggctcttcacgatatgggcatccctcctggcctacgccttttttgttgcccccaatcagacacccctgaggtaggcaagtgtagacgccgggcccgcgctgtgctccaccatccttgccggtcagcccggtccacccgctcctccccctcccccccatcaatccaagggatgccgtgttcatccagaagctggtgggcctgggcgaccccaccaccaccccagtgaatgctgtcttcacacagctcttcctcgcgatgggggtctggcccctcatctacaccgcgctgctcattcccagcgcccgcagtggcaacggggtccccgcctggcctttctgcaccctctcctttgctgcgggcgtgtttgcgctgctgccctacatggcgctctggacgcccgagcaggagggttcgagtcgagagccgcgccagggcccccgcatcctggagtcgcgcctgctgcccattgcgacgctggccggcgcggtgtactgcatcgcggccgccgcgctggcggggtcggacgcctgggtggccttcttccagctgttctgggagtcgcgcttcgtccacgtcaccaccgtggacttcagcatgctctgcctcctggcgcccttctgggtgggcctggacgcctcgcagcgcggattccaggggcgggccgccgggctggccgcgctgccgctgctcggcccagccatctacctgtgcctgcgccctagggtgccgccgaccactgacgaagccgagcggcaatgactgagagttgtaatgaccgcctcgtgtctggactgcatgtgtgggcgtccagcttgcttcctgctctggatactcgtgttgtgtaggctgccacatcatcgacaagtactgcaccatgcaacatgctgtttatggttgaggatgcagggcagggagtcgcaagcatgtcagactgcagggtgctgagggacttttatcatcctggttcctagtcctctgccatcggccctgcgccctcctcggctctctgttctccagcctcatcaggttcctccgccccggccttgttgtccgccttttcttccgcgggatcagcagcgtcttcgtcctcaacgaccccatcatcatcggggtcttcccccgttgcgccctccgccgctgcgccctcctccactccgacatcgtcgcccggcggtgcgctcgcaggatactgcccgccgccgccgtacccggccgccatggccgccgcctcccagtgcgccaccatctgtgccaccagcacggccatggcctgcacgtccggcacgaccaccggggacgggggggcctcccccacggggcgcgggcaggcgccgtggcgctcgtggggcgccagggcgagggccgtgggccgcgccgtgagctggcggaaggtgggcgccagctcgtagcactcggagaagagcgcggcgcggccgaagacgtagaggccgaggcgggagcgggacatggccaccaccaggcgccgaacatcgcgcaggtggccaaagtgggcggtgcgcaccagcgacagcagcacgtagtccgcctgctgcccctggaacttgtccaccgtcgcgatctgagggttgagggttggggggtggatggggagggggggtgtgagtgagtaatgtggcgtgtgcaacgcagcacgcccatcccatgggactctccctttgccgcccaagtcgaccccactccagtccctgcccgcctcgaccccaccatacccaccttggagggcatgccaaaggcggggtgagcggcgcagcgcctctggaacacgtcccgcagcagcgcggtctggccgttgtaggtggtcagcaccgcgacgctggaggccgggtagcccagcagacgcatgtactggtacaccgacaccaggtactcggcctcgcccaggttctgtaaggaggttggcacaggattgggtcttgttgttttttggggggggagtagggtcctgagcatggatgggagctgttgcagggctttgttcatgacacacgtgtggcccagaggcagcagcagcacccccctcccgctccacctcccctcccctcccgcctcatcacctggtagaagtagggcatnnnnnnnnnncgcagtagcagcacccccctcacgctccaccccccccctccgcctcatcacctggtagaagtagggcatgggggaggtctcgccccgtccgttgtagtcctgcacgtcgatcagctggtagtcgtgcgcgaatcccgcgttggccgcggcaaaggccggcagcgccgcgacgtgcggcaggtcccccaagtctctgtaccgccagttgtacagcctggccaggctgggtcgcgcgcgcccctgcgcgttcagctcgatgtagggcgtgcccaggcggatgaagcgggtgaacagcggctggtccaggttgctgtacttctgcggtgggtatcgaacgaggagggggtgggtgggtaatcatgggaagagcaggtcaatatggcgcaccggcatcctccaacagggattggaaaggccgacagggcgggaggtagaggttctgcagtgcggccagaggtgccctgagccaacaattccaactgaccgcccccctcctggctggcccgcgcctgcctttccacccactcccatcgnnnnnnnnnngtcccaactgaccgcccccttcctggctggtccgcgcctgcctttccacccactcccatcgcacctgcatggccatgttcttcaccacgggcgggagctggtggtggtccccgatcatgatgacccgtttcagccggctcacaccgtcctcctgcttctgtacgagtaaaatgtgaccagaggaggttgggaagtgggtggtgtggggattgtgagctggtagccacctggctgccccgccggcagcctacaccaaagttgcttcatgcaaaggccaaacagcgccgctgccgcgcgtagtaacaccaccctccctaaatatcaatcctcaattgatgacaacgatgactaatcgtgatgtcatcactgtacaggcacttgccatcctacaatccccccacctggagcagcatggggatgaaggtctcgatctccaggatctgcgcactctcctccatcagcaggttgtcatacttgaagccaagctccaggaactccctgcggggggagggtgggtgcggcgggtatggtgcagatacttgcagggtttccgaaatggggcgcgtcgctgcacagcacaaaagttctgcatcctacctcaacgccttgaatccccatgggcagcatcatgccnnnnnnnnnnactgccacgcgtactcacaccaccctccctaaatatcatttctcaatcgatgatgacggtgattaatcgtgatgtcatcactgtacaggcatccgccatcctacaatccccccacctggagcagnnnnnnnnnntggcaggtatggtgcagatactcgcagggtttccgacatggggcgcgtcgctgcacagcacgaaagttctgcatcctacctcaaagccttgaatccccatgggcagcatcatgcccaccatgcgagcctccatgatcccctatccctgcaaacgccacgtatcatacatccccctggcgcacctgcgcttcagggccgcgtgggtgcaggtcatggccacaatcttggcctgcttggtcagcaggtagttgatgcggtccgcctgcggcatggcagagggggtgggcgtgaggcagacgcgtggagggcaacgtactttggcgccatgcagcgagaccagcaggacagagccaggtcgaccctgctactcggccatccccacacatccagcagctatccacctgggtgcgcaggagctcaaagggccgcgtttcctccagctcctggaacatgcgctgcaggtgccggaagcatccctgtgtgggtgggaatgagatgaggggaaggggtgaagaagggaggggccggattgaaacatgtgaccccaccaggccatgcagaacttggccagacaggcacagctcgccgtgcactatctgaacagctgcagcccagacgctacaagaacattacggggatccctctgtgtgcccatctccacttcacacacatatagataattggtttccccctttccacaccctctccatcaagnnnnnnnnnncttatgcccatctgcacttcacacacatatagataattgttttccccctttccacaccctctccatcaagctcgccttggccttctcgaggtcctcgtcaaagtcggcgccgcggaacaggggctgtggcgcgtcagcaaagtactcggcaaaggggaagagcgcagccacggcacccgcctcgccgccctttctcgcggccgccagaaaccgctcccagcgcgacagcacgtgcaggagccagaagtgggccgcggtctcgcaggtgtaggccaccgactcggagacgcgcagcaggcgcgccaggcgctcgacctcggccagcagctgcaggcggcgcgccagcatggcattcacgcgcccgacgcgcgagaacacctcctccgtctccaggtcggcctcgcccatgcccaggcgcaggagatagcgcgcggggacgtcgcgctccacgatcttggtgaacaggtcgttcagtgcctggttgctgtgcgtgatgatcagcgtgcgctggccggggcagttgtggtacaggatatgcatgatctgcaccgccgtgtcggtctttccagtgcctgttgaagggaggggaggggggaagaggggagatgggtagtatgggggaagtggtggaggagattggaaaggggaggtgagacagtccaggctgcgtggacaaaccaagtgaggggcggaggcagctgaaggtcccgcggtgtctgacatttccaacaatcagcaggcccatggttcaggatcagatctatcacatcgtcccgagcaccagcccttcactcgcaggccgttccaccgcggtccctcctcccctccctttttacctggcggccccacgaccatggtgannnnnnnnnncccaccacggtccctcctccctcccttttacctggcggccccacgaccatggtgagccccggttgcacgccggaaaggacggcagatgtctgcaccggggtgaaccgcacgttgttttgcggcggctcgtcctcagggtacggcccggggtcaaccgcggtgtaggcctcagcgtgcaacgtggggcgcctggccttggcccctgcgtcatcctcccggaaggaaggaaaggtgacgcggaaggggcggacgagctggccatcagcccgcgagctcgtcaggctgacgtcgcactccgggaaggcctcccgcaggtggtctggcagtatgttgttgggaaggggagtcaggttggtgacgcgccagtgtgcttgatcactgccaagcagtcgtgccttgcattgttttctcatctacctctaatgcaaacaccgtcctcatacgacctcatcctcacaccaacacgaccagtccacacaccggcatcaaggaaggtatccttgaagtcgatggtctgcagcgtgtcctccatgttcttgtacagcgccgcatctgcaggggtgtgaggaggtatgagcaggtgaagaagggtgtggcatctcatggacaaggggacggcttgccacccatgacaggggacaaactagactggagtggccgtgttgctggagaacaacaagcgcacaaccccagcaggtcagactggtcagagtacagtcctcctgccctagtccccttgacannnnnnnnnnttggccgtgttgctggagaacaacaagcacacaaccccagcagggcagactggtcagaatacagtcctcctgccctagtccccttgacaggagctcccctgtcctacccctccaacattctccctttccccacctggatcgccgtagcccagcaggatgtcgtggagccaggccggcaccgcgcagtcggcgttcatgaggtcgcggatgctctccagcaccgccttgaagttgttctccttgggcttgcgccggagcaggaggttgaaggtgccgtacacatcctccgcacccgatgcctctacagcatccatgtccatctgcatggaaggaaggaggaacagagggtgtcgctgacaccaggtcgccgcacgcacacctagatgaagcaaggggcgccgacgggagccagcagcacgagtacagaaccacccacaccccctgccaagcgagcnnnnnnnnnnccgggagcctgcagcaagagtaaagaaccacccacaccccctgccaagcgagcaagcgatatccaggcgatgttccatcctccagtaaccccaccactcaaccgacctggtactgcgcagcatccatggccaccgtgatggttcggatggagcccttgggacgtgtgacctggtcggggcgcaccctccccgtgaagtcattcagaagctggccatctgcgtgagggaggggcgtgtgggacagctgtgcgttcaatgcccaacaacacctacactcctgctttggggacatgttgagatgttccccctcggcagaccacaagccaggccatgcccgaggtagaccaggcagtcgatggcacaagacatgcagacccgccgctcaggcaatgcacaggccgatttccagtcctcccagtcgactcaccctcgtcccgcatttcgatgacctcacaccctcggacatagtccagcccgtactttctcatcaggctggcgcctgtggccaggggagtggaagcggacggcttggcagtggcaggcgcagactcgcagtgccatgccccaaggtcagcagccaatggcattcctttgatgatggatgaatgctgcatgccccagccctgacccccaagctcacctgtaccgccatcacctgccccagactctgctgcggcagactgcgcannnnnnnnnnaaatgaatgctgcatgccccagccctaacccccaagctcacctgtaccgccatcacccgccccagactctgctgcggcagactgcgcatatgcatcaggcggcctcagggtcagcaggaacatcacgtcgtgctgcttcacctcctcccactcacgccgcacatcctcgcgcagggctgcgaggataaggaagaatgagaatccgagatccaaaccagatacctctccattgtctcaatgctgtcccgactcaggcaggtcgggcacactgcagaccagtccgcccaacccatcatcctcatcactctcccataaacaaacaatatgcaacccctgtccacccagcgcgccactcacagctcaggtccacgaccacctccgcgctgacggcggctggcctcatctccccaaccttgggcggctgcacctccgtgatggtgaagccctccaggttcttggccatgcgcgcccagccattgaaccccacctgggcggtggaaggtgaatgggtgcagcgaatgctagtcactcaccaaggcagtgacgattggacatacagacaggacttgcacccacgccaccacgccgatccccctgcgacctctccagtgtagaccctcccacnnnnnnnnnntgcatgctagtcactcaccaaggcagttacgatcggacatacagacaggacttgcacccacgccgccatgccgatctctctgcgacctctccagtgtagaccctcccacctcatcgttctcccgcagatagggctgcacacgctggagcacatctgcgatatcttccctgatctcatacgtggcctccagcctgcagaattggggacgagtggcgggtgagtccttggatccttcatgtgtatgttgggggcacacccagacaggcacgacaatgactgtgctggcatgcacacgaatggcaaaccatcacctcagcctccctggggacccgcacctgaacannnnnnnnnngatgtgtatgtccagggcacacccagacaggcacgacaacgactgtgctggcatgcacacgaatggcacaccatcacttcagcctccctggggacccgcacctgaacaggttgaagttgcgcatgaggtagtcctggatggtcaggaactggaggttgagcttgggtagggccagcacagtctcccctgcagatggcagaggaggggtgggtgcagtgggggttggatgaaggcgccaatggcaggatgcagcgtcttggtagcatttcgcagaaaacgaggcgcacccaaatacagtgtagtcctgaaaacttctcaccttgcacacttcaaccacagtcacatgatccttgactccaccaaaatcttagctcaccggtgtagtgcagggtggggacctggtgctcgtcaaagagcactctctccgtggggtacaggggcatggcattcacggtctcagcctgcagccggcggcgttcgtaggccgtcaccgccacctccaccaggaactctgggtcctctgcccaggggtcgtcctcgccgaccagcctggatgagagtggagtggccggcagtatgatggtgggatgccaggttggctcaaagcatgggcagacgagtgagggctgtgtgcaggaaggccgcaccagggtacggcgttctaaacgctctgggcggccgacgacactacagtgcagcggagatgccccaccatttgcaggctctcctattgtacagaaggcagggtaacaaggacaggcactctgagattcaccccccaaaggaatctgccacccacccctccccacctgagctggcggcagaccaggcggcgcagagtggccggctccaggccgtgcagggccttggaaagcacgtcacggcgctgcacctgggcacaggacgccagggccaggtcacgcagctcaggcacgtgacggaagaatagcctctgcagcgcctggatctgcgcggcgcaaggggatccaagggatgagcagtcgaggagggtgtaggtgtgactcacactcagcaggttggatggtcaggggtccagtcgggaagtatccannnnnnnnnngaggtgtggctcacactcagcaagttgaatggtcaggggtccagtcgggaagtatccacagccagggcttcccacaccaaaggccgccgcctcatcatatagctcaaagatacatctcagtctcatccacacaagtaaacaatttgcccaagccatgcataccctctcgtagtgcgctgcgacgacctcnnnnnnnnnngtgataaagctcaaagatacatcccagtctcatccacacaaataaacagtttgcccaagccatgcgtaccctctcgtagtgcgctgcgacgacctcctcctcgcccagggcctcccccgtgtggtccgcaatggggaacccggagtagaagcggaagaggtccaccagttgggcgaagagcacgccctgttgcccccgccccgagcacagcgggctcagcgtgcacttgaccagcaccgcccggtcatccagcagggcgtgcacgaaacggcgggtgggcagctgcaggaccggggacagatgaagtagggaacagggtgaagcatgcaagggcgacgaggggtgcatcgctctgcagccagcacgggcgggctagcnnnnnnnnnnagagggaacagggtgaggcatgccagggcgacgaggagtgcctcgctctgcagccagcacgggcgggctagcgctgctcgctgtcgagaggcagtgtttcacctcgtgtccagccgcctgccccggcatgcacaggccttgcatccannnnnnnnnnagagcggcagtgcttcacctcgtgtccagccgtctgccccggcatgcacaggccttgcatccaggcaaggtgtactgcacaaacccgctcctcacagcgtccaccaagccgattccccccattgcacacatgactgccccatgaatcaaccccctatcaacaccccccaaccctnnnnnnnnnnctccccccattgcacacatgaatgccccacgtatcaaccccctatcaacaccccccaaccctcccttccccccccccaggatcgtgcctgggacaggaggtcggtcaggaactcgacaaagcgctcgaggtagagcgtggtgcggcggtccgtgccctcctcctgcacgccgcccagcacgctcaggaactcatccacgagagccggcaggaagctggcctcggggcggcgctgcacgggcatgtgcgcgtcgcccgcggcggccgccgccctggcctcgcgtcgcgccgcgtggcgccagtgcttgagcagggccgggtgatcgtgcagctccagctgcaggcggccgggggagagggcgtgccagaggggcagggaaacgaggcgcaggacctccttgcgcaccgcctcctcctccagcgactgcgtggagtttggggagtttgcagagtcgcaaggtggcggtgaccgtagtggagggctccgtggagatggaagatgagggcggggcggtaatgggcatcgccgcggccacgccccaaacgactagttccccgcccccggcccccctcaaccaaacccacctgnnnnnnnnnncgaggacggggcggtaatgggcatcgtcgcggccatgccccaaacaactagttccccacccccggcccccctcaaccaaacccacctgaaaggcgttgatggcgaagaggaggtaggtggtgcgctcatgcatgtgcagctcgccgtccgtggccttcagcgcgaggaaggcgcggaagaacgccgggaagacctcctgtggtgcagggcggtggaagaatcgggtgatgggcatggcatgcctgggagatgcttcatggatcccaaaccactcagactggcgagcccattcaccagacagcaaggacactccagcatatctgaaagtaagctggactggtgtaagactcaagcacacctcagagctnnnnnnnnnngggacactccagcgtatctgaaagcaagctggagtggtgtaagactcaagcacacctcagagctgaatctgcggagcccgtgccgccctgcacggcatctcccccctccagaaccactctcctccaaacacaccctccgcaccggccgtgactggcggaagcnnnnnnnnnngtcccccctccagaaacactctcccccaaacacccctccgcaccggccgtgactggcggaagcacgtccacgccggcacaccctccctaaacttctcgttgaccatggccaggatggacagcacgtgggctgacgtggcgccctccttggggaagttgggccagaggtagttctccaggtactgcgacaactccagcatggtcaccctgtgagttggtgggacagaaggggcggctcaagcgcacgccacgcctctcctcctggccagaggcagaggcaatggccccctccatgcaggaggccgtcaccatcagtcagcgatgcactgcagcacacctgcgcagggagggtgggctgtcgctgccgccccccagctcatccnnnnnnnnnnccgccatcagtcagcaatgcactgcagcacacctgcgcagggagggcgggctgtcgctgccgccccccagctcatcccggtatatctgctggacgagctcctcggagaaggcaggggcctccccacccgccagcaccgcgctgctccagtgtttgttggccagctgagtcagcttgtccttgctgatctgcgggtgaggtgtgcggcatgggtggggcttggtgcactgcgctgggagggcatcgtttggcaccccaccccaggaactggccatggagcatgcaaaaactcagcctcaggacggccacgacgggttccccacgttcaaattcatgtgcaaacaatggaatacatccaaatctatacctcggcgatggtgagggccccagactgtgctgccttggacttgggcgctgggcccgctcgttttggctttgtgttgcttgttttcgccatcgcgacggtcgttgcaagactctaagcacgttactgagggtataatataagtattcaccaagtgtaatacgctgcgtgccagctaagccccgtcctcggacaccttgtcggaactgcagcacttgatgccgcagcagccaggcatgggcagggccacaagagcttcagcagacagttcgcagtttcagatacatcttgatggatgtaacgatatgggaagagggaagtggggaacctgtttaatctgttcacgatcgtgcactgacaccccacctcagctcgcatgctgcgcgccccgatctctccaccgacaactgcaggagcagcgggcttgaggctgccttgccattactggtaagagatgtaaatcggtaaaacagagatcagcaacaagttcaacagtcagtcgatgcgcaatgtctggtgtaacataagctttgggtcatagatgaccttcatatgtcttggctaacagtgggagatgcgccagatacctggccagctcatggagctgataatcggtccttcccttctgacaatattcgcagccttttcatcgaggaggacatagaattcgatttgaaagacaccctgttgttaaaggtgcctgttgaacatggatgctcatgcgcgtcactactgtgccctgcacttcacagttgctcgtgcatgctatcaaaagggtggatcctcacaacataaccggcggcagacaaggattggagggatactttggatgatcagagttatcgagatagggccatctgtttgctccacaatgtgcactgccatcaacaggcggaactcctaaacactgtgtcaacaatgtttttgcccacctactcccaaactcacgattggggcgggggggacttnnnnnnnnnntcacataaccgtcggcagacaagggttggagggatactttggagcatcagatttatcgagatagtgccacctggttgctccacaatgtgcactgccataaacaggcggaactcgtaaaaactatgtcaacaatgtttctgcccccctactccaaactcacgattggggcgggggggacttgaagatgctcacagctggaatcgtggctggttcttacctcgaacacgcgagaacagcagccgcaacatccttgcaactataatgaaaattttgacgcatctgaagttctatcgatgcctaagacaagacctacagtagctccatgcatttggcgttcgcctctccctatgtctttgcacttccctccagcttccnnnnnnnnnnagcggctggttcttacctcgaacacacgagaacagcagccgcaagatccttgcaactataatgaataccttgacgcatctaaagttctatcgatgcctaagacaagacctgcagcagctccatgcatgtggcgttcgcctctacctatgtctttgcacttccctccagcttccccagaatcctcgatggattttttacgttattttggtctccgcggcccactcgtgtaccgacgtattgtacataagagcgggtcaatcgcaagatttattcgccattaaatagttttaaagagtttttaatctaggtaccatggcgtcgcttggctatgagaannnnnnnnnnaatggatttttacgtcattttggtctccgcggcccacccgtgtaccaacgtattgtatgtaagagcgggtcaatcgcaagatctattcgccatttacaaagtttttgagagtttttaatccaggtaccatggcgtcgcttggctatgagaagatcgaaggacaagatcatggccactggctgctcatcatagcccgtccccgcgaggagagctacttcttcgcccccaccctcaaggcgctacaaaagcaaggcgacaccgtcagcgtgctatgcctcagcgcatgtaggtgcaaggagtctcctgaatcttgctccgacgtcttatttgtttcggacaggagtgatcatgtagggccggacgctcggggctgcccatgcctcacacaagccctccaccaaatgcactgcgcagtgagtgacgagtcactgaaaaaatctcgtcaacaagagctgagagatgcttgcagagtgctgggggtaggtctcgcgatcgttatgcagctctgggcgtgtctagggttgtttggtccggaggccgtacccccggtctgtcagtgagttgtagtcaatgtgcttttctctgccttgtacagattgatgccgaccgggttcggtgcatcgatgacccttcgctgcgagaggatgcggagtgggcgactgaggttgtcgccggccatatacatgaggctgtgaattacttccgcccaactggggtgagtttggccaggcttccttcagcccaattggtgccaggctggatctctcctttttaccaggcnnnnnnnnnnnnnnnnnnnnnnnnnnnnnnnnnnnnnnnnnnnnnnnnnnnnnnnnnnnnnnnnnnnnnnnnnnnnnnnnnnncactcacatgcacgccgcgtgctacaacggtctggtgcactatatgaacttcaagaaggaaaaggagagggtgctgagggtcaagatcctggtgagtatggactatcctggaggtgtcatggacctgtggtctgaaggcatcaacagttcctgtgagtctctgtgcactcctccgtaaggattctttcnnnnnnnnnngtttccacaccaacactgatgggtcgatcaagtctgcaatgaagatcattcaagcataaaactcagggtccagcccctctttccaccttgtaggtgctcacttttgataagaacagcggcaagtannnnnnnnnnacttccacaccaaaactgatgggtcgatcaaggctgcaatgaagatcattcatgcatagaactcaaggtgcagcccctctttccaccttgtaggcgctcacttttgataagaacagcggcaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtcaagatcctggtgagtatggacaatcctggaggtgtcatggacatgtggtctgaaggcatcaacaggtcctgtgagactctgtgcactcctccgtaaggattctttccaaaaatcctccaggaaaccattcccaagtgggcactctatgacgtatactacatctggaccatgatggccacggcatggtgcaaaaagtcagtccaacactatcacacttgttgggcgaggcaggcgcggcgggcggcctccaagcacgtctcacagaagaagtggtattcgtgcttggcgagtgggagtcgggtgtacatgtttgcaaacaatgtccgtgacgatacggctcagtttgccaccggatcgacgggatagaggagacggagattgttggctgactgataagatgcatcttgtgtaccaaaattctgaccgagtgcatgcatataatgtaccctacagtacttcacctttgtaacatgctagtagttggaccctcaacgacctgtatctcgatctgttcaagcaatcagccagagccgccagccatctcttcttatacattgttgtagaatgtgagaccgacagctgaagagacttcttgatgcgcggaagtcacgatactcgacatacctcttagcgcagctgtagacggggcaacgcatctctacaggcgccttgatacaattgaaacctattcgcaccatccgtggcatgcagcagagatggcttctcgtcacggctcaccccgatgacgagtgcatgttctttgggcccacgatcgttggcctgaggcagacgggtgcctctgtcagcgtgctgtgcctctctacaggtacgtcatttatggaaggccccacatcactgccttgaatgactggaaaccgattttgcctgaaccatcgactctcccctgcacaggcaatgccgctggcttagggccacttaggcaacgggaactctttcgctcctgtgctgtgctcggggttagtgttgggctatcggacccaactactcccaggcgtactagtgagtagacaaccagaccatgatgctgctcgccatcctacatcatttccattccccaacatcaggtgcctagcagccaggtcacatgcattgatgacccagagctccaggatggatcgagttggcagatttcaaaggcagccgttcatatacagaagagcctggaggtggtcgacccgacacatgtaagctgtatattactcccctatggcgctgagaggattcattcaagcttgtaaatgctgctgcatttgcgagcactgtgggcacccgagctatcagatcaaatgacaacccctgaccatttcccaacaatcttgtcaataggtgctaacatttgacgctgctggagcatcgggccatcacaatcatatagctacacactgtgcggtgcagactgtcctcagctgcaggaaggacctgcagctctacctcctggtaatgggaggctggggtgtctgtcttgtaagggttggcatgcagcacaaggttgaagtacgaccctcatgggcagctgattctgccttaccactggtccacttccacaagcaccgtacagccattgccgaagtcaccacacctcatggcaggagaccttccccctatggcagaagtactcgcccctgccatccctcgccggctgggcgtcacagctgctccacggccgagctgcaggtggctctgcacccaagatcacctttggcgccctgagccctgtggtgccctggagggccatgacctgccactcgagccagctggtatggtaccgctacctgtggctggcattctccgtgtacatggtgtacaaccgcctgagagtggtttgacacaggggtgaggctgaggaggatgcatgtgcagggcatgagcctagggtgttacctaggctcaaggacaccaggctattcttgaaaccaaacatgtaatgtaaatgcttcacgtaacactccaaagtttcgtcccagtgttcaggctgtttccttgcagtatcccccttggcaagtccaacattcctgttgatacagattattcacagtctcagcaacacccagaccagttaaacagtaaagcacgacaaggtagccagtatcacaaggaggatgtgttcaagagtcacagacagcttcagccgagcgctctgcacggcatcaaccagggagacacccatctacgagagacgaactatgcattttgcgtcgagctgtcacccccctcctcggggagtctctgcagggagctggcgggcagcaggggcatgacagcctgggacgcgccccttccatccaccgcgtcatggttgagcacacgtgagctgttggccagggtgagcaggtctgcggagcttcgaatgtagtagccggggagcgcggcgccaggcagacccggcggctctttgctgccgggacccgttgggtccgggccggccgcctccccgtccacagagtcgtctgcgtggttcagcgaggcgtctggcgcggaggccaggctcacgcccagggccgcctgcgcggcgaagatgaggtcctcgtcgatggcccagcgcaggggatctgcgaagaaggactctgccaggcgtgcctccggcgacttccgcccccagaaggtgtagatgaggttgatggacaggcgccgcagctgcagggtgggtgggtgggtgttgaagggctgtgaatcgttgtgccattggcagcttgagcgccggccggggagcttccctcatcagatcttgtggcagcaagcactgctcaggtttctgcccctgtgccaagcctgggtcattcgggcctgcctgcatgcctgagaaggggaccaaccaccacccatccaccagccgccaaatccacccaccacccatgtgaggttgaacaggagggagatgagcgccagcgtctggaccaccagcgtcgtctcggagctgccggccagctggtcggtgaggaaatggaggaagaggccctccgtgtggtagtccagggcctcgatcgagcgcagggcgctgtcgtttggatggggtatttggaggtgcggtacagggaggaagagttgccacccacaaccatgtcctgaggcatcgcagcacccagcatctgccccaatctcaccaggacagacattatcagacacaatcccctcccccctccatacagaaaacaatactcactcggccacggcgacgcggccctgcagcatgccctgcatccccagcagggactgccgcatctgctcccccaggcaggccacctgctcgctctcatgctccagcagggccaggtgcgacaggcgctgcgcatccatgctgttagcaaaggtggacagcgtgttcaggatgtgcctgcgttgttggggggtgcgagagaggtgggaccggtgttggaggagggatgcagtgccggctgattgctgggcaaggggtctcctctggtgcacttgcatgcgcagcgcttgtggcaccgcagccctcgcgctcgtcattgctcagctgcaaagcccatgccaaacccctttgtcatgacccccgtgactttgtgccaaggccagcgtgcactccccctctgtccacccccccatcccggtcccctgctgccaaacctccaccccacctgaagaggcgctgcgctttgaaggcggagcgcaccggcagccggtgcggggcgtggaagagctcgtactcaaaggccagtgcatccaccagcggggccatgcccgcgatcttggtggcggcctgcgatgcttggaggaggcagcagcctgaggcttggcccttgtgagcagcaaggcctcgcgattcattgactggggcgcttgctcctccccagtgacatcacggagtggcaggtctgtgaagacacacaactttgaaacaggaccagagatacactccaggccccccctaaccccccgacgcccgtgcccgcccggccccgctcaccggccagatggtcttgtagaggtccaggaacacaggccccacggggcgcgggtcctcgctgatgacgcccggcccggcctcaatccggaactggttccaggcggccaccagctgcgccctccagccccccgagtagaggctggaccgcgccacaaaggcgggcccccgtcgcgcccaggccccggaccccgtcctgcgggcgaggccgtcccgggggctgcgctcgggcgcctccagggtcaccctgcggccagggcccgcctcgcccgacgccgcctcgcctggcaccgcctcgctggttgcggccccgtgcaggctctggagggtgggcggccgtcggccgtcgccgccggcccagtccccctcggtgggcaccaggcggcgcagcatggccgcgccctggccggccagcgcgcccaggctggccgccatgagtccccgcgccgtctggcgggaggaaaccgggaacaccacctgcgccaccagcatgtggatcagcacccccagcaccgtcatcaggctgcgcagcaggccctgcatagggttgattccaagacaggaggggaaattgtacctggaggcgagccgtgctggggcatgggagtggcatgcaggacaagtagcctccgggaaggcagcgagaggggggtgctgggttgctgtcattgaccagcagagggaccagctcctgcaagacgcctcaccgattcaccagtaccacccacatcaaaaccccaaaaccacgcatctcacatagttccagaagacctggtcgccgatgtagcccggcagcgccgagccaaagaggcagaagaatcctgccatgtaggcaaaggtgttgcctgggtcccaagcgcagcaggttgctcccactgccgagatgcatgtcaggcagatcgtggtgacgatgaactgcaaggttttgttattgaagggggttggggggagggatgggttgattcatgcagtgattggcatgtgctgtgctcattttgcctgtgggttctgcgccgcatcaccatctgattcccccaacacttacaaatcgctccccggcatccacgtcagcacccacatcacccacccggacgccagcacaatgacacctcaccttggcggggtggttgtcatgattcagcccgttgatgagcaccgcaaggtagagggtggccaggcccagtgccatgcccaccaccgtgcccaccactcgcagcgaccccttcttgtacactgcgccgattgaggtctccgccacagagatggtggtcagcatggcccagatggggcgctcccagagggccaggtacgacgcgtccacccccgtcagcaccatgaccaggccgtacgaggcggcggtctggcaggcgatgcgcaggtgcaggggggtgattcccgtgcgcgctgtcaggccacccatcagccggtcccagcgcccggggggaagagcggggaccggttccaccctggccacactccggcgctgcagcctgagagcgcaggcccgggaggagagggtggcatgggctggcggggttaataactttccggtgcaagggggtggggcctcccgggagctgcacgccagccttgatggcctgcacaggaccctccagccccaaactgtctgtacattaccaccccatatacaggagttgatgtccagacaggacagccgcatctcctctgcatctcagatatggcaacccacacccacctctcccgcatgcccggcagctcctcgcccgtgccgaggctgagcaggaactcgtccaggccgatggcggagcggcggacggtggagccgcggtgaatgagggaggcctgcagggcgcccagagcctccctccccgcctgcgctcaggagagggcagtgcatgacgttgattctcccagggtttgtgccttggaaacaggaggagcatgcacgcgggattctgcacgcccacccagggcgtgggcacgcccgcgtgaaacccctccgcttcagcctgctcatagctctcagccccttctgcctcaccgcctcattggcgggggccggggtgtaggcaatctttgccatgtctgccgctgggtaggccagcaggaagctcctgacggccttgctggactgcggctggtcctttgccagcaccgcaggcagaacctggtagatcttgcggatctgcaagcgcaggtacgaatttttgacagactgtcccagtgccaagatggatggttgaacagttgtttggtcaaagggcacccagactcggctgcagagtgcccagcggggtcacgttcatgggcaccagggtcaggcatgccgccaagagtcgcagtcgtgaagattgcgtatccacatacgggcgagcatttccccactgctccctggtccccaccctttggccttcctccataacactccccgtacctgagnnnnnnnnnnattcaagggcatcaggatcaggcatgcctccaagagtcgcagtcatgaagattgcgtatccacatacgggcgagccatcccccgctgctccctggtccccaccctctgcccttcctccataacactccccgtacctgagtagccgaggtcaggacgtttgtggccatgatgtggaatgccatgctgtctggggtgagggccagctccttcggcagcctctggaatgcgagtatgaggcagcacagggcgccatgcaggtcgcccagtgcctgcaggccgtcctcgatgggcgcattgtcagtcaggcaggccgccgcccggcacaggctgactcgggcgttgtccctgaccctggcaaacaggtcggcatgggcgtgcaccatggacagccggagctgaccggcctgggcgggggaagaggagagaaggtgggggggnnnnnnnnnnnnnnnnnnnnnnnnnnnnnnnnnnnnnnnncgacacccaggaagagggaccctaggccacacagacccatgcgccaccctccacgccccccatgaaagcctgtctgaggagaatgtactgagggagggtgcagagccccatggcctggctgtacagcctgcaggcaaccaccactgcatgccaggcagcnnnnnnnnnncagtatcccggtgtgggtgcatggacggcccagtgaggggaggactgcacaaacgccnnnnnnnnnnggactgtcccgatgtggggtgcctggacagcccagtgaggggaggactgcacaaacgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccataaaagcctgcctgaggagaatgtactgagggagggtgcaaagcccaatggcctggctgcgcagccagcaggcaaccaccactgcatgccaggcagccaggcatgtgggcccggaccagccaccccagaacaccaaccctccgcgtgcctgcactgggtacagcatgacggtgacggcgctgagcagggagcgtgccaggagggaggccttccagaagggacgaaaagcgaggacgtgggtggggcggtagaggtccagttccagccgggcgctggagctgtgctcccgcgcagcctgcagtgagcaggcccgggggtattggtgtgatgaaagaggaggggagggaagcattctatatggtagggggcgtgaggtggatgagagtggccggcggatcctctgacaaggcacaatctcatgaacccttgctgagtaacatcccccccgcctgagcaagccaggaatcacatcctcctcctccccggatgatttccccctccatcgcaccgtgatccttttcccggagttgtaggaggccatgtggatggatatgacgcgggggtaaaggccggagtcgatgttgagggccccggaatcgcccgtgcctgaggccgcagccagcttcccctcctcgttcagcttctccagagtcaagtccaggatgtcagccaggacccccgcggtggcgcgcaggccgttggcgagcgccatccgcgccagcaggcctgcgagagtgcgtgctcgcaggggtgggctcgtcggggtgacagggctgcagcggtctgccactcaggagcgaagtggaggtctgactgggcacctgcccagcaggcatgcacgccaaatacccaacgccagaggggccaagcccggggcacggcctccccggcacacggcaggcccacctgcgggggggggagctatgaggaaggtggtggcccaggtgatggccacagcgacgcaggtgtagaagaggaggtagcgtgggaactggggcaggaggtccacgggagtgcggtaggcgccgcaggcgatgagggcatagaagatgaggacgatcaggccggggaacttctggctcgggcgcatgactcggtaaacagccaggcagtagatgacggggcaggaaatcagcagggtcacgaccagctggggtaaggagggaagggttggggtggacagggtgacatggaggggctccagtgagcatgtccacagggcgtctgctcccccagcctggaaactggtcgcacttcaatctgcagcagcgacagaccgtcacaacacgacttctcaccttgacggcggagttgtcattgctcccccccatgatggccacgatgaggtagagcgaggccagcgccaggcccacccccgcggagctggcaaggaggaatatggcccccagcctgaacatgccctgccggctcataggcctcacgcaaaacaggagtgccagccagaagcatatgagctggggagggtggaggggacgggggtcttggggccagggctggacatgaactgcaaccatataccatcgcatctgccgtcgtgcactcatgcaagggtattgcttctcccatacgtctgcccaccacccctcaccatgggatttacaaactcttgggtgacagtgaattttctccagatgccagggtagctgaaaatcgccatgaccaggaaggtggaggcccccatctgcagggtcatggcatgggcttcatggagacagctgtgaccccattccggctggtcaacttgtcggcagtgacattgccccgacctagcaacacgggaccacctgcactccttggcgtatgtgaacggctaggaagccccgctggaccatccagccgggcagccggctcggccagaccccacccgaaggggccatggcccgcttgcttcgcctacagcaaccggcgctgggcccttatgtagctagtaatattaccaccatgttgtattcatgcatttcatgtaatagcaagggtggctgggatttggtgtgcaccatggtcccttgcttgtcccattcgacatcatatattcatatactattcaggatctggctcggggcattgccgaggcgaagaggcataggctctatctctcgagagagaatcacagacctcatccgtttccagcctggcatgcatcccctccnnnnnnnnnnttatctcgagggagaatcacagaccttctccgtttccagcctggcatgcatcccctccatctgacctatcatcgatgtctctcgtctcatcacagcgcattgtccctccgcaacgcattcagcatcggacccagcgcagacctccgcacccccggccgtggcttgaccgcccctcttgcgctcatgggggccggcgcggtgctggctggctggggagccggaatcctcgcctcggccactggcgaccctgacctcgcgcccacgcccccgctcgctgtcgcgccggctggggaaagcacggcgcgccgggcctggagctgggcgtacaggtcggcccaggccccctccggcacgatggcggagccgagcagtggcgacgcagcggcgcccccgcccgtgatcagggggggcggacccaggcgggagtggtacgccgggccctggctctcaaaggcgccggcatcctctggccgctggccggtcccgctgacacgggccgcagcggcatgctgcccctctctcgtcaccgaggtcgggccaggggttgtggtacgcggggcgctgcccacccaagtgggctccaccagctggtccatggcagcctcgagcgcgccattctcggcgtacgcgccgtactctgcaggggttggcacgtgaggctggtcagcaccctgcccagcccgctcccaggacaatgatcacgcagcgtagggggggaccctgcgagggaacccatacgttcctgctacactctcctccaggtactgttggcaaacaggcccacctgcacattcgccattgcccttacctggttcatctttctcatcatcatcatccatgccagcagcctcacgctgccgctgcacctcctcccaccgctgctgcagtggatgcccagcggtgggcgggtgcggcttcagcaccagggtcctgctggatgggtccactgcgctgaccaccccccgtcgtggggacgacacctgcgccatgcgacagggtcgagggggagggaggcacatggcgggggggacgatactgattacattctgtcagactctgtgagcagccggccgatggcatgaccacgccgtccactccttgcacctgcgacctatcatccctcgcagtcaaactgcccctgcccacctctggagatcctccccagcattccaggaggcggtactgcaagacgtctccctcgcctgggagctcgcctggggggactggcgtgaggatttctgcctgtgtcgggctggcgccctgcctgccaagcccacccccctggggccttggagccccaggcaagggtgtgccttgtgctgcagagtctagctgagggaactttaggcattccgccggcctgccgggagttgcannnnnnnnnnatcgcattgcccttacctggtacatcttcttcatcatcatcatccatgccagcagcctcannnnnnnnnngcgcgcactgcggctgggacctttggcacccgaggtcggcgcctcctgtgggtgaagtggcagtgtgcggattgtgtggaacgaaggcgctcagggacacaggcacatttgctacatgaaaatccaggccatcgctggcaaggacacggaccagacaaccnnnnnnnnnnaacgatcctgattacatttcgtcagactctgtgagcagccggccaatggcatgacgacaccgtccactccttgcacctgcgatctatcatccctcgcagtcaaactgcccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccatccccctggggccttggagccacaggcaagggtgtgccttgtgccgcagagtctagctggaggaacttcaggcattccgccggcctgccgggagttgcagcagctgggctgggcctcttgatcaggccatccgccgtccccttgccgtttgcagagccagggccggccaggatgcccatgcgcttcagccgccgtttggcggccttgcgacgcgcactgcggctgggacctttggcacccaaggccggtgcttcctgcgggtgaagtgggagtgtgcggagtgtgtggatcgaagccgctcagggacacaggcacctttgctacatgaaatccaggctatcgctggcaaggacacggaccagacaacctccggcatccataaaggcaaaaggtacttgaccctggaggtacctggagcattgcgggcgaggcgggtgacaggcccaccaactgagacggggattgtccattcctgagaccaatgtttgacagcgatgcgcaccgccccgccctggcctcgcctgattcttcctcagagctgctcgtatctgtctcctcttccgagctgctgctgctgctgccctccacagcttccccctccgagctgctgctgctgctaccactgctgccatcgtcaggctcttcatcagaagtgctgctgctctcttccgtccgctcagaagagctgctgccgctgctgctcacatcttcctccccgagccggacccgcttgaccttgcgcagctgatcctggtgggagactttgcctcctgccgttgccgaacgcaggggggggcctgcatcgccaggcgcagggagggcaagatgtgcggccgatgtaggcaagtcttccctttgcgggcgcttggcgccccgcctgtcgtgcatcacatgcttgcgaatgactatttgcagcacgtnnnnnnnnnntgttgccgaacgcaggggggtgcctgcatcgcctggcgcagggagggcaagatgtgcagccgatgtaggcaagtcttccctctgtgggcgcttggcgccccgcctgtcgtgcatcgcatgcttgcgaatgactatttgcagcacgtcgtccctgtccagggtgccgacaggcgagtcctccagcacgtagaagccggctacctttgcaaggacctggggtcggacaccggctggcatggcttgcatgcagacctgcaagagcgccacccagggcaggtgatcgaaatgtgaagtgattcgtgtaccattaagaacctcaatgtgatggcatgcagagcagtctgggtcagggtgtatcccgatatcaagggtgggggtgcacaacgcttcccacctggtcgaggacgtcgccgacagtgcgcatgcttgccgcgatggggagcctggagagggaacaggctaggggtatggacacatacctgaaagtgtaacttgcatccgagcatcaagtcgcatcttccttaccagaatctgtccaccagctcgaagtcttcccttcgggtgttgggcggggtgggcaagaccacccgcaccctcgtcaagcagccgctcctcattgcggctccgatgctgatccacgaccagataaaagaatcccttgggaaatggcgcatgttgtgtgcacaacgatgctcttggaccttggcatcgagcaatgagtttgcgcgcgctacgctgcgattgttgtccgtctccatgccgagaatgatgtgggaaacgtcaaagcctctcgtcatgggctgcatggtccagaagagaggtacgccgtgtacgatttatcatgtgcatgttatttacaggcagtaaggtctacgaggttttgctgatggagtatcatgttggaagctacaccattgtctgtcactctgagcatgggagccatccttgccttggccatgccaatgcaccttccattgaaccatgtgcccagttgctcgtttcgcagctgtaagctcgcctcacgaaaacaagctcagggcaaagaggtgtggtgtgcaagtcgaagcttcgcgcagggttcatcttcggctggtgtcaagtcccagggcttgaggctagtcgcacaccctgaatctcttctgttggattcaaatcttaacaggtccaaaaggcagagatgcccctttttattgctttacgacctcagtgcacagaaagattgattccagcaccggtcctcatacctaaggaaatcgttctcactatggattgattttctgcctcactcccacctgtgcagtaagcatctgcgtcagtaaatgtgcaccgctgtatcactcacatacgagaaccctggaccctagagtcacctgcagattgtcgtagtcagcctgcgtcctcccgcaagagtgcggtgtgactgaagtggccgttcagaacagccagggcgcagtttggggcaaaggagcagaggattcggtcccaggagtcgaagaaaggtccgattccgggcctgagcctcagccagtctgaggtgagcaagtgattgacacgacccttggacgcagctgagcacatcagtggctgattgctgaagggtggcatgcagtgatccaatgtcagtccagggcatcaccaccgagtccatcaccgtacccaccaatgatacatctcttaagcgccttctgcaatatggcgacaaggacttttgggggaacaaccctcacccacatatagtttgggtcatcctcccggctggctctcgtctgctccatgcacagcgtcgcacacaggnnnnnnnnnntccttctgcgatatggcgacaaggacttttttggggaacaaacctcacccacgtatagtttgggtcatcctcccgcctggctcttgtctgctccatgcacagcgtcgcacacaggttgcctgtgtgatgaaaggggttgaatcagcatagcattgaaccgacataacagcatgtatggttgccatacatttccctgatatatggcacatactctgttctacggggatggtctccatctctgggagcgatgggcgcccaatatacattataatttggtaggaggacccgctgtcaatcctcagcctcacgactgtgccaggagcaaaatagcattaccccaagtcatcgcgcagcagcagcctgtgcgcaagaaggtagtagatcagagggcactgtgatggatgtgggagatctcattttgaccaaaaatgggcagccagtaatgtttgcacgggcagggtgtgtgaaggccgcggctacaggaggttacctgccatgcccaaaggaacaagggtgnnnnnnnnnnggcattgccccaagttgaagcgcagcagcagcctgtgggtaggaaggtagtagatcagagtgcactgtaatggatgtgggagattccattctgaccaaaaatgggcagccagtaatgtttgcacaggcagggtgtgcaggccgcggttgcaggagattacctgccatgcccaaaggaacaagggtgnnnnnnnnnnctcctccaataattttcaagcctgtccgcatcgcacatcccacactgaattcgacaaagatgttgctgaacctnnnnnnnnnncgtcaacatatcgccaatctccttgccttgcatcctcagggacgtcgatgcacgttggtgcagaaaggtgcctccagctgttgttcctccaataattttcgagcctgtccgcatcgcgcgtcccatactgaattcgacaaagatgttgctgaacctccgcctacaaaaccaggatattgcacactttgtatgggtctgggcagaagacacctggctgtgactagtggtggccaaaacttcagatggctgccaggtcgatgcacaggctcaccacctctcatgtgcccacctcagcgaatagggtacggacatggttggcaatattgctgtcgcaccagctacgaaattctcaacataaccagaagtgtagagnnnnnnnnnnaaatagggtgcggacgtggttggtaatattgctgtcgcaccagctatgaaattctcaacataaccagaagtgtagagcgtcaagaactgcaagtgttctctgggcgatgtgtaggtccctggccagagtggggggtttcacatgaggaggggacagtggcaagggtaagttttgtggctaagactagggctggtggaaacccctcatacagactatcaccaaacgtaggaatgacaagcatgctcccacagtcgtccgttgcaagtaccttgggggttgccacgctcttgaagctttctcatagccatatatgctgtacttgaggatgatgacgcctcagtagtggtaaggggaaacacctacggcggcaccgggagggttgtcccagggtccaggctcagtccgtataacattgtgaggagccgagcagacagggcggtcgtgtagctcacaaggtccaggctctatcaaaacctacattttaagccagagaagcatacctcatccatagtaaacgtcttgtaagtcaaaggatgcctctcnnnnnnnnnnctgtgaggagccgagcagagagggcggtcgtgtagcccacaaggtccaggctctataaaaaagctacagttcaaagccagagaagcatacctcatccatagcaaacgtcttgtaagtcaaaggatgcctctccaacctctgctcaccaggagagtcgatggacccccgacagtggttcaaaatgaatgagaaatggctgcttcatctttctcactttcctcccgcgcatcctgaagacggtactgaacagcttggcctcccagccaaactcgggcgtcaccaagaccccgagatgattaagaacctgcaggagcaggaatggaaagtggcgagcagctacagaaccagggtgccagctggtcccacctctctccaagatacaggctacagccaggttacttactataataagcactacgaaagcctcaaggggggtgaagtaggtcttgtcaaggaagtctggaagcactgtgggacaatagtcctctgcagggtcctgggagtatggccgaaccgtgaacagtggcaggtccccctgcaaacagggaaggaggtagagctcatgtaccatgcagcactgccttggggtcttctcgatttcgtgtcagatgaatagcttgtgatgtgtccctccccactcatcagtgaccctccgtacctctggtcctgagcagaggccttggctggggaagaggacatgggctgtgcatgtaagcaccaagtatgccttattcaaaccttcgaccatatcgtatgcggggaagaagggttcaagcttggtgcacctcacattgtgctccgcgcatgccgctcagttgcgctctttgcaggaggttgactaataagctacatgcacggatgtagagttaagagctctcctcatcccattcacccatacgtttcgcattcggctgaggcttgaacatgccgacctaccaggatcaacattttgcaggctccgtgagactctgtcaatgagagcttcccacatttgccattcgtgctctgtgcgcacggtacgttcaggagtgtatatgatgtgctgcggatgccagggtggcaggtacagatgatggtatgaatgtaaattgtcagatgcatgctacaaggtatgcaaggcctgtcagggtcccaggttccagtgtggatgtcatggcgtgcgtggctggaaagcatgcagcactcacaagtcggagggtgtgaaggaggaaggccgctccctggtctgcattcgtcagtatacccttgagcaggattcctgcctttgtacccgcgagctctctaatccttatgtagtcatccagcctcacagcccagaacctcattccacattgcatgactggcgcctctctctacgcacgcagcagaccctgcgcagaatcggcggagaggaaggcagtgctgcgattcctgcgaacagaattccaatcctccttgtcctggcagtcgggaccccatgaccccactgggaatgcacctggcaagctgggtcaccactgggtgacattcaagtgccacaccagaactcaaccttggtagacaaaatgtgtcaactgcccagaattcacggccccactggagactggtcaacgctgtaagggcactttgtcggtcctgcacatgatggacttcagacatctgatcactgctggaaaagnnnnnnnnnncgccacaccagaactcaactttgggagacaaaatgtgtccactgcccagaattcacggccccactggaaactggtcaacgctgtaagggcacttcgtcggtcctgcacatgatgaacttcagacatctgatcactgctggaaaaggcacagaagcggctagcaagccacaactcacgttggtcatcctttcacgcttcccttctttcattggtgcgccaggctcatgggaaaacagagactccctcatccgtgaaggttcccgcctcctttcgatgcgttgcatgaatgtataggacaggtacattttggcctccttgcacgttccagctagtcggcacatactttgggtattgagaagctagtagcagatgtcgtgatgcgtcagcaaaaccctcagcagtggatgcgctacctttccagggttggagccagaattcttccctgcgaaatccaccccctgcatggaggcaaacccgtctcctggaactccctttgagtattgcggttttagcaattgaagtacaaagcaaggtctcgcnnnnnnnnnntggttggagccagaattcttctctgcggaatccaccccctgcatggaggcaaacccgtgtcctggaactccctttgagtattacggttatagcaattgaagtacaaagcaaggtctcgcaatctgctactctggctgatcatgtcgagagtcatcggaagaacagtgaggacgctcccggaacggaaaccaggtcacagcatgctcgggggcgaaaggcgaagttcgactttccactcagtgctgctgccatcatctggtcctcagtcgcagggattcagtgcagctagattgccaattgtgtgtgtcaagcctgcacttataacttaaatcagcaggcatccatccagaggagcacccaagcgctggattcttcannnnnnnnnnacagtgcagctagattgccaattgtgtgcgtcaagcctgcacttatgacttaaatcagcaggcatccattcagaggagcacccaagcgctggattcttca

SEQ ID NO: 32899 - DNA, 68 bp, Chlorella protothecoides
gccttgcacgacgtcaatctgcatggggcgcgggggtgggggaagaagctggtgggaggtcaaatagc

SEQ ID NO: 32900 - DNA, 96 bp, Chlorella protothecoides
catcacgttcaggcaaggcgcccatggagtcgagcaatggcgtgcccggctaaggcctgagtcaacctaccaggacatccaaatggtcagtgtatg

SEQ ID NO: 32901 - DNA, 61 bp, Chlorella protothecoides
agatgcattccagagcttgtcgtgcgtcttgcccttctcccactcctccctgcatgatatg

SEQ ID NO: 32902 - DNA, 69 bp, Chlorella protothecoides
tgcaagctcgatgcgccgctccagcatctgtgatgaggtggagaaggcacggtcgggaatttgcacaga

SEQ ID NO: 32903 - DNA, 61 bp, Chlorella protothecoides
aggaaaagcctgatcaagtaataagggaggaggaatgcatgggcacagcatacatcctagg

SEQ ID NO: 32904 - DNA, 80 bp, Chlorella protothecoides
tgcaggtgccctgaagacttccctccggcggcgcagctcgcacatccaacctcccactccccaccctcaaaccaatcgca

SEQ ID NO: 32905 - DNA, 69 bp, Chlorella protothecoides
tttgctgggcatatgaaattggaggttgaatacagcacgttgcctaccattgaggaacttccttgggga

SEQ ID NO: 32906 - DNA, 99 bp, Chlorella protothecoides
acccccttggatcccaggtccccctgcacctccagtgggtctgagggggaggccatgcagcgacgttgctgcatggtcactcgcatctacccccccccc

SEQ ID NO: 32907 - DNA, 12146 bp, Chlorella protothecoides
  modified_base (7883)..(7892): a, c, t, g, unknown or other
  modified_base (10154)..(10200): a, c, t, g, unknown or other
gtctccccctccacccaagaagtcgtctcctcctccaccgcagcccccaactcctcagccctcccctgcgccggcctctccgtcaccctcctcgcctcagccctcccctgcgccggcctctgcgccaccctcctcgcctcagccctcccttgcgccggcctctccatcagctctgcctggcccagtgcttagtgccgttagagttgatggcaacaaggtgaaattcactgtgactgaaaatgactactggatgagtagcattgatatcttcaagaacaaagtccttgcctattcgtggaccgagctagaccatcatgaatataccaacaccccggaggatgtttatgccgctggtagtctgaactgtttcacttgcaccgcaaaggattacgatgcagggacgtccggcttgtcaaacgaggtttgcgtgtcgttttaaacttcttgttgggagcggtggagtgctcgagcagtgactaaagctgtaagtccttatcggtccaccatcttgaaggggagtggatatggcaaccatgattgtcctgtcagtccgtcgccgctttcgtcgatattagtgagattccacacgggagagatcaaacagcacgaaggacaacagtactgtgaagggtgtgagggacaccattaacacatggggatctgacaatccagctctcgcacagacgttggctgaccggcattgcgaccgatttagaatacgagcagttttgactcaagcagtgtgacgttctgctgtctcgatctcgataattgcaataccctttggcgaaatcatgcaaagctaacagacatgatcaacgcaccagcatccgagggatcgttcacgatgcacggtcacgggaaacgcttcctcagcaggccatgggcgcgtcttggaaatagacgtgcatactatccatgtgcaatctactggtaaagagaacctgtcattaaattccccctcgccgagattgaggtcgactgcttcacccatggtggaacctgcccgcggaactggcgtgcgcaatgcgtggcaagcgccaaaccctacgcacgccttgacaatccggtccatgcaggctggcagccgtaccagcgcatcctctccagcatccgacccaagtaaatgcgtggtgtatatccaattttaagactctgtttgacatgagcaggctgtaacgttagattccacgttacagcgctgtgaaggcctcccatccctcagcgtcccgcagtagagtatatcgcatcccgaggaccacagcgagaagggatactctagaactgctggcgatcgaagtttttcttcctttggtagtcatgcgtgcgaactttgaaatgaggcgaccgctcctggtctttctgctgctctcgacggcaggcctgtgcatggccacgtcgcgcccccatcgctctcacatggcgagcccggcagaggtgagaccgtgcatttcgctcggccgccttcgatgcatggcgacctaatgtgttgtcggggcctaaggcatgcgtggtatgctcctgtctgccacagggagtcagcgtggagaggacggctgccggggtcgtggtacacaggctcaggtatgcggtggtggcgggcatgggtgaccccggggctcatccaaacggtgtcgaaagggtgggtgccccaccatcagcatcaccacaacattattcccccatgacaggacacccggccgtccgatacccctctacttccccgacctagacagctacacggcctggtcttctcacaccaggtgggttgcggcccacgtcagcgtcccagcgtcgcagtgtctgggggagagacccccttctcatggctcctcgagaatgcaacagggccatgctcccattggcatcgcacgcgccccccccccttcgatccctgcgcaggcgcggtgcggccagccagcgcctggagcactccaagcggtacgacgcggactccggatcctggaccgtggcggtggccgccgccccgccgctggacctgctcgtcgtgcacgatgggagccgggaggtgggcaggtacgaactggtgcagcgcggcggcggcctggtcgccgaccgggcgggcggcgtgctcctgctcctgcacgccggggccgaggcggtgccggggtccgatggcccccgcccccggcgcctggccgaggcccaggactgcttcctggcggtgaggggcacgctgtacaagttctcgggctgccggcgcgcgcgttcctacctccacgactttgtggtgtacacctcgctggagaccggggcggggggccgcggcgtcctgcgcctgggcgtccaggcggcggccgacggcggctgggccgggttcggcctgtcgcacacccgcagcatggaggggggggaggtggccgtgctggccaccgacgagcgggtgccctcaggtctgttcgtgtgtgcgtgcgctctgtgtgtgctctctgtgtgcgctctctgtgtgctctctgtgtgtgcgagggggggttggcgagcggggggttgagtgggggggagcccggcctggtgggcagcaccttcaccagcggtgttcggctcaccccaaaccggctgccgagggtggccagggcaccggcccggcagctcgggcgctcttttcagcacgcccccaatcccgaccaactccctgcacgcccacgcacaggcgccacgatctccaggttcacgctgttcagccccctggcagagcgcatcaacgccgccaacggcagcttcgcgctgccgggggccgtggccgaagcacaccccagtgagcgcctgggcgtgggttctgagggagaggagggggagtgcggagggggtttctgcccggcgtgggggaggggagggagggtgtgggggaggatgcgggccggggcatgttgggcattccggagcagcctgttacctggcatccaccttcctggcgtgggccgtgtgaccgggtcgctgcgcccggcggccgcggacccaggctgccacgagcacagcagggctgtgcgttcccggcagggtgcctgatgccgggggcggttccccacccctgagccccactcccaaccccactcctcccccagacggcacgctggtggggtactttagcgtggagacacccgagtctgctgccttcctcgcctcccagccccagtactttttgtttgcacgagggcccctggcacagccgggggtgctgggcgcccacttccaccccacaatcgagtacccctatggcggcatcgacatagacctgttcccggtggagggcgtcccggcctcgccgctggaacacatcgaccccgacgactacgaggtcctggaccttgaaccccccctggccgaggccgaggaggagatcgccgtcgcgtcgttctctgaagatccctaggcctgcgcagccgctgtatgactgcacggctacccgatgcaattgcatcccccgtgtggctggaaggcagccaggtgtgtgtaacgagttgaatgcgcgtcgtctccacgaagctttgaagacggggagagtgctgagctgacacgatggctttgcatggtacagccaaactcgctgcggtatggctgtcatgcgtatggacagctgtcatgatcgagaggatgctgcccagtggagatggcacaccaacatgttgggagcggcaatgtggagcagcggtgcacagtgatcaccctctaaccctggcttcctcactttgataaccacttgcagcacctttgtgagttacatcactgcccatgtggaatagcaacgcaactaaggctagtaatgacggaccatccactgaataagcgacaatggattcttcttcctccggaaagcccaaaggggcatgttcgaacgccctgccgggggtgtccaaaccctcaccgacttggatatacatcgcgaattccatctgttcgaaaggaacactgggaatcaacgctgtatgagaaaggtaccgtgagctgctaaacaccccagtggattgactccatgatggaggggccagcttccctgcaagcacttcacgccccaatgccgactttggggcaccggggttacaacctgaccagtgaccacatctcggcaactgatggagctggtatcagctagagaatcgaaaccgagtaatgactcacagttcctgatatgggctggcatcgttcgaaacctgcccacatgaaagggggtggtttgaccacgttacaaggggtggtggtgatcggacggagttgcattggaagttgatcgtctgcatggacgggtctccgtaccacttgaaacgaccgagtgggtccccggcatgcctcagggcactgaaaatgaccccaatcattgcacaatcatcatgcagacatgataattgtgccgcgggcagggttgagcgatatcaaacgtgaagtaccagatctgcccatccaagaggacaaaaaggatcagccccgccaccgacaagccatcttcaaatagaggttgccccgccagtctgacaccgattagtttcagtaattcagacgacggccgcttcgatcaaattatgacgatgcatgtgtggacggcgctcctcctcctggcatcttcgagccatgccgctcatcaggtccggattcggcgacgcagcaggtcgagcagactggggccctggcccgccgatgaagagcgtgtcctttggaatttttcctcactcgatcacatcgcctctacacagagtttgagcgcaaggaggattgacacgggggtggagttgcaagggctgaggtacagcggagtcggggctgaggagatccatgcgatgcctcatgcgagatcgccatgccggctgcacggttcataatcagcaaactttttcgatactcctactccagatcaaagccccaggttcgcttcgcatactttcagaccctcgaagttgccagtcgatggatggcgggtcaggagtgagtgagcttgactgggagagggactgtatgggaggggattaaaatgggagggctgacaaaggcccaggctgtcccatcccccactcgaactttggatccaagggcgcaggcaccagggctggtgcacagagccttgatgcactctttccttccacacagcaggccctcggaagcaccgatgagggtaccggcaacccagcagtttgacgccccatcggggacctggagtgccactgctgagacgcccagccccgtctcctggatcgtcctggtcgaggacggggtgcaggtcgtgcgacaggctgtgactggcagcactcctgggcggggttctggggtgctgctcatcgtgagcggtgacaaggtgctgtccagggctgacagggccgggcagcgggctcccttcggccacacgtctgactccagctcaaggtcgagccgccgccgcctgctggccaccggcgactgcaccctggacatctcgggcaccgcccactccttcacggcctgccagagcgtggccaccggcttcaccgtctacacggcgctggaggccggcgtcggcggcgtcgccgtcctgcgcatcggcctggaggcggccgcctccggcggctgggctgggttcggggtgtctgccaacggcgacatggtgggggggcaggtgggcgtggcggccaccgaccccggcgtcccctcgggcgccaccgtgtcggggttcgtgctgccctccacctccgcccgccgcgtgaacgccgccaacgggacgctggccctgaccggggccagcgccgcggcgcggcccggtgcgggaggagtctgatgggaccagatggtgcctggggtcctcgccggtgcctggggctgtgctcctgtgtgtggtgtccggaacggcgtggcgtggaagggaggccgccacccaggggcgggtgcccggcacttgcggtgcacgcagcagatctgcatgtgctccatggctgctccccttctcaacccctggccacccttccctcccctgcacagacggcaccctcctggcgacctgggcggtccccctggagggcacggtcgcgtcggcgcaggccggccccacccgattcatctacgccattgggcccctgtctgagcatggggtgctggcctcccacgcccggggggggaactacccgtacggcgacgtcagcatcaacctggtggcggcatagaccggcgggcacggcccacctgctccccaatcggctctgccatgcgttgggcgacaagggtggcagtcctggcagcgggacaggggcaccctggtctcatctgtgctattctcgggcggaatgcagggccgactggcatgttgccggacacttgtctaggtttaagttgtagacgtgcatgtagaatagaaatgtgtgtggttcggagcagcggtggacatgtgcgcggggggccttgatacaaaggtcctcaagaggcatgcccagacgtcagcgtcatgcattgccctcgcacttgcgctcaggcccattggtaggcaaccactccctgtgtacctgtcttttcactgccaaagacttcgagaaaggcgccagtctcgcaaacatcatgtcacaccatcttctcatcaccatggagactctccccccacccccccctcctcggctccctgacaaacataaaatcgaggtttgcacagctccaagattaggctgtggggcatcagatttttgaatatcaaccccttttctccgggagacctgacgacatacgagcctcaggagacgacgagtagctgagagggtagctggctcctgggaatcgagcagttccgcctgtacgaccggaagactggcgcacgcctccagcatgtcacctacacatgagcggattaagcatgtaccagacagattcccttccatccgaccaagaaataccccgcatctgcagcgcgattagtctcacggtgcaaaccggtcacgtgtcattgataccctgtgtttttgccacggagtaccagccgggggaccgggcagttctccgcgttcattaacccctggtggtcctgctgtcccagaactcctaggatcgatgattcgattgcagccgctccccggccctgtggcctccaaaatgttcgtcttaactgtgctcattttactggccactactggccaggctgctcagcaggtccaaggtcggcagaccgacagctccagggtgagtgcatcagggttccccgtccagctcaccatgctggctggaaggagttccacagtgaatgagcgttcctcggtggcctactcgcaggtcctggacgtagtcagcagtgcctcggggctgcagctgaaagggttgaggtgagccttcccatggatccggccggccgtgagaccgacgattccctggggatgctgagccctgtgacaaccaattaccgcagatcggagtctaagcttcgttttgcatacttcgaggaccctcgggatgctgcactctggaccagcgggcagaagtgagcggcaaaccctgctggggttgtcgggtttccaggggggaggaagtggcggacctcagacttggccacctgccagcctggtcacgtgccgttggaccacgcacagataaatttccacctccatgcactactcacacccactttccaggcctgtgcaccgctcagggcgggtagcacacacccagcagtaccatgccgccaccgggacctggagcgcggtggtggaggccccgggcccagtctcctcggtcaccctgctcgagcagggggtacccgtggcgcaccgcgacctccagcccgacgcagcgggtcttgcttccggcgtgctcgtcgtctcttcggggagcacgcccaccgccagcaccagccgtcaccgcaaggaggcagagcgcatggccgcccgtacagcctccagccgccgcctgctggccaccggcgactgcannnnnnnnnnccgccgtcctgcgcgccggcgtatcggcggatgcatccggcggctgggccggcttcggcgtctccgccgaccagtccatggtggggggccacgtgggcgtggtggcggttgactctggcgccgcctcaggagccagtgtgtcgggctacacgctgccctcctacaccgcctcgcgcgtgaatgcggccaaggggtctctcaccctctccgataccagcgccgtcgcgttgtccggtgcgtgttcgtttgagggttgggggcaggaagggggggaaggaggggatggcaagccgcaatttggccgagctgggcgggtgaccaggactggcctggggatgagaaggagggatcattgttttggtgacctgggcgaatctcatctgtgcatgcctgcagccccatttgccgggggtccacccctgcgtggcttgtggtcctcagatgctgacttcaaaacgtggccgtgtccaggtcctgctccaccatcccccaccgcatccccccttttccctcccaccgcccagacggcacgcttcgcgcgacgtggtccttccccctcaaccagaccctggctgaggcggaggccgccgagaccgggttcatctacgccatcgggcccctggccggggcaggcgtgctgggctcccacatcagtggcaacggccacccctacggcggcctggccatccagctggcctcggcgggcgcggccagccccgcagtcgcgccctcccccgggagcgccgcctcgcccagcccctccgtctcgcccagccccgccgcctcgcccagccccgccgcccagcccagccctgccgcctcgccctcgcccccgccggcagccacgctttcctgcacgctggtcgggttgtccagcggcgcgggcgaggagtttgggtcctgcgcctcccttccctccttcggcagcgggttcaacctgttctggaccgcgcgcgaggcctcggggtcaaacgcggccacggtgacctggggcatgaacaccagcgccagcgacggctgggtggcggtcggcttccccgcctcgccgggggagatggtgggcgccaacgccgccatcctgtcctcctgccccacctgcgcctcgggggtcaagctggagggctactacctggccggcaccagccaggctgacgtccagcccccctcccgcatccagctctccgacatctccgcctcgcgcctggatggcggcggcatggcgggcgcgttcactgtgaccctggcgaccagcggcacggcccgccgccgcggcctgctggccctgggcacccagcccatcatagtggcgtcggggcccgtgggcgccgacggctccatccagtgagtgcagggcgcctggcagtggtccggggggcccttgagggcaggggaggcttgccaggagaaggatgccagggtgtggcggcggcatgccgcatgctgtttcaggagccggcacggtcgtctgggtgctcgactgagagggctctggcacctgtccaccacacagcatcaacgcccaagggcccctgctgtcgtgccgataccgagtcaggccgggcacatgttcgcacccagcaactcccaaaaaccccttgtgcgcacaggcagcacgacctgtatggggcgagcaccgtgaacctggcagacgggggctcggccagcgtggacggcacgtccgacgacctgagcctgatcaaggtgccggcgatgggattggggtcgtgatcatcgagcggggctctcttgagggtggcggggaagttcaggaggggctgccaggccgggctcgaagttccgcatgcctccctgaccctccttgccggcgggtgcagcgcgacacacgtcactcggtacaagcgccgtgatgtctggggcggtctgttcgtgcgcccacttcaaccagataaccattctatctttccacatcgccaacccatcctccaggtgcacgccgcgctgctcaccgtgggctggggcatcctcatccccgccggcatcctgctggcccgctccttcaaacgccacgaccccttctggttctacggccacatcgcggtccagaccctgggcctggccctgggcatcgccggcgtgggcattggcttccacctcgtcggcggctggacagcgcccaacgacacagtgcagactcaccgcgacctgggcgtcaccatcctggtcctgggtgtggtgcaggtgtgttggggtgcggaaggggggatggtcaatttttttttttttttggaggggggggggggnnnnnnnnnnnnnnnnnnnnnnnnnnnnnnnnnnnnnnnnnnnnnnntggagggcaaggcaggccaggcatctatccccgtgtagagctgtacaggtgtggcgtgcatgcttgtgaactcagagtgccccgagctcgggcgacccactcatacaacgcctccacactcccaggacccccccccctcccccaaacccactctcggctgcagttcctgctggcgctcaccaaaccgcacaaggagcaccggcgccgtgggtggtggaacctggtgcaccaatggctggggcgtgccgtcgtggtcatcgccatcgccaacatctactagtgagtgtcttatgcctgggtgtggggagcgcgggaaagagcgggggaacggggtgttgagtttcaagactttgggctgcagcacagcagcagctgcgcccctcgatagtccattccaggtcgtgcaagcacacaacacatacccccacccccaccccccatcccatcccaccaactcctctgaccccacagtggctacatcagggtgtacgacttaggtgtgtggccctacgccacctactcgggggtcctgggcctcatcctgctggtgggcctggtgcgggaggtccagctgcgccgcgagagtgctaggctgagggtctcggcctcgggccagttcctggccacccagaacgcgctggccatgccggacgagcgggagtcggagagctccacaggccccgtcaagcagaaggccgcagtctgaggccaagggagggagggaggctgtcatcccgacctcggacgcccttcaggacgtccgatggagtggggacaaccccgaatccccactcgccggccttgggaccattgtttcagtacgcaacgtaatcctgcctgccctgccctgagcaaggcgctctgtgctctcgaatacaacttccccgaatgcccgaagactccttgtcctaacccgtgactgttctgtaatgcaactctcagtggcgccgagaggacacgtgtctcctcaccgatcggaacaaggcaaggcactcaccggtgggtggggcgaaaccagccttcccacgcggtgtcgggcggatggctcacacatccactccccaccccctggagggtgtttgtgtttgtactaaattattttcccggctccagcgtcgaccatgcatagcgcctgacatggggccgtcgcccaccaaggtgtcccaacttccgacaccaggcctggtcgggcccgggacgcgtcgcatggtctctcccatattctcgagatgtgtggtcaaggtctcggctgtgacgaagccagcaccgcgcacccacctgccggccaggcctgcggaacacctgccccggcaggcagccgcacgcgcaccccggccggggttccccggcaacctgctgcagagcgtgtggccgaatagctccaaacctctgcctgacgtcgtcgacatgcaccagctggcccaggagaccgtggagcgggcgtcgcaggtgcggtggggacccgtgcagaacctgggtgacagattggtcgagccccgccccggcgtgtacttagcccggccaacgcacctcgtcccccccccagatcgacacgagccaggtgggcggggcccaggcggacctgtcctccgcgctgcggcccgcaagcctgctggagctgcgctacgtgcgcctgctgagcagcctgtcggccctgagctacgggctgtcggcctggaagccgggttggctggcccgcaggcacggcctcaccctggtggccacctccacggcctgcgctgcggcgctggccgcgcccggcggccaggcgctcgcggccgccggcgactctgacgcgatggcccctgagccggcgctggtgcgacagcgctgcgcggcgctggcgccccgggaggccgagcacgagggggaggatgccacaccaggcggggccgcgggttcaaccgacacggccacccgccccggcatcgaccgcgtgggcacca

SEQ ID NO: 32908 - DNA, 130 bp, Chlorella protothecoides
cgtcagaccgccaaacgtgccggtcacgaaagcctcgtccgccccgtacacctttcggggagggggcagaggtcatcgagtgtgtggggttgctgggcgcgcagctcacctacgcactgcaccctcatca

SEQ ID NO: 32909 - DNA, 76 bp, Chlorella protothecoides
cctgccatgtttgagggagggggagcttgagtgggggggggccggacggaccgtgaccaccgtctgcacgtggcac

SEQ ID NO: 32910 - DNA, 61 bp, Chlorella protothecoides
atgttctacgttcccgtgctgttcaactccttggggacaagccgcaagacatccctgctca

SEQ ID NO: 32911 - DNA, 63 bp, Chlorella protothecoides
ggccatgtgcgtgctggttctaggttccagacgcatggggctgaatggtagatctgccctgaa

SEQ ID NO: 32912 - DNA, 130 bp, Chlorella protothecoides
gccccaccactgcgtgttgccactgtgctcgggactgtgcacatgcacgcctgatgctcacacccagatcaaggaagctgtaacaaacgaatgctcgtcggggcacggcggcttcgctgcatcacttgcg

SEQ ID NO: 32913 - DNA, 101 bp, Chlorella protothecoides
atcacccctgcactgcatcgactatcgtaaaccccctctcaatcccccccccccgacacacaaacactctccatcgcagtggacgtggcggtgcagaccgg

SEQ ID NO: 32914 - DNA, 79 bp, Chlorella protothecoides
tgttacagcgcaagccgctgtcactggagcaccgacagaagatctcgcaggccaacagtggcaggacctttacactgag

SEQ ID NO: 32915 - DNA, 66 bp, Chlorella protothecoides
cgcacgtcagcctcctgcctgcgctcccgctcaggacgcacgtcagcctcctgcctgcgctcccgc

SEQ ID NO: 32916 - DNA, 77 bp, Chlorella protothecoides
cattgcggcttctgaaatccaaacccagaaatatatatacttctgtttcggttgtacaaccacctgtgtacttgttc

SEQ ID NO: 32917 - DNA, 61 bp, Chlorella protothecoides
actccacagggtgctggtacggcagacagcacccctgacatgctgaccctcccggagcctc

SEQ ID NO: 32918 - DNA, 61 bp, Chlorella protothecoides
gtacctctaatcattcgctttacccgataccactgcatacatgagctccagctatcctggg

SEQ ID NO: 32919 - DNA, 65 bp, Chlorella protothecoides
gggccagctcggtctgctccttggcctgggcaggaggggggagggggttgtgcaggtgcggtaca

SEQ ID NO: 32920 - DNA, 75 bp, Chlorella protothecoides
ggggggagggggttgtgcaggtgcggtacacttgcagttgtgatgggggggagggggttgtgcaggtgcggtaca

SEQ ID NO: 32921 - DNA, 61 bp, Chlorella protothecoides
tcgcagcgccccccccagccccggccgccgtgcccgaccagcctaccccagccccgggccc

SEQ ID NO: 32922 - DNA, 61 bp, Chlorella protothecoides
ccgtgcagcagaagtggaacctggagttcaggtagaccctggggtggccctgcggtcatcc

SEQ ID NO: 32923 - DNA, 85 bp, Chlorella protothecoides
gaccacctaatgtcatgaactcacgcaatgtcctggtagctcatgttgtagtcgtggaagcggtccgggaagtcacgtaggaggc

SEQ ID NO: 32924 - DNA, 2399 bp, Chlorella protothecoides
  modified_base (222)..(231): a, c, t, g, unknown or other
  modified_base (854)..(863): a, c, t, g, unknown or other
  modified_base (1836)..(1845): a, c, t, g, unknown or other
gaggggggtggtggggggttgggggtttgggggtccccttttgtctcgtgtcataagtatatccaatgacattcaggctgctgcctgacctacagttaccatgccattccacctgtgagaacctgtgatcacacacacctgcggaccccagaccctgcccctccatcccctcacgctctccctttccacgccttcagggtgcccacggcgaccggctggtgnnnnnnnnnngtggtgtcagaagtatgttcaacagcatccaggctgcttgaccttcgattagcatgccattccacctgtgagaatgtgtgatcacacgcaccccccaaccccagcccctgcccctctattctccctcacgaactctccttccacatcttcagggtgcccacggcgaccggctggtggtgggcctgaccggctaccccaacgtgggcaagtcctccaccatcaacgcgctgtttgggtccaagaagacggcggtggcgccgacgccgggcaagaccaagcacttccagaccctgaacgtcaccgatgacctcaccctctgcgactgcccgggcctggtcatgccccagtacgccaacagcaaggcggagatggtggccgcaggggtcatccccatcgaccgcctgaccgacgtgcgggcgccggtgggagccatcgccctccgaatctctcgccgccagttctcctctgcctactccctgcacctcaggggagaggggtgagtgggcaatgggatccggggggtcgtaggggtggaggttgggggtgatcctgccaccggaacggccggctgtgtgggttcctgtgtggacggcgcactgctcccattccagcctttcctcccnnnnnnnnnngtccggggggttgtaggggtgaggtttgaggtgatcgtgccaccggaacggccggctgtgtgggttgctgtgtggacaacgcactgctcccattccagcctttcctcccctctcttccccccctttctgtccaggcacccggacgcggtggaggtgctgcgcgctctggccctgtcgcggggctgggtggtggggtctggcctgcccgacgaggtgcgggccgggcgccgcatcctcaaggactacatcgatggcaagctcatgttctgcaaggcgccgccgggggcggcgcgggcggtgagggccgtggcggcggccctggcacacggcggcatgcccgaggcgttggcctgttcctccggagcgccggcgctggaggcgccctctggcggagggcaggaggaggcctccacgtctggggaggaggacagcgaggaggaggaagggccgggggtgtctgctgccgccggcgccgagctggacctggcggacctcgagctgctggaggagctgaagctgcaaggtatgtgaatttgaggggattgcaagggaagtgaggagtcggaaggatgggcaggcttgctggggtactcgtttcagtgatgctagcgatcgcactctctacaacactctgagagcagcagtatccactcccacaccccctcgcagcgcaagggcaaaagccgagcaagccggtgcgagcggcacacaagttccacaagaaggcggcgcgctcaaagggcacgcgggggatcgcggtggacctcggcaccagcgacggcgcgatgctgcagcacggaaagcgcggtgggctcgtcaggatcgtgtctgacgccactgcctagtgccggcatgacatgctctcctttcgcacctcgcccttgtaaccatcagcatggaaaacccctcaaatcagtggaccagggctattcaacatccgaccactggaggcgctgtcttttgtatgcgcagnnnnnnnnnngctcccttcgcacctcgcccttgtaaccatcaccatggaaaccccttgaaactagtggaccagggctgttcaacatccggacactggaggcgctgtcttttgtatgcgcagcctcagtaattctgaatcaccatgattcagattgctggaagtggggaatgggcatccattttacagtggcaagtagaggacacgggatactgcaatggggctcttgggggggcacgttcgagtggcagctcagcgcctgagcccgccggtgagggacgacagcagccccgtcccaaagctcatgtcccccaggctggccgtcatctccgccgcgcggtcgcccagcagcgcgccgagcttggagccgcgcagtgcatccatggccgctgcgcccatctccttgggccccggcgcctgcgcggcggccgcgccgcggcccccgccccgccccgccggcctctcctccttgtgtgcccgcgcctgcagcgcggcgcgcagcgcggcaaaaccgtagtgcgcgccgccgccgccgtcggcgtcgaacagtgggcaacgcggctcgg

SEQ ID NO: 32925 - DNA, 61 bp, Chlorella protothecoides
agtgcagcttccgcgaggaagacaggcaggtgcctggggaatcagacattcgaagcaggca

SEQ ID NO: 32926 - DNA, 61 bp, Chlorella protothecoides
gacttgtcagggcaagggatccagatctagatacgatccattgatctcctaaacacagaga

SEQ ID NO: 32927 - DNA, 80 bp, Chlorella protothecoides
ggccagcctgccgaggccctccagggagtagtcctcgccctgcagtaccttgtcgtcctccagccggcgcaagagctgac

SEQ ID NO: 32928 - DNA, 101 bp, Chlorella protothecoides
cgcttgcacagcgccctggaatgtgacatccccctgcgccgtgtgtgcatgggcttgtaagagtcttgggggggaagtgtgggccaaggctgtatgttcat

SEQ ID NO: 32929 - DNA, 23911 bp, Chlorella protothecoides
  modified_base (11492)..(11501): a, c, t, g, unknown or other
gggggggggcccggttgccgggagcgtggcgcggcccaccgccagcgcggcggcggtgcgcgcgagcgtcggccgggcggccagcgccgcgtgctccaccttggcgggcacgacgcaccagagcgtggaaagcacggtgcgcacggcgccggcgtcgtgctcgtcggccaggaaaccggcgaacatgtcgcaggcctccatgcaggcggccagcctgaggccggcggggaggctgtgcagcgccgacccggcatccaggtaccccgccgcgaccgggctcgtggcctggcgcgtcccgaggagggaccccgccgccgccagggcgcgggcgtggactgcgcccatgcgcgccgcccagcgcgcaaggtcccgcagcgagaaatgtcggcccacaccctggagggagggcaggctgccgtattcggctggcagccaggaggggcactcgtcggccggcagctggccatacatggcccgcgccaggtacagcatgcgcagcgcagtgcccagcagggtcggacccagggccggatagagggtgcggaggattatcgcctgatcctcctcacccggtgcatcggctgcacgagtaaggtaaaagggaagtgggatgataaggctgcttgtggcggtgcagggtagggccctttccgaagaactgccagcaagggtgagcgggggtgctcctcgctggcatgagacaccccagaagtaattgcagtttgaacaggagactgtataaaagggtcacagggctcagagagattcccacatgagtttctcatcacggtgtatatctcagttgtctctatctactgatgtcaagaggttgcatcactgccctgatgccggaaaagcagggaacatccacacaccgctgacgcagtctggaatcaaatgtagtagttatgcagcacatctctcatcagcacctgtcccccaatctccccacccatccctctcatgcaagcccgcctccacctccactccaaccaccccctccccgcctcactcttcacatggtgaaacagtcctcccagcatgtccaccaccgcggctgacgagccgtaggcacccgcccccaccccctgcggcgtggaggtcaccgtggcaaacagctggaagccggggtgggcggtcagggtctggccccgcgcggcgacatggagctgccgccgctcagccaaggggatgagtgcggcaagcacctccggcggggccaggttgatgtcctccaccaccagccacctgccctgcgccacggcctgggtcaggggccccgcgcgccacacaaactcgccggggcgggcggtgcagacgtaggctcccatgagccccttgctgtccgtctggtcgtcaaggtgcaggtggatggcgccggccgcgctccccgtcacctcctccaggtggcgcagtagggtcgacttgccggacccgggggggccctccaggaggacgggggaggcggcgcagaggcccagcgcgacgccgcgcagcgtgcgcagcatgcccggcgtggacaccaggcgggacgccgggagggtcatgggtggcgcagggccggggcccgtggactgaggcaggtccacgcccgcaatcctgacatagccggggaccgcgagggtcggctgcggcccagccttgccccctgatgccgaggatgagaccccctcgtccccagagaagcgttcgctgctgctcgtgtcggagttggagccatcgcctgcgaggatgctacgtgtggccttgcgcttgcggctggccgggcgggcgcggcccctgtcccagggggccagcgcggcggcggcctccacggcaaacgcagccgcctcctcctgccagaccctgcgctcggcggccagctcctcgggggacagcagccgggcctcgaggcctctgacgtcggcgtctgccagcccgaggagcaccgcggtcaggtggatgccggcccacctgaccccgggggaggagtggcgcaggagcgggaggacggcgggccaggaccagacgcctgccaggtcccggcagcgtcggagggtgcgcagccctgcacgcgcggcgtgggctgcagcgcgcccctccatactggggtccaaggcgtgggcccaggggctgggcgcggcgcgccagtaagccagcgcaagccttgtgtgtggggggtggggagaagggttggttgcggacggtgtgggtccagagccccggcttcagtgcaccctgcccagctgcgggagggggccgcatcaatagcaggtgtgtcccgcgagatgcaagagcttgtcaacgtcggtatcaccatggcagtcagcaatcatcctcatatcgagtgcaggcctccagtacctgtccgcatgtggggccagctcgagcacggaggccagcgccagagacaactccaagctgggtcgtgcggcgttacggctgttcagaacagcatggacgagggtgctgatggcggctaggacgtgccgccggaggatggtgatggccggcaaggtgagagcagggtccagaaggcactcctgcaccgcggacactgtgatgccaggacgcacatcagccggctacggggaggggaggaatgtgggtgaaatgtgtaatcgtgcgctggctacccatctgttcaaccacgcgtgtgccttcaacaccccgggccaccaccagcgtacacacctggagctggagcaggcggtgcacggaggacagactgccggcgggggggcatcgcaccaacaacctcttgaaatcgtctatcacatccattccagaagtatgacaacgtcaggtcgcgggtatggaccttctccgcgtgggagacgccttccgtcggcgccggcaacgcaggagtcaccctgggctctcgccgacgataagccaggatggggcaatgaagggtacagctttttgatgataaatcgcaaactcacagggcttggatccagaagtgttggtgaggggcgatggtgcaaggttcttgcatgcatggatatcgggagcacgggaactctcagggcgcgcgaaatgttcacggcagcctccggccaaagggacaggggaaggattctttgttacagaccaacctccactcagattgtgaatgcgttgcctggatccggaagcaggctgcagcgatgccaatatggattctggcatcgtgaccgggattgagtgcgccagccctgcaccgcaatatgccacactcgacagcccgaacgaatctatatcatatccccacagctcacatccagtaagtccattggcatacccagacgatctcgcatcggctcaattgaagggggctgagtacatgttcggcgcgctcctccttactttgtccgctgagtgctgtccctggtggggtccatgtctccgacactctttcggcgctcaggaaggtgtacaatacaaatctctttctgcgagtgtattcttctgggccctccagtgataaatgccacattgttgccgtgtctagtgtatcaaggggacatcttttagatcagtggttttcatctcctcattgactgctgtgcaaagcgtaactcttccggaaatccagatgaccgaccgtcgtccattgcagaatccaccaccgaaacctgcaattcgtatccttcctgaaacccatcgagaacattgaatcaggcctccttgccccttcgcaatgacgcaatagtgacttagcatcggctacatgtcagatggcgtccagccaccaccactgccaggggtgcgtcgccgcctcaaattggcatcttcgacctttttacttgcaaattactgaataattttggtgtttggcacgactgtccccgtgattcgctgagcccggtcgttcggttccgacgggagttacacacgatggagcactttacatccccgttgcattgggaccgccgtcactgtacgcacagcttatgatacatactgacacagaattcttcgacacttcacaatgtacccgtccaatcagagaagcgggagccggtgggtctgagagctggcaagcacccctcaaccaggaaccctcagcgtcccagacggcgcccactgcaagtagttcccaggacacccctcgcacagcctgcatcaactggaaccttgaaaaggtgcgatgtgttgcaaccttcagtgtgcgaccaatgtcttgaattcaacactggtaatacattgcgcactttgatgtgcaggtgacgtcattggacatggaggagtgtcagcacagacaggcaggcacaggcctcaacaatcgctcaggatatagaggagtgcgaaaggtgagtcagtgacgacgtcaatgtgttacagacatagctctcgactacatgtgtgattttcattcttgtcggtcttgattcacatttggacgcttttttacagaggccatgggggaagtgggcagctgagattcgggacccacatcgccctacacgacgttggctgggcacctttgacgtccctgcagaggtgaagcctcattgcattgctctagccctgtccagggtttgctctcaatggaaacgaatggttgtgatggcgcaaggccatcaagctcttccagaatataccctcgcccatccaagtgggactcggatacgcttactccaacacagacatgatgcttaatgttcccaatactgcaggcagcccgcgcctacgatgctgctgcagtggccattcggggacccaatgcccgcactaattttatctacccattcgagctgcactccataccaccgcaacccagtcctgccaaggtaagggtttcaaggtgggaatcagaggcctcttccccatcctgcagctaatccacctgatggcaagacaatttaaaaggctttcctgtacgtggttgaccagtcttctcttcctcgtcaccccttcccctctcaacgaattcattcccccccttagagtgccgaagtgaagcgtgctacgagtgaacctgctgccaggacacccggcgcgagctcatcccacccccagccagtcgtcctgggagcggcaccctttggtgtcgagctgatgggcagctcccttcccttcctctttacacagcaccctgcgatacagtcctatccacagcagcatcaacccgtggctgcctggaaccagccagcagtgcctgcacatcagctgctatcctccctgccgcaagtgcttgggacaagccttcatgtggccgccccgaccctcaagcctgcaatccctgcaaccttggcccctcactcggtggggctgcaccgaggagcacagggctctgcgcatgtcatctgttgcagggactgggaagcccctgcctcccggcgatgcaccgggcttaaagaccgaatgccgtcagcaacactcaggcacatccaccttgcacccatgtcacgcagggtgcagtggcgctgcccacccctccagcacccaggcccgcatctttcacgagtcccactgcacacttcacgaacgaggatgtcctcttgattggaaccgacttggtgaggtggcctcgaggctcgggaaattcctggccaaaatgctctcttcaagtctacatgagcacctgttcataaatcttcccagacattgagatctccactttctctgcagagtttccttttacccaagtccgagcagtgtctggcttccaagattcctccgtgtgtattgatgctacgatgtttggggggcattctgtgatgcctgtatcatggagtgaacctctggggaaggccgttgcacgcttgctctcgggcagctcatgtgggttgctcatgggctcagccatgctcccacacgatcccacatccagaggcttcctgagtggacaggaagattgccctcagcgagcacaaatcccatccgtccaatccgagaattgctttacacctggttggtctggagctggcagtgtcagcatccaggaagcccagaccagtgttcttgcatgcatgccccagcagtcgagcagactgagttcagagcagagcgagttttcatccttggccatcagagatccgggatcacaggtacatgttggtggccggggggggacctgctactgaggcttgaggaaacccggaatttccttttcctggttgtcagtgtgctgcaccatgccattgcaaaacttgaagctcctggccgcatgcacttccattgccacagcagctgctagcggtgactcctgagctacaaaatatcagcgagcaactagactggctgctagcccatccaccgggagagaaggggcagcactaaggtgccacacggatagtggttagatgtggtgcaaggggctgcacagtaaaatttacatgaatatgtccggagcttggcaacacctatggaccaagctaagcatctcaaccccccggcagttttgctggcatggctccccagagccgagtgctgacggaggccactgcatgtggatgcagcaaggcaagtcagatctcgcgcccggagcgtgccggcgtgccacagcgatggaatgcctgtaatcgaatggatgtcacgacgacaatatcgactctgaagcctgtacaaaataaaggaagagtgatgactttcgagcgccctcgcattgcctaagagggcagtgacctgcgggtggggtgcaggtctaacaccacgacctgatctgtactggaccgcagttccaagcacaggccaagtggcaaggcaaaaaaatgtacagcgacaagatagaacgcaaattgcggcccatcttcgatgccgtggagtgtcatcaatacaaggcatgtacgagtccctggacaggctgcatatggcaccaccctcttcacacggttgaggaccatcgacacagcacactgtcctccacatgcaggctggcaacaaactcatcgatgccgccttgaaaaagttgggtcagaatcagatgctgctggccctgaaagcttactcactcttcaagctggagtatttggcagatggtctgcaggtactgagaagaagcgatgcgcgatgcttgctcggagctgatcgacgcagttgcacatgtgggctttctcaatgaaagcgaggctttcagttcaggtcaacctcaccacgatgtgcagatcctggaggacattgtcaaggagggaccagagagcgaccgggtgctgtcgatcatggcatatgcatacaaagacgcagacaggtgctgtcggtggtggaggcatggagctttgttgactccgatttctgggagcctgtccgctgtccctgcagcatatctgtccgagtgcttgcttgagcaggttggagggcaccctgtcggcctacatagcagctgttcgagcacatccaggggacgaggagatgctgaagggattgtttggggcgtatgtcaggtatgcaggtcccctgcaagcttggatgtcatggagacaccaaagccaccactcctcagtggcagtgtgtgtttatggtttgaccagtattggcgatggtggcaagttgcagttgattgggctgggaatttccccgcgaggggcagcagactcaattcagggaatgcacacaccccactcattgatttccagtgcgggcgacttcaccaagcagcaagccactgccctgcagctcatcaagctgagccctgatgctgtgaactacctctggtgggcagctgtgtcagcagccatgcaggccagagcctcaatacagggtgagggagcacactttggtgacaagccgcatcaagtgtccacaatctctcccggcaaactcagccacacacagtgcctcactcatgctcctaaccctatccacactatgtcccatcgcaggccaggcgtcagcgctgcccaccgcaagcctgctcaccttggctgggcggctcatggaccgagccctagacaggaccccaccgggtgcctttacctttgagatgctgctggtggtgctggatgtgctgctggcctctggacagcatgcccgggcggcggcgctgctggagggctcccgggcgcgcaaggcatgcacctccccgactgacctctccttcctctgcgccgccgtggccgctggtgccggggagcaagaggcggcggcccggcgctgccgcgaagtgctcactgtctcccctcatgactgggcggcggcgcgcctctgcctcgactgcctcctggcccagggagggagcggcagaaccctgcgctgccggtggcctgtgtgggtggtgggtggcctgacggatacgctgctggagcgggagcctggcagtcaggaggatcaaacggcgcctgagcccctgggcgaggtgcagaggcgggtgctggcggactggtcagacgagtggggctccaatctcccgccttctgattgtagcgggagtgcaagcccaggtccacttcttcgtgccactcatttggcccttttggatggcttagcgcggggtctcacagcgagacatgcggagcaggtcagcacggaaccttccgggccggctgacaaggatttggccaagcaaatttcgtcggccttccgtacgctgagtaccctggggaatgttgtcctggatcttggtccatacttggccatacttgggggtgcagaggcccagtccctcgctgacgaggcaaaggcgattggcgaggagctctgggccaactcttctggagcagggaacacaggtacaaggacaggggcctggggactgatgactgccagagagacttgcgattcagatgagcattatgagcgccatgatggtgcaggcacacaatcacacaacagcatgtttggttagttatcagcctgttcccacagacaagaggacgcaggaagcaggactccaggcgctcagcaacggctaccaggtggggtgtggaatgttggggcctaccctgcgtggaagacaccgaaaagatgtggtcttacaggagaggcatcaatgttgcaatgctagtgcagactcgtatcatgctagcttacccactgaaatcatcaactgaacggcataacaaacaagaaacaaaatgagcatccatcgtccaagtcatgtcatgcctctcattgcacaggtggagtttgagctgggcctaccaaggcacacaagcggggaccaagctcgaggcgctgctgccgctctcttgaccacatatgccgcagctctgcccctttcaggtgagccagagtggaacggtggctgctcctgtgccatgtgcaagctccagtgaccagaatggtgtcgcattgtcagcctgttctgggtggccatgcccaggtcagctacggccatcagacctcaagccatccccacgctgcagctgggctggacgccaagcaaaggggtcacggtgaggacctaataaccctcgcagtgacgcgcctgctccagggtcatgcgctgggcctgcatggcctgctgccgagcgccctcttcgtgttggaggcggcgcagacgacgcgcacctcatcggcacccctccggctccacgctgccgcgttgtatgccctgcttgggtgcccaagggcagctgccatgcagctggaggctctgggcgtgaagcagattttgcatgacagtatgactgcgcactggctcctgccagccctgctcgacacgggagccactgcagcagctggagagtcgctggacatgtgggtccggcttggctgtgggactgcacttgccctcgtcttattccttctgtcgcctgttgggcggaagtgtgcaaaggtatgccgggtgtcggtgagccttcgctgctccctgtcctggagtgcaggtttctgaaggccgtgctcctcctgcatgatgggcaccggaaggactcaggcgagacactgattgctgcattccagcacgggtcgtactccaaggtcggtggctggaagcgtcctgagtctcactctgtcatatgcagcaggaaatgcacagatgctggcaatggctgcctcgtaccacacatgccagtctcgcaccaacgcgtactctggccttgatactgctgagcctctggtccttcttatgcgttgcttgttccctcaacacatcccagcagccctacccttgcaggtcgccgagtttgtgagtttcaaagagaggcttgcagcctcccatgccctccatgtggtgcgagcagaggaagctatccggaagctgaggctcctggcctcctcccctgtatcaccccacaccctcgtcaaggcggcacgacatctcgaggtgggtggcttgcccccggcacggctactgactggtgggctgtgccaccgtccctgcctgccctgcatcaatggctttttggccccccgcaaattacaccgctgcatctcaaatgcccgcaggagcaggcacctcccctgccgacatgcatcagcttcaacgaggacctgggcacacggccagcctggttcccgcccggtgcgacctccgcctccgaacttgggccggcactggctttgcgaccctgtgggctgtggtggcgagcgccatcggctgcctccagggccacctgtgccgaggctcaggcctggcggagcgcccagagggccaagctagagtggcgaaggggcctgccacgtatgctggcggctgctctggatggagcaggcccagatgcaggctcagaggatgcagagggcgacagcggtctgcgtgcggacccagccggaaacgggaatggcaaatacgcccatggcatctgggaggtgctgatgcccgctgccagagcctgctgggcagccctgcgctgcgaagcgggcaccgaggctcccaagtgcactgcggctcccccggcctgtgctgcactgagcgccgtgatctcctggctccaggtgcgattcagtgcctggtctgaccgcctggaggtcgcgcagcagggtcttgtcaatgacccgctcctgcacctatctctggcgatctctggcggtcacgcccggtttgtggcggaggaggccctctgggcagcccacgccctcaaggtacggattaaggggactgcaccctttcttgcagtaactgcaacgcagcgatttgattgcaacagtacccatcaaggttgcattcattgcagtgcattgtactgagaagtagtgagctgctgagccggagtgccaagcccatcgtgtgtctatccctgccgcctaatatagtgtgcaagttgctgctcatcacccactgctgacctgccaccttcaaccctcgctgccattgcaggcgtggctagctgcggcggggggggggccagggggggggggggggggggaggtgatattggcttggtgggaaggaaggtatacatcttgagggacagctgtgtttcttagacgacgggggatgtgtggtagtccaatcggccttgggggacatgatcatggccccattcctgaaggatcacaccatgatctatcccgcattccaatcgacctgacaccatcacgccccacagcctctttcccaagtttccagctcctcatccctgcccccgcgcgcgcccctctccctttttaggaaagaacacacccacacctgctcatgccggcannnnnnnnnncggagcacaaggggcgagcgatgggaacttagacatgtgtgctgacatccagcgtgccctctcctgcctacgtgagggtttggggtccctgagggaggtgctggaggcgttgagcctggctgcagcccagctgccggatgcctatgatctggcgggggcagatgccaagctctggggctttgcacctgggtatgatgctcgactggtgcatgacactacggtggcggagcagcggcaagggctcgagcagctgcaggctcaggccgcgagcgtactgcgcatcctcgactgactcgcagggggtggtgttgtgtaaggcggaatgcaatttcaggtgcagcacatgggctgcagggcaggacaaattgtcgagtcgggaatcagccgagggagtgctagggagagggttagtgaggcatgaagcttggtctgtgcaatcgcggcatggccgtgcatgccaagcagcctctggagtatgtcgcgagggagttggctggtccagctcgaagccctgtgattctgcagcgcagcagagggcatgctcctcattcgcgctggcaagaccggaccccgcggcctcactcgtgcagcttcgccccccgcacccgcctgtgcgtcatggtgagcagcgccagcagggcggacagcggctgggtgacggccaccttcccgcaggccacgcccacggccagccggtcggcgtagggctgcaccatgcgccgagtggcggggtccagacccagcacggccagcaccacgccggcatcgaagcgggcctggcgcaccaggatagacctgaagggggggggggcccaggctgctgagacatacatttgctggaaaggaggaggcatgttttgctcagggttccaccagggtcgctgggtcagcaggccaagtcagagcatcggatgcaggcaccgaatggtgagtccatgagctatgcagggcgcggcagcgcggccccaacaccttccccaccatctccacgacgtctcagcccacctctggaacatgatgggcgtcatgtggccgtccagcacctccctgcaggccgccacgccctgcaccgcagcctgccaggccagggggtagcccgggcgggtagtgaggactacgttggcgacgtcctccaccagccggggcgacgacgccaggcgcgaccgtgcagactcctccccgccctccaccagtcggcgcaggacctgtccacggcagtcgggcgaacggaccaggggggtgagccgatgcaggaagggcatgcgagactggattctggcagtagaggcagcgtccggtctcgtgcaccagtgcgccggccgacccattccgttcgccggcgaacgtcatcatgcagaccagccccgcccatcgcaggcagcagtcactccactgcaccccatcatccacatcaagctcgagctcggatcgacgcaccatgacggctgaagagactgcctgcgcttggtgcgtcatggcgaggtagtctggcgcggtggcgattgcagcggcgcggcggggacccaaggcctccaccgacccgccctccctgccctcgcccagttcgtgcagcaagcctgggtccatctgggtggtgaggtactctgaggccagactcctgtgcagagatgaatgtgtgtttgttggggggggtcagggtggagcagagggaaccgctgccagatgcatacaggggagttcctgctgaggggggtctggtgggagtcgagctctttgcatgcccagtgacccttccggctggtagtgcaaggcccctgcatgccgggcctcctgcctctacttgcccaaggcccccattacatcccagagtcctggaaatacaaacatggggacattccaatggccccccacgccctcccgcacacacaccgtagctcggagtagggcagagtgacgaggaggtgcaggacctccaggagatccccctcctcccagcacaccgcgcgcgtggcggcagccatgggtgagttgggcggggcggccaggagcagggcggcgacggcctcccccgcaaagaccgccagcagcgccccgccggagacggcgccggggcgcatgagtctcaggcaggcacgcaggacctcgggctggccggccgcgacgtacgccgccagcgctggcacggtgcgcagcagggtgcttcccacgtggcacagcgccgccggccccgggtcgtgtccggggacgggcgtccggggggcccgcgccgcagcggcgggccaggcagagggcgccgcggtatgcaccgcccagagcacgcgggccaggagggggaggcagccggcctccaccgcagccgtggccgctgccgcgccgcccgcggtgacggcggtgcgcaggatggcggcagcggtctgcgccgcctccagtgcctgcatctgccgctggaggtcgccggatgaggggtagaggtcgtagggacaggactgggggtccgtggtcgcggctcgcaggccattgtgtagcacctggggtggtaggaggagggtggtgagggctggtgggcgggggtgcagcagagggacaggtacccgcacccagcaaagggccatgatacagtgcagcactcacctccagcagggctgccgtcagccccggccagacgtgcatttggaagccgggctgcgccgagatgtgcgccaggatggacagtgcccgactctgaaactctgggacatggctgtgcacatcggccacgagtgcccccacctgcgttccggaacgatttggcaacaggctttgtggtagcaattctcgctggacaggaccggtagcgcgcgagggcatggcatgctgggtgctttaagtgcctggcgcatacctgtgcgctcgtgggaggctcggaagtttcagatgacacccggtcggtgctgataacacttccaaaggcgcccgatgctggggacttggaggacatccaatcagcacgccaaagcttgcagcgctcttgtcacaggttgcgaggctcggtgctgcatcgcacgttggtggaggtccgtggtgtcgaggacaggcaaggtcgctaggacaggaccagactcgagaatcagttttccgcagaaattgaagctttacgttgagtgctcaagctcttcggttgcaaaattgtgctcgatggaaggcgggacaaaatgcgcaattacatgcaggtgaaagttcaatacgacgatctgggagtgtgagtgggtccacaatgctcccgagtagcacatgcaatttttagctcttcacctccccgtcaattctgttttcttccgctttttccaaatgggatgctgttggcagtgagaacagcgttattgatgttcggtttatggatcttattatctgacactgctgtgcgtgcactgctgtattgcagccacctgcggcatttgcatgcagaattcgatcaaacatttctttctatcgggccagtagagaatggtggaccattgcaagcttggaatctacagcgctcatcctggccaagcaggtttctgtctcggcatcaggcatcgagcgcgggtcgccgacaagggcctccggaaccggtcgagatcagggcgtaatcaggcaaagccaaacaacccaacagcttgtatttgttgattggttctgtagtcgggaggttgcccttagctcgagccgcggacctcgcaatggaccagagcacccggcgacgtgtcaggcacttgacggaactcctctcacccgcatctcatcccctggggttcgatgaaccggtgagagccgtcaagtgttcatcccggcgaagctcccgagtctgcgtgctgggagctggcgtggtggggctgaccacggccctcagactcctcgagcgattccctgggctcaacgtcgtcgttgtggccgacaagtatggtaccgaaactctgagcgatggagccgggggtctttggatgcccttcgcccttagtgagtagagagaacccctgtggaagtgagtctggccagcggcagtccagagtgaggatgcacagctcggggtcatagccctgccctcacccagtaggcttgcataagacgttttcatatcggcattggctgcatcaagctacgcccgtcaccccacgcaggtggcggccaggtggatctggtggccaaatggggagctgccacatttcagcactacatggatctgtatcgcaccaagcacgctgccgacgcaggcgagcggtcatgggagaagggacggtgagaagcatttacttgcgaggcgtacaagccgtcttctgctaaatttgctgagactgaatgcccagatccacatgaagcactccatcttcctcctgcccccttccacccactccctcaggtgtcatgctgactggtgggtatgacctctcgtcggtacccctcccagaggagaagcctttctgggccgacatcttgcttgccttcagacggctggaaagcagtgagctggccgccttcgatccaagcggtacatccgtcgatggctacggattcaccacaattgtgacgtgaggcggccaattatgggaaaggaagctccacttcaagcggcatgcccttgcaagctgagggggagtgcagacctcctcatgccttgaatttgcagggaggccagcgactctgcccctttccaccgagcagggaggggcgactttacctggtctggttgatgaagcagattgagcagctgggcggcaggcacgagcgccgtcatgtcagcagcttggatgagctggccgattacgatgccgtggtcaactgcacaggtgcgcacgtggtcgggttgcatgagccagcacggggggcgcagccctcccctgctcccgggacaggcacgccgacgccgttttgcatcatcagccgagagcctctgtgaggcaggcccacattcctcaccccatcgccaccaccactcctgcttgcgctgcaggcttgatggccccaaagctggtggacggcgaggagatgtaccccatccggggccatgtcatccgagtgcgggccccctgggtccggcagtacacgaacaaggacaaggacatctacatcatccccaacaccggtgaggctcgtgggcctcatgccaccctggcccccgccgccagcagcggcatgcggttggtgaagggggccgcatcgcctggctcggcttctaacccccctcccccgccgcccccacccatgcctgcagacacggtggtcttaggaggcacgatccagaagggggactgggacactgtcccacggcccgaggagcgcaccaggatccttgagcggtgctactccatcctgcccagcctcaggcgggcgcccatcgtgcgcgagtgggtgggcctccgccccggccgcgccgccatccggctcgaactggagcgccgcgcgctcccggcgaccgccgcgcggcggggcaccctccctgtcgtccacaactacgggcatggcgggtcggggctgacccttgcctggggttgcgccgccgacgcagtgcaactcgtgcaggcggcgctccagctctgattctttgccacactgtgtctgtgctggtcgacctcagatccccttgatcggccgccccctgaatgtatgtcgcaatgctggagtgcaaggaagtgggggtacaggcaactgcattgcaaggttcacctcaggtgcagacaccgtcgagcgcaaaggctgcctgcgtccagccgggccgggccgacccctgggccgcccacagctctaggaagcgatccttggcgccaggcagcagcgtctcaatcgtgtcgtacactgcctggggcaccgcatggcagggtgatcctggcacgggggaggggtgggcgagaggttggctgcggtgctcatcagtctgctctgacaatgaagacatggcattgtccacagagccgaggcctctgcccactaccctcccacccacctgcgatgggcaagcagcagtcgaacagcacgtccgggttgcgctggtggcgcagctccatctcgcgtccgcggtctgtgggcgcaaagatgggagcttggcgaatgaggctgcgggcaaatcttgtcctgtggagcccagagctacccacagcaggaatgtgcgatgttgcaagacctgacgtccaaccttatacgagatgagtaaacgggatgtttgcagtccgatccacttggcccatgtacttttccccagccaatcaatcagaacaccccccccaagcaccccgcaacaaccccatcagtacctgcccatcgaaacatgtacagagttaggtgggaggaggcaaagaagggcgactcctcccgagatacagtatgatttggggaaaggtaaacccacgtcaggttttcgatatacatgaagccccagctcaccatctgcgcaagtaggtggggtggaggatgcacttgtcaaagcgaagctgtattatatcaatgctcctgcgttctggcattacgcatgcctctacgcacattgtaaccaagtgtggatcaggaacggctttgcacctcttggcgagagggactgaatgacccaacctcccctccacatagttttggatggctgatgcctatgcacctgttgacagacagattgaatgtactgttttgggatgaacatgaagaccattcccgcgggtacaaggtctggcagtgggagcgtcgcaaacctctgcgcatgttgtgaggattggacgttgagcagtgcgtgcggcagcacggcctcaacttggtgggggattgtgcactctagccttctgccttgtctcaggcaccggctggtgcatggcctccctgtgctcaccttgaggccagccccatcgtccccactctctacccacccagggttgatcagcacagcctgcacgacaggataccaggggatggcgtggagccatgcttacacgtcccgtgaagagcacgattggcagtgttcctcgctaccgtccagagttatgaaaactgacatgagactacaagctggtttctctcatgcctcacctcatatgtggctgctgcggccttgcatttcagccaggactcgtaggagactggaggacagcgcttctcctgcccatccactgacgaccctacaatctcagcatcagcagaagggtcaactgcaacccaaataccccgtgagctaatcccttcggcccccacaacactgtgctgcgggaatgtcctccgcaccattcacgcacctgggctgtatggcctcactgttcttccccaggagaggggcagtggggctgccgggatgcgcatggtgacgacctcgtttttgtcgcagaccctgactttcctcctcacaagggcctgatggaggaggaatcggcaggggcaggacatggggccggagcgacatgaacatctgtcgagacagcccacagctgcttgtgtcttgttcatcacgacaaagccttgcggggcactgcaaaagtgggacaacgacccacctgagagaatgggttgcaagacgtcactagtctgtgtcgggattgtgaggatgggcgtgctcctgtggtgcctccaggcattcgctgcctgtgtcagacatttgattgtattggaaggacggagaaacagaggaacaaaactaagggacagaggccagattctgaggtcatgcagaaccctgccgctgcgggaaaagacacctcgctcaaggcgttccctacccacctgggttctgtggaagaccgcttcaccgcatctttcccgttttctgtgatgaggccggaaggggagctaagtgggatgcggccaggctgctgtacctcaaatttgttattcggaagcggagctttcatgtgggttgctgagcatatctgcaaggcaagctataagccgtcgccatttcataccacttcatgcattaccaaggggtcaaactctgctttgagcacctcatcactcaccagttgcagaccagaatgtttggatccagtcctcatcatctgatacttcctcgtcagatccatacctgtgcatccaaaggagggtgatgatggtctcaccgatgagacatggcctctccaggatgtctgtacaggcagtgcaaagtctgggagcacgaagcatgaaacgggaggttctcctcacctatccgcatattgacagagaaggtcatctatgctgagaagggcctcgttgtcagccagggcggtcttgacattgaatatggatgtctgcaaagggtttcacgtggttttgtagtgggagcactggagggagtcttctcaccatgctccctccaccagccagaccatgctttgattgcccaaggaggccatctgctctccaaaatgatccacaaccacggagcagttttcacacacctgtttgaaaacttccaagagctgtgcatctgtcaaacacccgtctcggctcctctcctccactgcagcaaggatctccaggccgacagtattcacatcccctgccttcccctcctccccagggctgtgtgagctggcctgtatacgatccagggcctcgaacttggccatgatcatctccggagtctcatcatcctcgacctggccgcgttggggttgtggggttggggtgctcggaattgatggagggcatggccagtacttcgcctgacactgcaaggcgcacgagcgtcgccgcactcacataaccgacgtagtggaccgccgatggctgacccgatgcttgattcccacggcgggtgcaccgtctcttgctgcgggcgtccgccacgtcctcttccatgatcgacaccccactgtccaagcagtggattctgttcaggggctaatttggaggacagcggggatccgagggcgttcagcaacgctaactacgatatgtacagaacatgcatgccgtatcgggggtgtagatcgccgttttgcgattcataccaactcccagctgcccccaaaacaaactttgaagcccgctgagggaaaatgtcgacgtggcggtcgcgctccgggaggtggtgatcagcgcggatgcgacacccatttgcaggtcgtgctccatattcgatcgaactgaagggatgagatgcaagtcgtactttcgttgcggcgagttatagagcatcgccgcagcttttagtgaggggcctctgtacagtgtgcacctggcccagaggcttcctgactatgtcccatgagctacggcaagtgccttctaccttcgcaccgtagcataacaccgagacccgccgatgttgtcatgctgagatcattgcctgggaggatgatgtccacagacagcgtcggcctggctaaagccgcgctgcgcagggatgtcctccagcgcctgaagggcatgtcagtgcaagacatgcagtctgagagtgagtcgggggtgcgggagtggcgtggcattgttgagtcgcgaccatcgagtctaggaatcccactacccagtttgtgctttcttgcaaggtgctgcaattggcgagcaggtgggaagctgtacgctcttcaaaactgcccagtctgtcgcggtctatgttgactgtgaacggctgagggaggtgcagactgagagcatcgtcactgcagcgctgaagagttgcgccaggtgacatctgggtactgggcattgtctgttgtttctctgaggggaaccagcacctggaagtcatcatcaaagcgcggctgagactctcccaaatcaagggccaagcaacccagcccagcctttcataccaatgcgtggtagggtgtatgtaccacgcgtgctggaccgagacagcaacatgcattttctgaggctgcaaggcttggaggagctggtgcaggttccaccttttggcatccgcgagccccctctgacggatgcggctggcgccccacggtccgacgctctccagagccctgaccccctgcagcttgtgagcatgcacagagggagattgcaagctggcggtggtgttgacagcaggcttgacctcacccctggtcgatggacacatgcttcaggggtcctgcagagtagtatttcgagtggaaagtccccactccaccggcatcgacctcaggctcttccctacgtctcgccccgcgactcgtagattatcatgccgggcctggcctttgacgagtccggccgccggctgggcagaggtggggggtactatgacaagttcatcacctccatccgccaggtgggctcgtgtggactggttgaccgagggatgtaattttacaaaccagacggctgtatgtatatcaccaaggcagcacacgttcgtgctccatgggtgtactttatgactttcatcattcattgtcgactgatggtgtgggaattgacttgcccatctttggtgtttcacacgatacccctgtccagagatctctggaaaggagctggaagactcctctccttgtggcactggccttcaatgcacaaatggtggacagcatccccgtcggtcaccatgacgtcccagtggacgtcattgtcacaccccgtggccccatcctgtgcactcgccgtggagaagaggaatggccctaaaataatgtggattgaactcctgcagatcaataccactgtgccccacgggttctcgtcaggtcggttcaagcacggttatgaatcctgaagtagaggcatctcgctgctgctgcaagcacacagcctgcaatgctgtgggaaggtggcatgactggtgccgcccccacaccagcatgttccgcgaacacatgctgcccgtctccgacctggccattgtcgcagacctagcgtcattcgatgtgcggctgtgcgtcaagcagcctcctgatctaatttccttccatactgatcggaagtcaccgggcatgagaccttgctgtcgctgcagatctgttcggagtttttcacgacgtgtgtcggctccacgaacaacctactttcatgccgcccgatactctgcaggcctcctccacgccggctcggcatcgcggaatgagacttcagtacctcaaagtcatgatcatgggcaccatgacatgggaaatggccgtttgcacacacgtggtgcatttgctttcaaacacgggcagctgtggttcccgttccgacaccacccgtagctcgaggcaaaccgaccggggttaaaagcagctcgactgcactgcggacatcccaagtccgcccttcccacgttccactgaattccactccaacgttaagttcagatcgcctcgactctggttggagaccttcgtcatggatcgcacgatgaagttcaccctggcggtggtggcgctcctcctctgcacatgttcagctcgaacattgaagcagggcgacgaggaggccccccctcccggagccgcgtttgcacgtctcgtctgggtggtacgtgcattgatgctcggccttcctgcatgctgagcaccgcggtgtgaccccgagctgggagggagggctgcctgccgccataacgcacccccctctccccctccggcaggcgaccggcattccgtcctgccgtctggaccccaagttcttcagcatcgacctcgacaagtgtcagggtctcagtgagctggctgagaaggtggccaagaaccagacggtggacgaggtggtgtgcgagcccgagtgcgccaacgagtacaagaaggtgggcagaggacgggggtgggctgggtcggaggtctttgtcaaggttacctggacactaaaatccaggcccacttcgtcgggcccaattgttccttggaattctgttcaggaaggcgatcgtatccccgcaaccaggcaacccagaaagcagcctgtcatatgcggtacagaatcctctaacccacaccaaagcctccgataagccgtcccatcccgggcacctgcccctcgaccccctctcacccccctcccttcacaattctccctccagctgaacagccagtgcgcacgcgacctgttcgacaccttctcccgcgacacggtggactttgccaacgccaccctcctgtactggggtgcctgcgccgcccagagcgtggccacctccctgggctacccccccgagcccacctcggtgctcacccccgaaaagcaggctgcggtcgagaagctgctgggcctcaagtccgcacccgtcccggcacccgcccccgagcccgccaagactgccgacatgacggccgagcaggccctggaggcagcacaggccgccctcacagccgcagccgcagccgtcagctccgcctcggcggcgaccaccgccgtggaagccgtcagggccgccaacggcccgtgaattccgtgtgctgtgtggcggggcctggcaagccgaaagggttggccacgcccagcacggcgatgcgaggagctaggctccttgtgggcacccactccaaccacccctcttcatcatgtccccgctccccccgaccctgatttcattacgtccccccccccccccccccccccccccc

SEQ ID NO: 32930 - DNA, 71 bp, Chlorella protothecoides
gctggcctgcaccgcgcgcgtggccgcccatgacgctcggatgggcctgccggaggtgcggctgggcctgt

SEQ ID NO: 32931 - DNA, 75 bp, Chlorella protothecoides
ggcggccgtggccaggagacttgcctggtggatcctggtacgatggcgcaggtaggtctggctggggagcaggac

SEQ ID NO: 32932 - DNA, 61 bp, Chlorella protothecoides
ggttggtgggggagagttcaggggcgtgggtccagacactcatggctggaacccccgaacg

SEQ ID NO: 32933 - DNA, 81 bp, Chlorella protothecoides
gggcgagcaggctgcctccttggatgccagaatggtgcccggtgaggcattgtctgaggcttcttccaagcatgcagcaca

SEQ ID NO: 32934 - DNA, 113 bp, Chlorella protothecoides
tggctaccacctaacaattctcacgcagttctatccttctgcactttgatgccggccttttgattcgtctgcgtacataacatcgttgagtggccagcaggaaggagaccgcg

SEQ ID NO: 32935 - DNA, 70 bp, Chlorella protothecoides
aagttacgggccttcctgagcccccgagcgctatttgcctggtggggctaggcgccataagaagtgatca

SEQ ID NO: 32936 - DNA, 80 bp, Chlorella protothecoides
gggggagagcgggtcctgtgtggcagcagcagcgtggagctctcgaaccctgcccactcctgagagggcctgatgctggg

SEQ ID NO: 32937 - DNA, 451 bp, Chlorella protothecoides
  modified_base (83)..(281): a, c, t, g, unknown or other
tcctcagtcgtccagtggcactcccagggtatcccccggctgccgggcttgtaacacaaggacctggacgtctgaggccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgccagcggctgcagggtggaaacatcagtgcgtcagggtcacctcacgagggtaaaagagtgaggtgtgggtggcacattccacgcccacggttccctgcagtcacatgctccccagatgcttttcgtcaggccgggtgctgtgcctaggcagctctccccgccgcc

SEQ ID NO: 32938 - DNA, 61 bp, Chlorella protothecoides
gctgagatgtctgtgcacagtggacgaggttgtgacctctcacctgctcaaggggtagctg

SEQ ID NO: 32939 - DNA, 61 bp, Chlorella protothecoides
tgggcgcccagtgtctcgctgcgcctcgtcgcgtgatcagtcaatcgcggcgctagacggg

SEQ ID NO: 32940 - DNA, 61 bp, Chlorella protothecoides
gagtctctgccggccatcaacccggccttttgcaaccccagcatcgttgcctcggtgcgag

SEQ ID NO: 32941 - DNA, 66 bp, Chlorella protothecoides
gcaaccccagcatcgttgcctcggtgcgaggagctgcgctgcgcaaggcagggataagtttggccg

SEQ ID NO: 32942 - DNA, 67 bp, Chlorella protothecoides
aggggagccgcgtgcgctgcccgccagggggaagatcgtggtgatgacggagggcaggctgccgatg

SEQ ID NO: 32943 - DNA, 188 bp, Chlorella protothecoides
cgtcgcggcggtgggtgcttggtggggtgggtgccgggcgtgcttgattttgctgcatctctggagttgcaggtgggaggtgggagggatttgatgtctgaagccctgtaaggtcccaccaccctggatcccccgtgtcccttcaccgccgcagctgctgaaagaccgggatggggccacccgcacgg

SEQ ID NO: 32944 - DNA, 107 bp, Chlorella protothecoides
aggccatgtacatcatcatgaatctgggtgggcgccggcgtggcgtgacatgggtgccagcctctgtgctgtggcacggaggcaccgggctctgtgtctgggcctct

SEQ ID NO: 32945 - DNA, 240 bp, Chlorella protothecoides
atagactgctgccaccatttgctgcccatcctgagtgcttctgcctgcacgcctgcagaaggtgtggtcctgcagcccacacacctaccacctccccccatccacccaccatgcagtggtcagcctgattgccgaagaggccaacgtgaccgtcagcaccagtgacatcaggaacactgcacagagcctggtgaccgagctcggcgaggtaggcaactctatcagcagcgtcacgtcctt

SEQ ID NO: 32946 - DNA, 61 bp, Chlorella protothecoides
ttcaagttcacaccaggtacctctcgctgcattgttctggggaggggaaggaactcggtgg

SEQ ID NO: 32947 - DNA, 62 bp, Chlorella protothecoides
tgtatcgtcttctcccgccctcccaccccctttggttcgccattagaggcaaccaactgcgc

SEQ ID NO: 32948 - DNA, 61 bp, Chlorella protothecoides
agacggaggcggcgcccctacccatccccgtgcaaggttcccatgctgaggctgccccatc

SEQ ID NO: 32949 - DNA, 61 bp, Chlorella protothecoides
cgtcttcgcctgccgcgccggcaccgtgcatgaggaggccatgctggccatgggggcgctg

SEQ ID NO: 32950 - DNA, 61 bp, Chlorella protothecoides
atgagcaatgctggtgtcctgataaggtagtatcgatgcgcctttcccccctcgtttgccc

SEQ ID NO: 32951 - DNA, 61 bp, Chlorella protothecoides
tgcttgctctctctaatcctcccacctcttttttccggatgtgatgcacctcccggaaagg

SEQ ID NO: 32952 - DNA, 88 bp, Chlorella protothecoides
gggccctgaatcacagtcccggcctgtgacgagggtccggagggcctcctcctgaaagaacattcactcaaaatgccccacttgtagc

SEQ ID NO: 32953 - DNA, 67 bp, Chlorella protothecoides
ccatgaacacgtatcacacaaccttgccacccaccaggcgtttgccgagccccatggtcgtgccgcc

SEQ ID NO: 32954 - DNA, 78 bp, Chlorella protothecoides
tgggctgatactgcactgggcaccacctgcggtggatgcgggccaataccaaggtcaaaccacatggccttcagcacc

SEQ ID NO: 32955 - DNA, 4741 bp, Chlorella protothecoides
  modified_base (235)..(244): a, c, t, g, unknown or other
  modified_base (517)..(526): a, c, t, g, unknown or other
  modified_base (1184)..(1303): a, c, t, g, unknown or other
  modified_base (1382)..(1391): a, c, t, g, unknown or other
  modified_base (3711)..(3783): a, c, t, g, unknown or other
ggagccggtgcgcaggcaggccgcccgtgcgcgcggccactcggccgccaccagctcagccagcgcgtcgccccaggggccgtgcgccgcgtcgtgcagcgccacgcgcgccgtgcgcagcgcagcatccagcaggtcctgctggtgcggcgtcagcgccgcgcctggcggggcgggaggagtttcggggtcgggctggttgttgctgaggttgtgatggtatcgacaggagtgnnnnnnnnnngccggggtcgggctggtcgtcgctgaggttgtgatggtatcgacaggagtgcacatgggatggcctcgtacttcgccttgaggcatgcccaattcttcatcatgtcacgggtgctgtcatatccagaccaaccttcacgcagcacagccccagcagatccatcagaaccaatcccatcctccgagcacatgccaccctccgctccacctcggattcccccaccctaacccacactcctacctgagtcgctgtcggagaggagctggggcaggnnnnnnnnnntgccttgaggcatgcccgatgcttcatcatggcacgggtgctgtcacatccagaccaaccttcacgcagcacagccgcagccgatccatcacgaccaatcccatcctccgagcgcatgccaccctccgctccacctcagagtcccccaccctaacccacactcctacccgagtcgctgtcggagaggagctggggcaggagccaggaaagcgtggccagggccagtggcggcgtgctggcatggcccagctgactcagcagcgcttccacaacctcggcctgcgccgcatccccctttgccgagtccgtgagaggggggaggggcaggggggaggccgacgggcgggccatcctctgcgcatggcccgcccccgagccggctgcggcggactgcgccgactcgagggacgcctggcggctggctggggcgctgccggactgctgccgggcgggtggcccgccgctgctgctggcgacccggtccaagccggtcgttgacgagtcgcgcgtcagcgccgtcagcagctccagctgccgttttcggcgccgcggcagcaggcctggtggggtggaaacccggatacttagcgtcagccgctcgagttggcctccatcgtcggccgaggccaggcggcaccgatgcctccctgccaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttacaccccaaaagaataatcctcccccacgcaccaatgccctcgagcaggccctcgtccagggtgcgggagcggnnnnnnnnnnccggcgccgcggcagcaggcctggtgaggtggaaaccgggtacttggcgtcagccactcgcgttggcctccatcgttggccgaggacaggcggcaccgatgcctccctgccaactctcgtgcatcattgacccagccttaagagcaagctgaaaaccaggcaccctcacccatccagcgatcccctctcccactctagcaaacaagccagtccaaccgccatgtgccctttacaccccaaaagaagattcctccaccacgcaccaatgccctctagcaggccctcgtccagggtgcgggagcggagcagggcggccagcaggcgcgcggcagccgccgcgagctgtggctcgccgccgtgcagcatgcccagcagggcgccgcggtacgccgcgggctcatactgcagcagcgcccgcaggtgggccggcagcggctgctgctggccgccgaccggcggcgccgaatggtgctgcgccagcgccgcgccgggcgcgcgcgcggcacccagcagcgcccccaccagcgccgacaggaagggggtgtccagcaccgcgaagagcaggcgctcgaggacgtaaagggaggccaggggtccgaccacgcccctctgcagcggcgcgggcggcgcgggacgcgcatgcgctccacccaccccgcccgtcccctgtccctgctgatcttggtccgcctggtgcgccagggtagcgatgtgcgcgaccgccacgtcgtcctggatgaggggccagaagagcaccggccccaccagcaccgaccagaggcggtcgaggagcagggcgctgaggggctccacgcccgtggccaggatgtcgttgcagtaggacagcatgtcctcgatctcggccaggcaggcggccagcgcgccagccgcggcggggctggcggcctccgcggcggccagccgccggtccagctccccgcactgctccgccaggtaggtggccaggctgtccaggtagccggccgcgggcggggcggtgaggtaggcatgcagggcggggagggggatggcgtacacgttcagggtcagggttttgaccgcggcgcggaccatgccgtcgcggtggttgatgaacttcaccgcctcgctgtagagggggagggaggcgggcgtcccgggcccccccgcctggaagaagaactggacagtggcctcgttcagtcgcaggctgatggtcttcagcaggttgatgtagtaccccagcacctcgtcgtcctcgaagtcaaaggccatgcccacgatgtcgttgatgtggttgttgctgaacaggtagtacaccgtctgctgcgtgcgcacgttctgcagcaggatggacagcgtctgcagcacctgctgggccacgccgccgcggcggttggcgcgctgctgcaggatctgggcaaagtgggccagcacgttgttggtcaggaagtagtccaccatggaggggtcgttctggtcacccctgaggtaatgggaggaggggggtttgggggagcaaaggggggcatgggagtgcagggtcgaggtctgtgaaagacacaggcactccacaggcaccagtggcatagggtaacaaccagcatggggacccctcgttctgtcacatccactccaagagctatctcccacaccatcgcaccatatgaccagctcggagatggaccgcagggtctccaccactgtgtcgcggttgccatcgttcaccacggcgttccgcagcaggacggagtgcaggtggctcagctcctcgagggagaagcggtcccggggcggagggctgaacagggagctccagaaccccctgtgctcccccgccatgccaggtgtgaggcacgggcagaggtgcagcacccgagtgccgcaagtgatccccgcactggcgtggctcagtgccggggcatgcgcctcggcgtcatcctgggatcaggctgcactgccctatcattgtgaggtgaacatgaagttctgagatggttgtgcgaggcctcatcgggggttcctattgatggcctagggaagctcgcgcctcacgacggtcggcctgctgccgagtgcctcaagcaggggtcaacttgtcgtgatgcagtcgtgatccctgcacctgaccctgttctgaaaaggtgatgatggtgcatcagctgccttgaactgaagaatgaaatatacaacatgcgatgtacccaatcaggtgaatgtcatacattcagatcacgttcggcgctctccttggccgcctggcctcgtcgccggcgcctccagcgccgcagcgccagcatggccctcggcttccaccacctcctggtggccaggaggaggnnnnnnnnnnnnnnnnnnnnnnnnnnnnnnnnnnnnnnnnnnnnnnnnnnnnnnnnnnnnnnnnnnnnnnnnngctccaggtctaggaaagggttggaggccactgcctcccaccccgacaccaggccctgccaccatgcctggtcgtacatgctggcatcccccaggaaggagcgcgggtacacctgctcgattcgggttgggtgcgctgtcatggtgtgcgtcatcagggtgggttgatctgcatggcactgagtggtggctagtgctgtttcggagttgtccactgggagcagtgaggagtgtcctgaggtacacgcccaccttgcagatgacaccacacctactcgctcccctgccttgggagattcaggcatgcattaccgccccctaccaaaagagtctgcaggcagaagcagccctcaacccctgcacctcgggcaaggccaccaaacactccccgctgcccagcacacctggaagaacacaaacgcgccccaggcgacgctctcccccagctgcacacggactacgaatctgaagaggaggatgccggcgatgctgcagagggtcaggccgttgagtagcctggcgttgtagtccgccaggaagcgggtgtgctccctctcccaggcctttgccaggcgctctgtggggaggggtgggtttgcattatactttgtcgagagcgagggtggactgggcgtcatgaggcggagatcggggaacaggttgtgcatacatcccgactcacacgtcagcctttccctgcactccaccccctccctcacgtgcaaattcacaacacaatccacgcgcctgagtgcgcggtgcgcgcgggcccgacgcaggcccgagcgaacctggccaggcactcctcgtgccggcgccggaagcggcgcgcggcgggcagacgctgccgcgcctccgcctccagcgcgtcctcgcacgcttcctcggcggcgtcgcatgcgcgcgccgaggccgcctcgttggcgtcgccgcgagcgccggcctcgcggtccagctcc

SEQ ID NO: 32956 - DNA, 61 bp, Chlorella protothecoides
gctgtccgattctgtctacatctgccggtcgggctccgcggccgacacgcaaaacatgtcg

SEQ ID NO: 32957 - DNA, 137 bp, Chlorella protothecoides
gaagccgcgctcaaagtcgctgtggattgcccccgccgcctgtggtatcggggaggaatttgtgagtgtggcaggtttgacacgtgggggactgcttcagtgcaatgctgttcagagcacccaggcgggacacacga

SEQ ID NO: 32958 - DNA, 105 bp, Chlorella protothecoides
gcaatatagctgagtttgggcccttccattcctgccgacaacctcctgccctcgttctcgcccggtgcgactacgaagtcgaccgccatggctgaagtgaccgcg

SEQ ID NO: 32959 - DNA, 76 bp, Chlorella protothecoides
gaggccatgcagacggagggcggcgaggcggcgcaggcaggtggcgaggcgggaaagggcggcgaggcggggaagg

SEQ ID NO: 32960 - DNA, 112 bp, Chlorella protothecoides
cagggggggctgaagcgtgtgatgggcaagggtatgtcgcatgctgcaggtcaggcactcagcacagatctgtcgccccttccccccttcccactgcagatcgcgacgtcct

SEQ ID NO: 32961 - DNA, 61 bp, Chlorella protothecoides
cagcactgcgcgggcgcagtggcgtggccagtttccctttacccctagctccagcttggcg

SEQ ID NO: 32962 - DNA, 61 bp, Chlorella protothecoides
actatgcgcgggtattgccgtaacaaacataaaaacgcgcgcgccctgtcactccgaaatg

SEQ ID NO: 32963 - DNA, 61 bp, Chlorella protothecoides
acaagatcacaggcatttgttacgttgatttcgagaacaccgcctgctgtcagctgggtag

SEQ ID NO: 32964 - DNA, 61 bp, Chlorella protothecoides
taggacaggaggctgaacagccgcgcgatgcgccgctgtggcgtcggtttctggggcgggg

SEQ ID NO: 32965 - DNA, 117 bp, Chlorella protothecoides
gttgggaggttgaggtggcggtcaggtgcagaactgaagggtctagcatccatgcattgtgtgctagcctcctgttttgctccagaatccccccttccccactgcggcttgacagag

SEQ ID NO: 32966 - DNA, 61 bp, Chlorella protothecoides
cgacttgcggtcgcccggcaccgcggccgctgggcccagcagcccgcacaccttgatgtcc

SEQ ID NO: 32967 - DNA, 76 bp, Chlorella protothecoides
caggagctcccacctcgtcgggtctgaggagcactcagaggaagaggatggcccatccctgacaggctcagagatc

SEQ ID NO: 32968 - DNA, 116 bp, Chlorella protothecoides
cctgacccgttccaccggcaattatcgaaggacccaccccctctcaaggaggtgggaaactccgaccccgacctcaggttgggcatgccagtcaacaagacacgaatggccctgac

SEQ ID NO: 32969 - DNA, 123 bp, Chlorella protothecoides
gaggatgtgggagcatgcagcgtcgccctgcgctccgtccactgctcccccctcccgtcccctcctccaccaccaccgccaccccaccgcctccaccacacacacctgtgtggacctccaggt

SEQ ID NO: 32970 - DNA, 61 bp, Chlorella protothecoides
cagccaggagaggtggtagcagtgcaggtccacgaagacaaagtcggcggaggcgacgtcg

SEQ ID NO: 32971 - DNA, 95 bp, Chlorella protothecoides
gcgggccttggtgcgcaggctggtgttgatataaaccacgtgcagcgcaggggaggggtgcgcgacggcgcgcgccaggaaggcggagtaggcgg

SEQ ID NO: 32972 - DNA, 61 bp, Chlorella protothecoides
caactttcagcggatgctgaaggactgggatgtatgctataactgtcggattggggcagtc

SEQ ID NO: 32973 - DNA, 61 bp, Chlorella protothecoides
cgcgtctcgtgtgcgatccggttaccctagatttcgtccggaggagatgggatcaggttag

SEQ ID NO: 32974 - DNA, 75 bp, Chlorella protothecoides
gatgtgctatacccatcgtcactgaccggttcacgttcttcaattgacatgtcacaggcgtgctggaagggattg

SEQ ID NO: 32975 - DNA, 100 bp, Chlorella protothecoides
ctcctcactgtgatgattgcatcagcacacagtgcaaacttcacccccacacaaccactaaactgtaacacacccacaaaacacaggcacgcgtctccag

SEQ ID NO: 32976 - DNA, 63 bp, Chlorella protothecoides
tgtggggaatgggacagggaggggccgggcttgagaatcctggggatggtatgtgcaggcatc

SEQ ID NO: 32977 - DNA, 111 bp, Chlorella protothecoides
cattctacaggtgtgcgaggatcagtgtgtcgttgttctcgtgttcctgggaacacacgccggcggctcggtggggcgcctcgcaggggcagggggcatgctgcccagggg

SEQ ID NO: 32978 - DNA, 63 bp, Chlorella protothecoides
tctaagcagcgctatgccgtgctccaaccgagcccgccgcaggaaacggcttacgatgcctgg

SEQ ID NO: 32979 - DNA, 2589 bp, Chlorella protothecoides
  modified_base (237)..(246): a, c, t, g, unknown or other
  modified_base (774)..(783): a, c, t, g, unknown or other
  modified_base (945)..(954): a, c, t, g, unknown or other
  modified_base (1350)..(1359): a, c, t, g, unknown or other
  modified_base (2087)..(2096): a, c, t, g, unknown or other
gatggagggcgaggcggcgtaggtgccctcatccttcaccgagaataccgccacccccttctccgacagccggtcatgggggaagaagcgacgctggcccttcctctgcttgggtgggagggagagtgagtggaggtgtgggtcccgggggatgaaacatagcgtgctgggcgggggggatacaacacccgggagaagggggcggcaggtcaggggtctccacctcagtctccaccnnnnnnnnnncccgccccctttctcccgggtgttgaatcccccccgcccagcacgccatgtttcatccccccggacccacacctccacccactccccctcccacccaaacagaggaagggccagcgtcgcttcttcccccatgaccggctgtcagagaagggggtggcggtgttctcggtgcaggacgagggcacctacgccgcctcgccctccatcacccgcctggactcggggcgcctcctctcggtgctggagcggtccatctcctggggcaccaacgaggatgtggccaccaagctggtcttcgcctccgacaacggagggctgacctgggcgcaggtgggcaccatccaccccatgaactggccgcaggtgagggggaatggctggagggtggggccggggggtcgtttacgagtccacaaccggggttcgttggggaagggctgtacctgggggccgggcggcgatggtgacggtggggtaaggagtccctgtccggatgggacggcagtgcactccttgctggtttctggnnnnnnnnnnaggaattgctggagggtggggccggggagtcgtttacgagtccacaaccggggttcgctggggaaggggtgtacctgggggccaggcggcggtggtgacggaggggtaaggaggccctgtccaaatgggacgacggcagtgcactccttgctggtttctggnnnnnnnnnnattatttgagagtccctgggtgcccgattcaaggttctagtacaaggcatcagccatgcagggccccagcgcgcccaaaacttgccagctctgactggatgtcgccggccatgctctcaaaggtggtctgcgacttggagagagaaaccacgctgctatcgatgttttcccgaagctccttcacctgatgagtgggaccaaaggggtgtggggagcaaggagttgagcaggtatcatgcaatccccaagatgttgatgggaacggggaatgtcgcgggggatggcggacagccagcaagagtccaatggagggactgtcctctgcagcacccgacccagcgatgacggacaaatacaagattggcacgcacgatgcccgactcccaggcccaaacnnnnnnnnnnacgggggatggcggacagccagcaagggtccaatggaggactgtcctccgcggcacccgacccagcgatgaccgccaaatacaagattggaacgcacgatgcccgactcccaggcccaaacacaagtgacgtcccccccagcagctcaccacagcctgcatctcatccagcgcgctccgtgcgcttttatcgaacgcgatgtcgccgagagcatggtcggcgtgcagttccctaaccatctgtctcagtgactccacgagctgccaaggagggcccggggtgcaagggtcgcatggggttgccgaggtccgtggctgattcaccgtgaatttgagctgacagcacaccgactcggactccgcatccaccccaccctcaccttctgctgggcgcccacggtcgtttgtgtcgcgtccaggaagcggtacacgagcaacggccccgtgaaggcgaatcccaaggcaaggcatacaactgccacgcgccatcccgttattccctgcaggcgcggtctttccatcagggatagcctgacgggaggataccggccgctgagacgctgctattgcggggccctgaccctggccctgcacacgcagtcttgggctgagtgagaacccgccagggctagcgagccccgcttccttacacgtcagccgtcttctgttgcatagcacaattttttaatgcctggctgaggtgattattgcgatcgcaaagtgcgcgcnnnnnnnnnnagtcagccgtcttctgttgcatcgcacaattctttaatgcctggctaaggtgattattgcgatcgcaaagtgcgcgcaatgcgggtagcgccatccgaggggggccgcagcagctccgggggccgcaggcacgtggaccaagatcggaatttgaggaagacgccaatacgctatctcaaggtcatgaaaattccagctttggggcatccatcgcccgactgtgtataatttacaactttcgatatcccttgggagttcaatcgccactgctgcggggaagtatcaatagccagagcatacatacccggcgctcaattcgagctcaaggctgcagcacccctcgtttcgacgacagtatagaacgaaaatcatactcattagacgtcaagatggaatctcaatcggcattcgctgtctggctcggcatattcttcgctccttggtttgcctcgagttagccgttgccgccacagagctcaagcgcctggttgag

SEQ ID NO: 32980 - DNA, 67 bp, Chlorella protothecoides
accctaaagaccactgattgcatggtcttcaccaactgacaacataccagatggcatggccagacct

SEQ ID NO: 32981 - DNA, 127 bp, Chlorella protothecoides
cgctggcgctggcgctggcgacgccacagacccgcttctgcggcacagagatcgcctcttcccgctcagtccaggtcgtgagggttattaggtcagccatgtgaccgtgaccctcacgacgctgtgg

SEQ ID NO: 32982 - DNA, 119 bp, Chlorella protothecoides
aagggagtgagcgtgaaggacggggagccacccgttgaggccgcggaggagccggcgcagggctgaggctcggggggtattctcccgtgcaccgtgcccgactcccttgtgcatggtca

SEQ ID NO: 32983 - DNA, 130 bp, Chlorella protothecoides
ggggcggtgccatgcacgtgtcgatgtgcatcctggataccctacatcagctctgtgccaccctttcccggctgcactcgacaccccgcaggcgctccaccagctcgagcggcgcctggaccaggggcgg

SEQ ID NO: 32984 - DNA, 73 bp, Chlorella protothecoides
cggccagcctgaggtgggtgggtgctgctgatgaggcctcgatattatatagaacgctgtagtcattcatcgc

SEQ ID NO: 32985 - DNA, 66 bp, Chlorella protothecoides
tccctttgctcactcccccacccccaccacaacccaacaccccacaccctgccaggtgctggcgcg

SEQ ID NO: 32986 - DNA, 145 bp, Chlorella protothecoides
ggcgggcgcgccgctgtcgtcgatgaagaccggcggtgggcgatgatcgctgtccccgtggtaaggcttcaggaagctcacgttgacagtggggttcatccccatggagggggggagcgccagcgtcgccgccccagtgccgcgc

SEQ ID NO: 32987 - DNA, 77 bp, Chlorella protothecoides
gacacccccgatcagctgcccaagtatctcgatggcatggacatccgcatccttgacattgcatccatgaccatctg

SEQ ID NO: 32988 - DNA, 141 bp, Chlorella protothecoides
agtccccagcctgatagaggctgcgcttggcggggttcgcagggtcgcaccagcgactccctcgcaggctcgtccagcagaacgtgagtcccagagggcggtcgtcgccgcccctgacaccccccactccttcccatgacc

SEQ ID NO: 32989 - DNA, 61 bp, Chlorella protothecoides
gatgccgtgatgagatgcaacaggatccgatgcaaaggttaaagtgccagaggccagcctt

SEQ ID NO: 32990 - DNA, 5625 bp, Chlorella protothecoides
  modified_base (350)..(359): a, c, t, g, unknown or other
  modified_base (2274)..(2283): a, c, t, g, unknown or other
  modified_base (2562)..(2571): a, c, t, g, unknown or other
  modified_base (3034)..(3043): a, c, t, g, unknown or other
  modified_base (3135)..(3144): a, c, t, g, unknown or other
  modified_base (4084)..(4093): a, c, t, g, unknown or other
  modified_base (5382)..(5391): a, c, t, g, unknown or other
ccaccccccctcccacacgcccaccgtccatgatgacgctgtcgccctccttgatgtcgcccgacagcatgcgctcggccatgctgtcctccagcaggcgcatgatggcgcggcgcagcggccgcgcgccgtaggacgggttgtacccttcgtccaccaggcggtccttgaagcgctctgttgggtgggtgggtgggttccaggtgggatcggatccgacaatggggtcgcaggaatggggctctccagacaccacggtggtgagcggcagggtcccccatcgccttcccagccagcaggcgtcaccctgcgccccccctccccatgcccacccgtgacgtcgatcttgnnnnnnnnnnacggtggtgagcggcatggtcccccatcgccttcccagccaacagaagtcaccctgcgccccccttccccatgcccacccgtgacgtcgatcttgatgcccttctccagcgcgcggttgaaaacttcgcgcagcatgatctcggcgatgctcttcacctccagcttggtgagctggcggaagacgatgatctcgtccaggcggttcaggaactcgggccggaagtactgcttcagctcctcgttcaccagcgtcttgatgcggttgtaggaccggtcctcctcgttggtgtccagctggaatccgatctggccgccgcccttctcgatgacggacgaccccacgttggaggtgaggatgatgagcgtgttcttgaagtccacggtgcggcccttggagtcggtcaggcgcccgtcctccaggatctggagcatcatgttgaagacgtcggggtgggccttctcgatctcgtcaaacaggatgacggtgtagggccggcggcgcaccgcctcggtcagctggccgccctcctggtagcccacgtagccggggggcgacccgatgagcttggacacggtgtggcgctccatgaactcggacatgtccaggcgcaccatggcctcctcggagccaaagtagtagctggccagggtcttggccagctccgacttgcccacgccggtgggccccgagaagatgaaggaggcgatggggcgcgcggggttcttcagccccacgcgcgcgcggcggatggcgcgcgcgatggcggtcaccgcctcgtcctggccgatgacgcggccgtgcagcacgccctccatgttgatcagtcggtcgttctcgtcggacgacaccttctcgatggggatccccgtccactgcgccacgatgttggcgatgtcggcctcggtgaccacgggccccgcctcgcccccggcctccgcctccgccgcgctcgtgtccttggccgaggcggtgatggccccgatctgggccttgagctccatctcgcggtcgcgcagggcgcccgccttctcaaagtcctgcccgcgcaccgcggcgtccttctcgcgcagtagtgcgcgcagctccttgtccaggtcgcgcgcctcctcgggcagggcggcgtggcgcaggcgcacgcgcgaccccgcctcgtcgatcaggtcgatggccttgtcgggcaggaagcggtcggagatgtactggctggcaaacttggccgcgctggccagcgcctcgtccgtgtagcgcagcttgtggtgcgcctcgtagcgctcgcgcaggccgcccaggatctccaccgtctcctccacgctgggctccgcgaccagcaccggctggaagcggcgctccagcgccgggtccttctcgatgtgcttccggtactcgtccagcgtggtggccccgatgcactgcatctcgccgcgcgccagcgccggcttcaggatgttggccgcgtcgatggcgccctccgccgcccccgccccgatcagcgtgtgcacctcgtcgatcatgaggattatgtcgtcgttctgcttgatctcctccatcagcttcttcagccgctcctcaaactcgccgcggtacttggtccccgccaccagcaggcccaggtccagggtcaccacctgcttgccctcgatcgtctcgggcacatcccccgccgcgatgcgctgggccaggccctccgccaccgcggtcttgcccacgcccggctccccgatcaggcacgggttgttcttggtgcggcgccccaggatctgggtcacgcgctcgatctcccgcacccgccccacgcacgggtccagcttgccctggggtgcatgggcatggtgtggcgaggtgccgagtgccagcgaggtctgcagccggcatgcgcgagcacccaccagaccacacacaccgcgacagtcccnnnnnnnnnnacggcggcccaggatctgggtcacacgctcgatctcccgcacccggcccacgcaggggtccagcttgccctgggtgcatggcatgggttgcagaggtgccgagtgagggcgaggtctgcagccggcatgcgcgagcctccaccagaccacacacaccgcgacagtcccgtgactcgggccaccaaagtcagcagctccccggcgttcatcacaactgcaccaggcctctcacctcctcggcctgggcggtcaggttggtgccgtactcctccagggtgnnnnnnnnnnggagccagcagctccccggcgctcatcacaactgcaccaagcctctcacctcctcggcctgggccgtcaggttggtgccgtactcctccagggtgggcatcttgttggagccggtggaccctccgcccaccgtggtgcccacgggctcctgcgactcacccaccatgcgtaccacctggcgagtgtgaatggaggggtggcttgaggggtcgagggtaccgaggccagacgctggcggtgggaaagcaactcagaggggattcactaaagccagattaccaggggatcttgcactccaacacggactgctggatgtcagtgtcattatgaccctagtatgcactctctcaccgtcgctcccaggcgtgcacaagcatgctctcagtccccaaggccctagcctagatttaaatggcacagtaacccacctgagtgcggatcttctgggggtcggcgcccaggnnnnnnnnnncagggggagggggcttgagggtagggatagaggggagcatgcagaaggtggggtccacaattagaaggagaacgcagtgcacaccgcacccnnnnnnnnnnaggggatgcattaaagccagattaccaggggatcttgcattccaacacggactgctggatgtcagtgtccttgtgaccccagtatgcactctcccaccgtcgctcccaggcgtgcacaagcatgctctcagtcccaaaggccccagcctagattcaagcggcacagtaacccacctgcgtgcggatcttctgggggtcggcgcccagggtctccagcacgcgggaggccacgccctccccctcgcgcagcaggcccagcaggatgtgctccgtgccaatgtagttgtggcctggtgaggggggtgggagggggagggtggttgagggtagggatagaggggagcgtgcaggaggtggggtccacatgtagaaggagaacgcagtgcacaccgcacccatggtgccaccaacagggggtcgagtgctgtgctgtgctgggaagcccttcctcaggcaccagtgtcaggcagatgcgcagctggcaacggtcatgagcttccatccgacccatacgctcgcaggcagatcgcccctgggacgccattccctccagccccgctcaccgagctggcgagcctcctccagggacagctccagcacacgcttggcgcggggggtgaaggggatctccacggccacaaagccgctcccccggccgatgatcttctcgacctccacacgcgcatctttcagcgtgacgcccatcgacttgaggaccttggcggcgatgcctggggaaaggaagaagtgttgagataagttcaaaggcgtgtgcaggaccacggacgggttgcatgcaggctgtcgccccagccacacacagccgagcatgccagtgcacagcatgcaccagccacacaaatggacggcatggcgacgcttgaacgtaagggcacagggaggcagtggccctcttcagcagggcacatcattgtctcgnnnnnnnnnnagtaagggcacagggaggcagtgtccctcttcagcagggcacatcattgtctcgaggatgagtcgtgcaatctacacggagcaacccacggtcggagccagaggccccccccccttctgccaacctgtggactccccaatcaaccccagcaggatttgctccgtccccacgaagttgtggcccagacggcgagcctcctcctgggcgagcatgaccaccttgatggccttctccgtgaaccgctcgaacatcatgcgggtcacgcgcacggcgctggtggtgcggccccgcgaccggcgcacggccttgcccacggcctgctgcagggtctgggggctcccagaccccgcctgccccgcccgatccacatgattcaggcgcctgaagccggaaaagggagtgagggtggtgaagtgctgcttgctgctggtcgagccccgggtcacgctggagccggagggcgccaatacgccatagctggctgcgacggtctgcatgctgccgcactgatggtgcgtgcagctgggttccgattggtgatctgcgggagggtctggggaggggtctcggtaatagatccatcgcgatggacgatggcccgggctcatccaccccacactagctggaaagcgcggcgcgctgggctggagcatcgggccgggccatgcaggatcgggagcgccccttcccgactcctgcgcgatccagcaacccttgccagaccctgaaccctctgcatcgtttccattgtacccgcggctgcgtcgatcaggctgataaagacggacggtgcgggggcccatccttctcctccctcgtttgaaagtcagtgaggccccgtgccgtgtgccacgccgcaatggaagacgatgccggtttcggcaaggcttcccgattgaggaggcacagggccgggctgggggcctccgccacaccgtacgcccggaacaagccagtggctgcgcccaccgccctggcccaccagcccttgctggataatgctgacggccgatctcgcctcggcacggtgctgagggctcccctgaaagcagcagcctatgttctgacgcgggtgagggcggggtggtagccactgggaaggagtatggtgtggagttgggcatattggagaggggatgtctgtctggtggtcacagggcatgcgcactggccaggtccgatgccacaatgcctgtgatgcctgcttgccaccccacaggtcccactaattggagggtactttggggagaattccaatgcggcctcccctgccgctgcttcgccacaannnnnnnnnngattggagggtactttggggagaattccaaggcggcctcccctgccgctgcttcgccacaaggtgcggggcagtcgcggcgctttaattgtgcaagggcggtgggagatgctcgagtccttgcaacctcaatctggaacccgtgatttcccagtttgggccgacttggtgctggcagacggggaggcgtgcactccacaagccccctcacccatgcgctccccctaaccccccc

SEQ ID NO: 32991 - DNA, 164 bp, Chlorella protothecoides
gcgacgacgatgatgatgacgaggtgcaggcgctgggtctgtgtactttgggcaatagtcccagagactcctgctgcacagctgttcgccagcctgtgcatgcgcctcacgtgccagccgctggttttgctttccacctagaggatacatgctcctgacccatg

SEQ ID NO: 32992 - DNA, 63 bp, Chlorella protothecoides
cctgcatctcggcgtgacatccagcagcatgcggtgcccacccacgggccccttgcctgccct

SEQ ID NO: 32993 - DNA, 131 bp, Chlorella protothecoides
ctcaccactcacatctgggcggtttgcctcatgttgcgtcgcctcctcgcccgcctgctcttatggcgcgctctctggagcctgcgagggagctggcgcgtccggctgtcgcctttcgcgctccgcgagga

SEQ ID NO: 32994 - DNA, 141 bp, Chlorella protothecoides
aatggctgatctctggtgctgcactggcctgatgtgctggggaacatggtactgggagcacatcgaccctataaggcaataattgagaggtgagtggactgtcacgcaactctgcccattccccttctagacccacctccg

SEQ ID NO: 32995 - DNA, 61 bp, Chlorella protothecoides
cacagatgtgactcacaacactcgcctcatgaacaagctggccagcaaccacatctagagc

SEQ ID NO: 32996 - DNA, 200 bp, Chlorella protothecoides
tggtgtggaggcgcagagttcgtggcaggggtgggggcggccgggaaatctgttatcacaggggccaaacgtgcaggcccaggtggctgacatccaggcgcacagcgcttgtgtgaggcctgtcgtttgtgcgcgtcgtgttttgtcaccaggcgtcgggtgccgtgccgtctgcagcagcaccccaagctccacatgtg

SEQ ID NO: 32997 - DNA, 61 bp, Chlorella protothecoides
gaggcgctgtcgtccacctcgcccccgctcccaccctcctcctcctcctcctcctcgctgc

SEQ ID NO: 32998 - DNA, 64 bp, Chlorella protothecoides
agtgcggtacatatatgaattatctccttccctccccatggttcgttcataccatccagaacac

SEQ ID NO: 32999 - DNA, 97 bp, Chlorella protothecoides
gctcgcagagctggcggaaggctgcgcgtgtgtgggtatgtggagggatgggaagaagcggcgcgttctcaagaggccaagaggggtgcgcgtggag

SEQ ID NO: 33000 - DNA, 11551 bp, Chlorella protothecoides
  modified_base (317)..(326): a, c, t, g, unknown or other
  modified_base (804)..(813): a, c, t, g, unknown or other
  modified_base (902)..(1033): a, c, t, g, unknown or other
  modified_base (1137)..(1146): a, c, t, g, unknown or other
  modified_base (1869)..(1878): a, c, t, g, unknown or other
  modified_base (2659)..(2668): a, c, t, g, unknown or other
  modified_base (3687)..(3696): a, c, t, g, unknown or other
  modified_base (4935)..(4944): a, c, t, g, unknown or other
  modified_base (5302)..(5389): a, c, t, g, unknown or other
  modified_base (6616)..(6625): a, c, t, g, unknown or other
  modified_base (7888)..(7897): a, c, t, g, unknown or other
  modified_base (9057)..(9066): a, c, t, g, unknown or other
  modified_base (10655)..(10664): a, c, t, g, unknown or other
ggcgaggcgggggcgcgctgcgaggcgctgcgggctgaggcggcccagcgggcgcagcatgtcgaggccctgcgcgaggagtgcggccggcgcggcgaggcggtgcgcagcctctccgcccgcgtggaggctctggagggcggggagcggggtgcacgagcggccggggcggcgctggaggtccaggtgccagtgggggggggttgaaggagagccggcaagggaggaaagtgagacgcaggcccccagacccggcacacaccatgggactggtacatggtgacgtgagtcaggaaggcggctcctgcaccccatannnnnnnnnngaaagtgaggcgcaggcccccagacccggcgcacaccatgggactggtatatggcgacgcgagtcaggaaggcggctcctgcaccccatagcacaccccttgctgctcgtgccaggtggaggatctcaacgctcagctggcagcatcgtcggcgcagctggaggagtgccgcaaagtgctgagggagcgtgggcgcggggaccaggccaccaggtgattcgggacgccacgagaggcgtgaggggttggtaagctgtgcaggaaccaactatgcaaaagactgtgggcccggtgtggtcgagcgggggagcgtcatcggcagcaggatagaccaagactgaccccttccttcccctctggatgagcaggggagggaggcacagcaagagggaggcttgtcccatggaaaccagggcacagccgtctgcaagccccggccggatgcccggtcccccacaggcgtggaggggatcgggcnnnnnnnnnncggtacgctaggcaggaaccaactatgcaaaagagtgtgggcccggtgtggtcgagcaggggagcgtcatcggcagcaggatagaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtgatcaccacgcctgcccatggccatgtagagacctagggtggttgacagcgcggagtactcaatgctcgctccctgaagcaccagctctgtgcagaagnnnnnnnnnnatggtgatcaccacgcctgcccatggccatttagagacctagggtggttgacagcgtggagtactcaatgctggctccctgaagcaccagctctgtgcagaaggttggatgccagaagcgtgacaccccctgccctgctgtccaccatcttcacactcctccctcctccatggtgccccttccctgcacaaagtggcgccttgctcaacccgggaatcatacatatgggatggtgcaggagaaagagggcaagaaaacgcagtacaatgctcatccaggcgtgcactgcaatgtgcacagtaaattacacaggctcagccgtcggcagagggcgcccgctgcaggggcgacgtcatacatcatgataaggcaggaaatgtcctgctccaatgacagcagtagcaaaacaaggaggccacgcatcacacgtctagagggcaagctttgccttctgcgcctcgctgggcagcttcacgttcgtggccaggccaatgctctgcaggccacggatgacgagccaggtagcatcgatttgccaccactccagcccgtggcgtgcactgaactcgaaggcatggtgattactgcgaggtgggtatggtgcgtttatggagaggtgacaatgagcgtggggaaccacttctcagaaacagtgatggtggaaagaagtggaaccagatgtctctactgctgcaaccccaccagccaaggtgccacgtgcannnnnnnnnngaacagtgatggtggaaggaagtggaaccagatgtctctacggcagcaaccccaccagccaaggtgccacgtgcagaaagagatattccggatcctagtttccgcagcctatgaaaccatacgcctggagagaggcaagcactcccagccctgcggcagaacccagtccatcctctgtctcacttgtgccagccttctccaaacgccagcagccccacccaccagttattccttgacaggtcccctgttgattgtaaaagagcaacgtgcgatcagcaacccacgtcttgcaaggggccgaggtgtgtcgacacggacagccaacatcctcttcctcaccgccacgaccttcaactccaagacacacaactcccccaaccatcccttccaacacagccgcggtccggcactccagctcaccagtcctgtacgactgcgagccccacacatgcgccgcggagttcacgaaccaggtgatgtggtagaccaccacgagacgcacggcccccacccacaccagggctggcaggccgccgagagcaaagagggctgccagctgcgccgttgcatgcaggccaaagtgcttggcgaggtgctgtgagaggtgggggaggagggaggaaagcggactggtacggtcttcaaacgcatgcacctggctaaggcttgtgggtgaggtttggcacacgcgccgttgaatggctggagaacagcccacacatcctccaggcccagccagccaagcgtcagacagcctgcgagcacctggtagaaagggtcnnnnnnnnnnaagagggtggggaaaagggaggaaagcagactggtatggtctttgaacgcatgcaactggctaggattgggtaaggtctggcacacgtgccgttgaattattggagaacaacccacacattctccaggcccaaccagccaagcgtcatacagcctgcgagcacctggtagaaagggtcgtctgccatgtctgcaacattggatcggtccgcgatcctgcgctgcgtggccccatcatccagcaaccagcccatgtggctccaccagaagccctcatagggggaatgggggtccaggggggtgtcgcagtgcaggtggtggtgccgatggcaggacacctggcacggcagaggcggggcagggggggccatggctggtgcgactgaacgcggaggtgctgacagtcgcaaaatggagggtgaacagcgctcaggagggcaaatgccaacgtgaacgggaaagcattcgcaaaggcagcgtggctgcgcggcaagggcacccgacggaacccccaaccccggaagggcgacgggcactctccgtcccagcagcagagccatcacgcacccactccagggggtccccctggatggccaggacgccgcagtaggccagggcgtgctccagccacttgggggtcctgaaggagcggtggctcagctggcggtggtaggaggtggtgatgcccagcaggccagacacgaggtacatgaggaaagcgccgccggcgagctgcggggtgaaggtggcgggggccaggcaggccaggccgtgcattgcgatcatgaagacggcgtaggttcggtccttggacgtccactggcgctggctgaaccaccgggtcctgggcagcgcccacacgtcgctcagcagcacctgcctgcgaggggggggagggggtggggagggggcagcagtgtggaccaggacaggggtcaaagggttggacctggtaccacgccaaatggcagtgtgtgttgtgggatccggggtggtcgacatggcaagctgctggcgcgnnnnnnnnnngtggacctggtagcacgccaaacggcagtgtgttttgtgggatcctgggtggtcgacatggcaagctgctggcgcggtgacctcccaacgtcccaggtgtggaggcagggcgcaagctgtgctccccactggcaaggttcttacctgctgccctgctcgaggccctgggcttcgttggagggctttggaagggtgcgtttcgtgttgatcgaggccggggccgaggtgaacacatcggtgtagagctgattatagctgggtggagggatatcctgagggcccgacggcgcctctcgctcctgtggagctgcgaccgacctacaatagttttaagggcatgaggcgttgattcagatcaaaaaagagagctttttggcacccgagcatcgccttcagtactgcagtactggacctacctcacagtccacgaccgctgtcccgctcgaggtgtcccgcggcgagggccgtgccatgcccgcgacgtgcgtgtactcagcctcgcggaaggagaacaaaagtgatgggtgcctcgcagggcgctcccatgtgcagctaggcccgtcatgaatggacaggtattccaatctcgtatctcgacgtgggtgcgcaataatgactcccactcaggccttcgcgggtctggcgtggccgatgtgcgtgtacaactcgtactcacaggacgaaaagtattccgctgaatgggatgccgcgtgttgcgcacgcgtgggccatcgccgtactccctccatatccagaatgggggggtcgctgatgatgattcgctctgaaggatcaccccgggtaaccctcgggtgatttggtccctcattgcgacggccacctccggtgtagagaacaagcgccccacaacaccactcactactttgatctaggttgtaggatgacaaggagtatatacaaaggccacagtgggatgcctgccaacccaaatccggaaaacacaacagaaacattgttgggtacagtaaggctcgtgccacaggagcaagtatttgtgcagagtgccctccagcaccacaactggtgtaacaaggcgtggcaatgtgaaaggctgtgccatcagcttaagcattgggacaaatgggtgctgactgcacccagtcatttgtaagtctgatgagctcaaactcaggaaggagagccgaaagacaaaggcgtgcagattagcagcccccctggagcgctagggtgcttacaagggacctagtcggtgatggnnnnnnnnnnacagattagcagtccccctggagcgccatggtgcttacaagggacctagtcggtgatggtgaaagcgtatgggtcgtcctcttccatgtcgagtatctcgttgatctctgagcctgtcagggatgggccatcgtcttcctctgagtgttcctcagacccgacgaggtgggagctcctgctggccatcccaacctcctgacttcgagcctccagcagctcttcttcgtcatccctgtcttgtaaaaccaccctagacaactcctgcaggaatggcgaggacaggccgatttgttgacgatccgttttctcgatatcagtcggacaatccgcatgggatggggctgatcccgaagacatnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttctcattggtcacggcatacatgtgcgtcctcgcgggggagagtataacgtcgaggagcgcccggcgcatttcctgcccctcgtacaccatggtgtgttcattacgtgttacatgaagtagctgctgagataataggaacgagaggagcagggtggtgagaacctggggtggtcgcaaggtgagagatgctgcctcgagagcgcgcgcccgggagcacggctgggagcaagtggcagaaggaatctcaaggcccgccacgcccgacagcacgatggaagtatcaaggggggaaggatgggcggtcgttttgttgactctctgtaagcaaccgcagtcatgcaggctcagcctcctcctcgcccgcctcgtccacccaatgcgtgatgcaggccaggaagtcggggaaggtgatgcggccattgccgtcccggtccagctccaggaagcgctgttgcaccagcggaacgatggtgttggtagcagaggcatgcgggctgtgcggcatgttctccaggtgcggctccagcagggcggactcgagctcatcctggcacgtgcggcaggggatgggcaggtgagcagcgcgtgggtgtgaccctaaccctgccagacgggccagggcatgatgcgcgttcctggtccagtcctgtggccctgcatttctggccactccttgccctccctcattccagcgcactcgtacacccacccggctgatgaagccgtggcggctgctgtcaaaggacaggaaggcctgggtggccagctcaaaggccttgagcgtggcggcatccacgtcctcctcgtcccggggccctttgagcaggtgcaggatggccaggatcaccacaaattcgtccacgttaatggtggaggagcggtccaggtcggccgacacgaaggccgactccagcacgtcgtcatccactgcataacccagcctcctggcacccgcccgcagctggtccagggagatctcgcccgtgggcgggacgtcaagggagcggaacaccttggccgcccggctgaggccgtcgtgcagactgtggaggggacatggagggcggggggagggactgaacgatgcgggaggagacatgcggcacaacccatggacatgcggcagaggaggggcgcgtcggagcatgaggaaacgagctgcaggtccatgctccacagggctggaatgagaccagccaggtcggtgccctcccccgccgcnnnnnnnnnntgtcggagcatgaggaaacgagcttgaggtccatgctccactgggctagaatgacaccagccaggtcggtgccctcccccgccgcactcacgaaggtagtttgagcaacagcttgttcagcttcattggggtgcccctctccccctgagcccatttctcctgcaaggttgcaagtaatgaggggggtggggcaaatgtaacagcagcctgtgccatccacctgaataacctggaagaaagtgtgggcgtgggcatcagcgtttggggccggcggaggacacccagaccctcggctcctcgtcattgtgcccaccttgatcgtatctgacaatcgagcatccaggtactccctgcactgggaggcaaagttgacggacggagaggatgcctcgggccccaagctcgttgccgtggatgtcgagttccccatagggccacagtatcctcttgcgggaccaggcttgccggagctgggaccaggccacctcggaacagtgtgtgagcagctgggtttgccaacgcctcctcaccagaggggatcagggccgttgggtgtgagggcaggagaccatgcattccgggcagggccagtgaagcatgatgcttcgcatgctgcacacatatatctgcggtgatccccgcccagcatccaccgctacttccctgccctgtcagggcgatgaggtcgccgccggaatattgagtttgaagcgactgacacgcagactcttgcagactgtggagtcgtccagccgagtgcacctgcgcagacccgcttggccgcgcctggatgttgggtcaggcttcctgtggagtgcatgcacaccttcaaccatatctagtctcgacagcgttcaggtcgaacgctcgggctcccaaactgcgccggacgctgtgcagagggctggtgtcggcccctcgagcagagcttggagaaggagcgacggtgaaggtcactgctcccatcacggtattccattccccaaagtataaggacggcctgctggtgcaagactacacgggcaccatcgttgccgacgtgtctcagttccagggcaaaaccttgagtgccaacaagccctggaaggtgtctttagacgccaaggaccccgagggcaagccgctgaagctcatcatccatcttgtgagtgagggagggggatgagggagatccacgtaacagatcccatgttcgccccagctgtacctagtttaccagtcttctttccaaatgacaggattccggggagctggaggaggtcnnnnnnnnnntgcagatcccatgttcgccccagccgtacttagtttgtcagtcttctttccaattgacaggattccggggagctggaggaggtcaaggaggcctgacaagaagcacctggttccttagcgcaccaagttttccacctttgttgtcacctgctgctctgtgtgcttccaaccaattttctgagagccacatggcgtgtgaagaataaaaagtgctgtctctgtaccgacgcacttccgcttcgattggagagtcaatacagggcattcagcgtacacacactacctcagcaggagaagcagcagtcacgtgggcacgtgcaggcccaacaacaacccgatgcacaatgcagactcttttacactccaggaacccgttgtccatatcaaactgcatccttgtgcttgcagttgtacaggcatggctgcgcagctaaacctgtcctccacgcgctgcccagctatgggcacggcaccgaggcggtcgtcggtgtccccgtcccgggctcaatcccgtcggagcctgagcgtgcgcgcagccaagacggagaatggtcccaccattgctatcgcaggcgtcaccggggctgtcggccaggaattcctccgggtacgacgggcctgatgctcaatggggaggggggccggggctcccatcgcgccgctgctcaccgcgccccgtgccgctcccgcaggtcatcacagagcgcaagttcccctacagcaacatcaagatgcttgcatctgccaggtgcgggattggatcggcgaccgattgatgccgttgggtgggcaggcaggagtgcagccatgtcttgtgtacacctggccttggactaggctgaagttcctgcgctggtactcatgcacaggtcggcagggcggcaatacgagttcgagggggagacctacaccgttgaggaactgacagaagacaggtgggtcgatgggtgaacagcaggccgttcagccagtggtctgcagcgcacgctgcactcaaaaggggcacgtccttattcgagctagtgcagcctggggggtcctggtacctggcctcctagtgatgactgtacaggaggggcactgcaccccgcagctgcaggtcccgtaggagttcttacggcaatcgccccacccactcatcgcccctcccaaattccagnnnnnnnnnnaataggagttcgtacggcaatcgcctcacccactcatcgcccctcccaaattccagcttcaagggcgtggacatcgccctcttctccgccggcggctccatcagcaagaagtacgccgccgtggcctccgccgccggcgcgacagtggtggacaactccagcgccttccgcatgacggagggcgtcccgctggtcatccccgaggtcaacccggaggccatggccggctaccgcgcgggcggcggcggcatcattgccaaccccaactgctccaccatcatcgccctggtggcggtggcccccctgcaccggctggccggggtcaagcgcatggtggtgtccacctaccaggcggccagcggcgcgggtcaggccgccatggaggagctggagctgcagacgcgggaggtgctggacggcaagcctgtcacccagaacatcttccccttccagtatgccttcaatgtcttctcccacaactcccctatgaccgacaacggctacaacgaggaggaggtgaagatggtgagcggtggggtgggattctgggggttgaggggtggggtggaagggggttgagatcaccgggaatgcaggcatgatctatgacacggagctcctctccagggtcatctgcctggggatgactgcagcaggtctgccagttctctattcccttgtgcacactctcccccccccaaatcaatcaacgaccacataggtcaaggagacgcacaagatcctggggacgtcggacatccgcgtgaccgccacgtgcatccgcgtgcccgtcatgcgcgcgcacgcggagtccatcaacctggagttcgagcgggacatcagcgaggaggaggcgctgcgcgcgctggcggcggcgccgggcatccaggtggcggacgaccgtgcggccaaccggttccccaccccgctcagcgtctcccacctggacgacgtgtttgtggggcgggtgcggcgcgactacagccgggacgacgcgcggggcctgaacctgtgggtgtgcggtgaccaggtgaagaagggtgcggccctgaacgccatccagatcgcggagctgctgctgtgacgagcgtgtggatagagatgctgcagggaatgtgaggggtttgcagagggctgaagcggggtctggggcaggggcaggggggtggtggataacaagtgtgtttcacacagagtgtcggagccctcctttccaccgcgcgaccccctcatggaaatgattggatccatccgccctctttatccagcgatggaggggtccggattctcgaaagatcacgtacagtagacgcatgccccatcgatagtcagtcttttgtgtcgtgttgtgagtgtgtgagtacagagctttacccgtgcgagtgttgttaccagccatggccggggcgggtgcaacgggccggtcggagtccgcgcccacggccctcaccgccgtctcattcgcgtgcctctgctatgcggcctccaggtgggtggaatgctggggcggtgcgatgattccactgcgtgggccgggccacggatgcgcccgtcttcgcgcaccaccgacggtaccctctcttggcttnnnnnnnnnnagcggtgcgatgagtccactgcgtgggccaggccacgcctgcgcccgccttcacgcaccaccgacggtaccctctcttggcttccgcccgcaggctcctcgactacctcggcttgcatgcccctacacccctggagtcgtatccggtaggtttcagagctttgtggtggctcggatgaggacaggtagaattgcatgtggcggtgcatgcctgtccacttttcgcctgtgccccaggtgccaccatcgctcaaacatcccccacaaaccaccactccccacccctcaggtggtcagcggatgctgccaggtggccgtcaccggcgtggccatagcaggcgtggcatcggccctgggccgcgacctggccaagccactggccgccggccctgcggcgctgcaccagatgcttgcggctgcgctgtctggatccctgggccctgtagtagctgcgcccaagccctcccacgcgtgccagaccctcgacagcgcgctgcctcgcgtcgccgcgccacgccgtgtgcatgcgctcccaccgacagcgcacgcgacagcccccccccgcgcctgccagccacgtggtgaggtggcaagttccactcccgccgcggctgcagagtcagcagcgcccgctgaccagcggtcggcactcaccctgcccccgctggccagcctgagcctgggcgaggcggcggggagctggacctccggcgcactgtctgccctgctcaacccgttgctggcggtgtgcgacagcccccccatcgaggccatgcgccgcgccatgtcctctcctggtgcgccgcgcgcgacgcaaggcgccgcgccccggcgccggcgcgcggagggggacactgcgcgggacagcagcgctgccgccgccacccc

SEQ ID NO: 33001 - DNA, 80 bp, Chlorella protothecoides
cctgttctttgtgtccttttaccaaaacatcctgctgctgctcatcactctgcctgtctacgccgcctggcggcatgcgg

SEQ ID NO: 33002 - DNA, 61 bp, Chlorella protothecoides
gggtcacgaaggcctcgtaggtgctggcggtgcaggtcagcgcggccgtgtgcggccccgc

SEQ ID NO: 33003 - DNA, 79 bp, Chlorella protothecoides
cctgatgcggatggctgttgcagcccctcctcaccagccatgctcacatgcagcggaatgatcagacatcaccctgaat

SEQ ID NO: 33004 - DNA, 68 bp, Chlorella protothecoides
gatgggaccggtgtggcctgcagtgcgctctacgcgctgtcagtacaggacagcagggtggctgggtg

SEQ ID NO: 33005 - DNA, 61 bp, Chlorella protothecoides
gccagcaccatgtcggctgcctccttggccacctccgtccccgtcacgcccatggcgatgc

SEQ ID NO: 33006 - DNA, 79 bp, Chlorella protothecoides
ctgtgggtagatcaagtttgcatggccaagagcagcagccaccatctgggactcatgtaacctgtgcagccgccgtcgc

SEQ ID NO: 33007 - DNA, 77 bp, Chlorella protothecoides
cccacccccgtccgtcccggtcggtgacgtcaggcgactgtacgtttctggttgcttacacggggtctgcctcaatc

SEQ ID NO: 33008 - DNA, 61 bp, Chlorella protothecoides
ccaccagcttctcctcgcctcggcggacccacacgtactggtgggcgtgcagggtggcgtg

SEQ ID NO: 33009 - DNA, 1144 bp, Chlorella protothecoides
  modified_base (153)..(162): a, c, t, g, unknown or other
attcctgggtgcattcgtgcaccgccctccgagagaaccagcatcgaagcgggatgatcctcggttgagtagaggcgcttctgttgtcagcagtgccctcagagtgtagtcgttcaaggggtgtcccccttgcctgctcacttccaacaggcnnnnnnnnnnaagaggaccagcatcgcagcgggatgatcctcggtcgagtaaaggcgcttctgttgtcagcagtgcccgcagagtgtagtcgttcaagggacgtcccccttgcctgctcacttccaacaggccacctcccatgtacacccacctcagagcctgcgatccgaggtttcccccgccccacccccacaaccctcaccaggtgcgtcatgtagtcggcgatgagggccaggtggcgcgggtcgacgccgatgccgtaggcgccgaagaccgaggcggcctcacgcacgatggtggcgcgcgcggcctccacgccgtacgtctccagcatggcgtagggcgagttggcggccaggccgtccacgtccaccaggtcggccgaggcggcggcggcccgcaggttgatgccgtcggtctgcacgcaggcggctgcgccgcgcgccgcctccagcacgtagcagcgtgacacgccgggcgtgccgcgcaggagggcggccgcagccacgcgctccgccacctcctgcagcagcagcttggggcagtccagggccaggtgcagggccagtccgcaggaggaggtcgccgcatccacccacaccccgccctccagctcgacgcgcgacgaggcggaggcggaggtgcggcggacggcgccagatacggatgcggcggagcgcggaacggcggggctgggggcggccgcccagccctcctccgcctctgcatccgccgaggcagtggcgccccgcgattcttcatccgcacccggccccgtctcctcccctccctcctcctcctccgccaggccctcgcgctcagcggcctggcgctgcgcctgcgcggccagggccgcgtcgtcctcgtccccagcgtcgtaggtggcgtgctcgccgcgccccgcgccgaaccgcgtcttcccctcctcgtcctcttcgctctccggctcctcggcctccttggggcggcgcggcgccggcgcagcgccgcc

SEQ ID NO: 33010 - DNA, 183 bp, Chlorella protothecoides
cgcccggggagtggtggtgaacatatgaatacttcccgtcacctgcctcccccagggaccttcatcactggagtgccagggccctctgtgatgaggttgccaggccctggctgcggtgcagcctccccacaacctgggacctgtcatgtatacatgttgccgtgagcagctggtcaggtgcag

SEQ ID NO: 33011 - DNA, 64 bp, Chlorella protothecoides
agacagacagcattatcatctaccgccataacccccacaccggccacgacgaggacaccaggca

SEQ ID NO: 33012 - DNA, 61 bp, Chlorella protothecoides
agcaggccgcgctggccttctcaggtgggcgctggtgacaagggggattgaccctggtggt

SEQ ID NO: 33013 - DNA, 61 bp, Chlorella protothecoides
aaagtcgggcccaatctgtgcgaagatgggtgcgctgtagggcttgatgagagatacttgt

SEQ ID NO: 33014 - DNA, 151 bp, Chlorella protothecoides
cccgccatccctcccaaacaggggggacatcaatagcatgaggcgttatgtacgaagataccttgtatgctcagaacatcccctggctcccgtttgaatcctcatttttggatcgtgatacgcaaaaagtagtgtctcatgcggcagttcc

SEQ ID NO: 33015 - DNA, 121 bp, Chlorella protothecoides
cagcacctccttcagcttgcgccgctccgagacggggtggtgggccagcaggtcggccaccaccgcgttgagcacctcggcctgcagcccggcgtgtcgccgcacgcccatggcgtcgtac

SEQ ID NO: 33016 - DNA, 72 bp, Chlorella protothecoides
tcaccaaaggcgacgatgtgctgtggcctgcacccgtgggctgcggcgtagtccacgcacttttgcaggtcg

SEQ ID NO: 33017 - DNA, 79 bp, Chlorella protothecoides
ccccccatctcacctccttcagcaggaggtcgacgtgagcacgcagggccgccacctcctcctcttcggccccggagcc

SEQ ID NO: 33018 - DNA, 209 bp, Chlorella protothecoides
accgccatcggtccatccctcgtggagcgtcctcctgtccctcggcaaacgtcatctgcctcacacgatgcacttcgtgcttcaacccccggccaagccttgcgattgcgcccctgccatcaagaaccaaagccgtatcaagggaccccccccaaaaatcataaagcccacctgcagcggcggcggcacgcccgacaggctcttgaccg

SEQ ID NO: 33019 - DNA, 4093 bp, Chlorella protothecoides
  modified_base (1795)..(1804): a, c, t, g, unknown or other
  modified_base (2527)..(2536): a, c, t, g, unknown or other
  modified_base (2809)..(2818): a, c, t, g, unknown or other
  modified_base (3945)..(3954): a, c, t, g, unknown or other
gcggccgccgccgagccggaggcgggcgccgaggaggaggaggccgaggccgcgccggcgcggggcgcgccgggcagcggtttgcagctggcggacctgtccaaccccctggtcatggccccggacagcgacggcggcctggaccgcctgccgcccccgcccgtggcgctggcactgacgctgtcggtggccaacaccggcgaggaggccttcaccttcaccacgggcctgcgcacgcgcctggctaccgaggacgcgcgcacgcacggccagtacatcaaggccgtggggctgcacggtgcgggatgtggagtgggagtgggcaggtcagggtacattccgggccgcatcccatggggagggggggaggctggcgcgtcgcttcgtcatgccctgggaatgagtggtgtgccctgctctgttgcgatgcccgctgaacacccctctggcgttgccctgcttgggtgccagatgtacattggcggcttgtaagttagttgctcccccccccaccaccactcccgcctgggctggtagactcattcgatcccaaactcatcctcatcacctcccagctctcacctcccatcacacccccaccctgacatccgccccctaacagagttcctgtcccacccacaggcaagcacacgctgcgccgcgagtccaaccccgcccggccccgcatccgcgtggagaacgagcaagcggtgagcttcggcgggcgccagctggaccgcgtgtacgtcgactgcggcgcgcgcgagttcatcgcggtctgccccggccatgccgcgcacgttgaggtgaagaacctgcgcggcttcgacgacgtggcgctggaccaccccgcgctgtcctacccggaggaagcgcggtggtcggtgggcatcgcgcccgcgcgcgtcgccaggcccgtcaggcgcgtgtgtggggagcgggaagggggggaatcagggaggggtcctcttcctgagcagcaacggggtcctgggcacggggagggcggctgtgctgggtccctgaccgcacagtacctcttcccaccctctctcgcaggctggagccgggggagacgtggacgggggaggcccatctcatcgcgcggcaggagtactgggaccaggcgccgtgggagagggaggcggggctgagcgcggtgccgccgccccgactggactcgctgcggaagaccaagatctttcagcgccagccctcgccggcgcgcggggactgaggagctgctggggagtcgagggttttgaatggttgccaggagctgggtgaagcagcagagcaactgctgtggccactcgtcccagcagtttcgtggagcgtgctgtctcgattttgcaaacccctggtgcgtatgctggaatctccagagcctgcaccacccctcaaagagaagacactgagcacatgaggtgttacaggggcacatgcgcactggaaagaggggaaagcttgagagaccgccgttgtccctcatgcagtgggcgcagcggggacctcctccttcttcttgccaaagatcttcatggccgagtagatgccgacgccccaacctgccagcaccacgagcacggtctgctcctccttccatcgcccaacctgttgatatgaggctgtgggtgttcacggcgtctggctgcggatcagttctatgctcttggccatgcagttcagaaggaggcctcagcctcccagggcctgtcagccacgtcccgtcccgtacacccaatgcgcacctccatgggagattcccagaagttgatcttctcctcgccatgannnnnnnnnnaagcctcccagggcctgtcagccacgtcccgccccgtgcacccaatgcgcacctccatgggagactcccagaagttgatcttctcctcgccatgagcatctgtcaagggccgtccgggcgggtgagtcgcgagggagagacacccgacaaaaggagtgccaggggtgtggtggaacatcaagctcattcgttactgaacacacagcttagcatctcaccggcagcaaagctccgtcgcggcgcggcattggcgacgcgctggcccgtcaggcgccgggagaggggggcgagcttctgcagtgcggacgccatgcttgttcgactgaacccgaggcccgaggagtgtcacagcacagatttcagggcctaagacgggataggcagggaactggaatcagtgaaggtcctgcggcacgagaccgtgctcctgagtccggggattcacaaagccaggagtgcagcatgcaccgcatgctactcctccaatgttcaaagcccaattcagaacacatgcatggaggcggaatggatccctctatgccagcatcacgctcccttgtaccgatatgtagtcctctgtaaaactgtaagccgaagcctcaacacaaagaacccatcctaaccgcaagatcaggacctcgttcagaattcttcaggatgggtagtgccccattgtcatcgacttcccatcaacctgtgcactaaagcctctcctttcactgnnnnnnnnnnatcgttcagaattcttcaggatggggaatgccccattgtcatcgacttcccatcgacctgtgcactaaagcctctcctttcactgtcatgagcacgttggccctggagaaaagggtgtccacctgctgaaggaatccagccttgcacctcaagtttaccaccagtacactttgcgcaagtgcatacactgcatccgttatatggaaacctgcgatgccacattttgttgcattttcctctttaaaagatggctccgtgtacaaaatgggtgtnnnnnnnnnnacacagtttgcgcaaatgaatacactgcatccgttatatggaaacctgagatgccacattttgttgcattttccccttcaaaagatggctccgtgtacaaaatgggtgtcgcatgggtgatcatgtgtggattgatgtccatgtgctgatttcgcgctcgagtccaagggggaacatttaccaccttgcccgggagagggcagctgaggggatccggaagctccgcgcagccgttataatccattgccattgattcacaatcattactagggtctgaatgccccttgtcatgccggatcatgagtgcgcatgattttcattctggggagtcccgacggcaccggtgccatgtctgggagacctccgatacacggcaaagcacatcgcaccacgcggcgaaatttccccgagcgcgtccgtgcctgaaaactagatatcagcctgctgagacccgtaatttgctatattcatcccatacccatcattcaccttcatcgcgataaaacatggcaggccacgcaatgcgtaacccgtccgccaggagtgtagcacctgtgcttgcactgatggtgctcctcgcggccatgacccccacccaagcccttgccttcgagacgacaacctcgctgagggtgagtgagcttctaatgccataacatgaccatggggatgtctcagagtgcctacgaagcgggtgaacaatatttttggggagtaggttcgtacgccgccaacgcggctgcttccggttggtctcggagagcatgtgctgagttcacatgcaccatcacgccttccattcgcagggcttgtcgagagttggtcgccttctgaaggcatcttcctcggcatcggcgtccgcttctgctcggggcagttccgaagtggcctccgccacagcctcggcgacggcctcggcggtcgcaaacgtgtgcagcgggggggacgcaagcgcacaggcgtctgcggcatcccaggccatcgcgacggtgagattaatatgaatttacaggtttatcggtatttcaatattcctgcaagatatctttgttcgaggcgaccgcaaggactgaagatatttgcaaaatctatgtcagcatggaacacttcagtttgtcaacttcctnnnnnnnnnnttatgattttacaggtgtattggtgtttcaatattcctgcaagataattttgttcgaggcgaccgcaaggattgaagatatttgcacaatccctgtcagcatggaacatttcagtttgtcaacttcctcatccacattc

SEQ ID NO: 33020 - DNA, 162 bp, Chlorella protothecoides
ctgcgagagagggtgggaagaggtactgtgtggtcggggacccggcgcaggccgccctccccgtgcccagggactccgttgctgctcaggaagaggacccctccccgattccgcctcttcccactccccacgcacgcgcctgacgggcctggcgacgcgcgc

SEQ ID NO: 33021 - DNA, 77 bp, Chlorella protothecoides
gatgcagcgcttggccacggccagctcctgtgggatgtgtgatgttggttgaggggggggggggggggggggggggg

SEQ ID NO: 33022 - DNA, 61 bp, Chlorella protothecoides
gtggtccgtgactgtaccactggggtgtgtactgctagggatggttctcctggattgtcga

SEQ ID NO: 33023 - DNA, 61 bp, Chlorella protothecoides
gccagctccatagattcgcggaatggcagggctcatgcatggtatggcatgcttgaaatgc

SEQ ID NO: 33024 - DNA, 61 bp, Chlorella protothecoides
cacagccctcttcgtgccgcgcgattccccgctccatccctccccacctccacacaacaca

SEQ ID NO: 33025 - DNA, 85 bp, Chlorella protothecoides
gtgagtcgtgctgatggctgcatgtccaacaggacctggggaggagtgatctgagggcggacgaagacgcgcgccaggatggcca

SEQ ID NO: 33026 - DNA, 109 bp, Chlorella protothecoides
aggcccatcaggggagcacagacacaggtacgcgtcactctcgcgcccccctttcccccttcaccaccagcctcatcaatgtgcaagctcaccctcctctcgcgcttga

SEQ ID NO: 33027 - DNA, 61 bp, Chlorella protothecoides
aagatgaggcggagcggatgcgggagtcagggtgcatgggaatgcgtctggcagagcggtg

SEQ ID NO: 33028 - DNA, 87 bp, Chlorella protothecoides
tcgcgccggcaccagcgctgggggccggcgtggcgccaaacgacggggtggaggcgcctgtcggggctgctgccgccgctgagctgg

SEQ ID NO: 33029 - DNA, 77 bp, Chlorella protothecoides
gctgctctacaagtgggtgctcaatggggggtcccgagttggagactgggaacaggccaggcagatgggctagatgg

SEQ ID NO: 33030 - DNA, 62 bp, Chlorella protothecoides
gcgactactgctattacactgagtaaggacacgcgctaccggatcagtcattctcaacatgt

SEQ ID NO: 33031 - DNA, 116 bp, Chlorella protothecoides
ccacacgggccgcgagcctccacaagggggcagggacctgccgggatacgcctgttccccgctggggaggatgcacttcatcatcgcaacatcgtctgctcatggcaaggccagcc

SEQ ID NO: 33032 - DNA, 61 bp, Chlorella protothecoides
cttcatctgtccccggtcctgcagctgcccacccgccgtttcgtgcacgccctgctggatg

SEQ ID NO: 33033 - DNA, 78 bp, Chlorella protothecoides
gtaggtggtgtcggggcggcgcacctcccatgggttgccctcgtctaaccagtagtcggggacctcgatctgataccc

SEQ ID NO: 33034 - DNA, 104 bp, Chlorella protothecoides
ctgggtgccatgcaggccaggggagtgccgccggacagcaacacggcgcggtccatgatagacatcctgcgtgcctccaggccggagctggatgcggccatgca

SEQ ID NO: 33035 - DNA, 68 bp, Chlorella protothecoides
aaaatgggggacagcatccgtatagagcactaacccctcaatcagtccttctggagtgacgattctcc

SEQ ID NO: 33036 - DNA, 1414 bp, Chlorella protothecoides
  modified_base (676)..(685): a, c, t, g, unknown or other
acccccccttccccccccttaggagaacggaaacctccacaacccccgtacctcctgcagggcgtagaacgcctcgttgatcccgggcatgagcaggcggttgacgatgaagcccggggtatcggccgacacgcaggtctgcttgcccaggcgcgcggccagggccagggaggcccgaaaggtgtcctcgctggtgcgcatgccccgcaccagctccaccaggcccatgatgggcacggggttcataaagtgcaggcccaggacctgggccgggcggcgcgtggcggcgcccagccgcgtcacggagatggagctggtgttagaggccaggatggcatgggggggggccaccgcatccaggctggcaaacaggcgcagcttcaggtcctcgcgctcgggcaccgcctcaaccacgtagtccacgtcgtgcaggtcctgggtgggggcgggatgggggaatggaggggggacaaaatgtcgatttgtttttcgggggggagaaggagggggaggggatggcgacttcagagtggggtcaggtcgactcatgggtgaggcctgggaccccaggtctggacagggaagggatgcccagatgcatttccccatgcaagcctgccaggcacctggccagcccaccccattccccctacctccagtgatgtggaggtgtacnnnnnnnnnntcagatgcatatccccatgcaagcctgccacgcacctggccagcccaccccatcccccctacctccagtgatgtggaggtgtacagccggcccagggcagcctccgcggtcaccgcatccacccttcccttggtcaccaggcgggccagggagctctctatgcccgccaaggccttatcaagggcctgatgggactgatccaccagcttgacagcgatgccggagctcgccaccacctgggcaatcccggcacccatctgcccagcacctatcacagccaggcgctgaggcaggatcgccatgatcagggtctcgcacttgattccagttagtcaatggaattctgccgcatcgggtctgacctcctgtcgatggcatgccttggcgtgcccatcgcgccgggcccccccccgcggaccaccgacacgctccggaaccaggttcaaaggagtccgcgggtctgatccctcccctgtgccatccaagccatcatccctgtcccgcagtcatcgtaacccgacatgcatctgctcagacttgcttcgagtgcagggtaggagggggtcaggcatgcatggaggcggccctggggttccgctgctgcaggaacctccagaaggaccacagcacgctgctgagcatgatgagggtgatgagccactcccagtcccccggcgatggagccggctgctgctccggtccggggccgtcgtcccacccgccgccccc

SEQ ID NO: 33037 - DNA, 61 bp, Chlorella protothecoides
gggaaagagggttccatcaggggactcaagacccacctctctcgctgaagcctagcaccca

SEQ ID NO: 33038 - DNA, 95 bp, Chlorella protothecoides
gggagggggggcttgggcgtgcttttgtgacccccaggggtccgtaaaggccagtttttccaaagttcctgatgccacctgcgctgcggcgacct

SEQ ID NO: 33039 - DNA, 80 bp, Chlorella protothecoides
cagcggcctgcttagcatgttttgtctctcactcggcctctcaggatgaactccctgcaagaccatcccaaaacattcgt

SEQ ID NO: 33040 - DNA, 112 bp, Chlorella protothecoides
ccgcgcgaccagcatggcatgcccgctggttgagctcgggaaccacgccactgatcaaaagatccacaggcaaagcatgtaccttgtgtccccgctccgcagtccctcttcc

SEQ ID NO: 33041 - DNA, 141 bp, Chlorella protothecoides
ctggccccgccgcagggtccttcaccaaaaccagcgcttggacacggacccccctgacaagcacttttccggcgcaagcatcttcccactctctgacattcttccatctcaaacacccccctgggcgtcacccccctccgt

SEQ ID NO: 33042 - DNA, 83 bp, Chlorella protothecoides
gtgtaggagaagtagacgccggggatgaagggcccattggcaaatgtgataaagggtgcctgggggttgaagctctggggcac

SEQ ID NO: 33043 - DNA, 66 bp, Chlorella protothecoides
gggacctggtggatgggtgctcgggatgcttgggatgaccgacccgggtggaggaggggcagctgg

SEQ ID NO: 33044 - DNA, 88 bp, Chlorella protothecoides
gatgaggccaaagacatccttctcggccataccacctccacccagcccctctcctccacccccaccaccacgtgcgagcgccacaatt

SEQ ID NO: 33045 - DNA, 78 bp, Chlorella protothecoides
catgcacggatccctcttcctggacgatcgattgcattgttgctgagtcctctccaccatgtccctggcgtagcattt

SEQ ID NO: 33046 - DNA, 68 bp, Chlorella protothecoides
cacaaacaggcggaacgacagcagcccggtgaaagctgctttcacatctcgcatcacgagagcgacat

SEQ ID NO: 33047 - DNA, 104 bp, Chlorella protothecoides
ttggttgcggggggagggatgctggctggggtatgacatatgaaatgcacgtcggttcacatgccagctgcactggcacttcatggcctccgccatgaccctca

SEQ ID NO: 33048 - DNA, 73 bp, Chlorella protothecoides
aggtttgcccggaccacgggcgcacctgtactactcaactgataaccagtcctgtgcgtgtgttgaagagctg

SEQ ID NO: 33049 - DNA, 61 bp, Chlorella protothecoides
tgtccactctcagtgtgcgtgcgctcgtactcgaggtctgggttcgaatgggagcccagcc

SEQ ID NO: 33050 - DNA, 98 bp, Chlorella protothecoides
ctcatcgggttcccaactccatgcacgtcagttcttgcggaatataatctcttgcaagcacatccagtccgttgtcgcagtgccatgcgtgcgatcac

SEQ ID NO: 33051 - DNA, 61 bp, Chlorella protothecoides
gagggagaagagtgatgaggtcgctacctatagatccttatctttgctaacatcatgcctg

SEQ ID NO: 33052 - DNA, 214 bp, Chlorella protothecoides
ctggagcccgtagcggaatgccacaccatcaagcagctgcaccgccaaatccaccgacggctccttcaggaaggtcaccagcccgtcacccttgggcatgccattggagtcctggtagatcttgatgcggggttgccgctgcaatgtagtagcaatgttccgagtgggtaagatatcccattgaatgaggattgcactcggagggaagccttgc

SEQ ID NO: 33053 - DNA, 61 bp, Chlorella protothecoides
ttgggggagtgctggggagcgggggcagggacccccgccccgcggctgccaggctgccagc

SEQ ID NO: 33054 - DNA, 111 bp, Chlorella protothecoides
ggattgcggggactgacttggacctctgctctctcgtgtgcatgagcgttggaaggaactcatccctcgctcctccccatgcgcgccacagaccatccgcatccagctcga

SEQ ID NO: 33055 - DNA, 61 bp, Chlorella protothecoides
gtgcagagagttgtgggtgcaaagcttcccctaaacccccccccccccccccccccccccc

SEQ ID NO: 33056 - DNA, 119 bp, Chlorella protothecoides
ggttggctcatggagcgtccctggctgattgaagggcgagagaagcatgggagaaggctccatcaagaacccagcgacagtgccaccactagtgcattgagggagcgactgtaccagcc

SEQ ID NO: 33057 - DNA, 118 bp, Chlorella protothecoides
gcactggataggtatgcagttagatttccagacattattccaagcgggtcctgccttcaggattcccattctcccggtcacacacaaccaacactcttcctaccccgaggatggcccc

SEQ ID NO: 33058 - DNA, 6693 bp, Chlorella protothecoides
  modified_base (581)..(590): a, c, t, g, unknown or other
  modified_base (1058)..(1067): a, c, t, g, unknown or other
  modified_base (1554)..(1563): a, c, t, g, unknown or other
  modified_base (2539)..(2548): a, c, t, g, unknown or other
  modified_base (2961)..(2970): a, c, t, g, unknown or other
  modified_base (3307)..(3316): a, c, t, g, unknown or other
  modified_base (3497)..(3506): a, c, t, g, unknown or other
  modified_base (3681)..(3690): a, c, t, g, unknown or other
  modified_base (3822)..(3831): a, c, t, g, unknown or other
  modified_base (4043)..(4052): a, c, t, g, unknown or other
  modified_base (6056)..(6065): a, c, t, g, unknown or other
accggcacgcagcaccaccacgcgggctgcatgccgtcgcctcgacctccatcccccggtgcatgcccactcgtactacacccatgacgcaggcggcgccaccagatcacgagcgtctggtccgcgggcggccaccaggcctacctgcgcggcagcaacgaggtgctgaccgcccccaaccgccgcctggtgcccagcctgtcccgggacacgagccaggcggaggccatggcgcagcaggacctggcggaagctcgggcgcagctggagcagcagcgggcagaggagcgcaggctggcgagcgaggcggcggcctgcgccgccctccgccaccaggcggaggcgggcatgcaggttggtagaaaggggagaagggctgggagtgaggggttcgggtgtcaggcactccatgcaggcgtcgctgcggccgccgggctggaggcaggcgccgcctcgacactcatcggactgatcgccgctcctgccccactgtgggtctggttggccacgcgggagccccacccaccccggccccgcagcaagcgcgggagcacttgtcgcagctggagcaggggttggcnnnnnnnnnnctgccccactatgggtctggtcggtcacgcgggagccccacccaccccggcccgcagcaagcgcgggcgcacttgtcgcagctggagcaggggttggcggatgcccgtacacaggccgaggctgtgcgggaggaggcggtggccggggagaacgacagccacggtgagggtgtggcgtgcggtgggcggagctcatcccagggaggggtggattgagttgcgagggggatgcactggcatggcgaccccgagcgtgggggttgaacggtccctgcacgcctgacccagcacagcacaaccggagggctggaggggccgtgcctccgccggcgctcgctgcaccgcagtgaggagcggcagagcatgcaggacgctggttctgcctgccaagcagtagggcagcctcatcggcggtgccatgtagaggtcgccacgaccccccccgctcaaggcccacctccctttccnnnnnnnnnnatctgcctgccaagcagcagggcagcctcatcggctgtcccttgcagagatcgccacgacccccccgctcaaggcccacctccctttcccaccccgcagccaagcgcctggcggagctggccagcgacatcgccagcagcgccgcgcaggccgaagcccgccgcgatgcggtggctcgcctggaggctgcgcaggcggagctggaggtgcggtggcaggaggcgcagggcgccgccccggccagcgcgcgagagctggagaaggcgcagaccgtcatcgaggactgcgcccgtgagagggccctgtgccatgaaaaggtttggtttctggttgggggtgttgggtgggtcgggggagggggtgatgtgacgcgaggcagggccatggtgaggcacgcggacctgcagggacgcaagcgatggggtggttgaagcgactcatccactcctgcccccacgtcgactcatgaaggagacagaggcgtggnnnnnnnnnnagggtggtggaagcgactcatccactcctgcccccgcgtcgactcatgaaggagacagaggcgtgggcccacctggatcaggtggagcagagctcggagcgggcccaggaggtgctcgaccagctggaggcggtgctgatgcagcagctggcctcggccgagcaagtgtgccccctggccgagggcgaggccgcgctggaggccctcacccgtgaggtcggcgagagcggggggcccaatctcggtgcgcgcgggggcggtgggacgccgggagaagcgaccgaccctgcagcgccagaccccaccgccgccgacccgctgtccacctgtgcgctgctggcatggctgacccagctgtccgcccgcatcgcgcggcgcgagcgggaggccggcgcggccctgggagacctccagctggaagttacgcgcggcgagcggcgcctggcggccatgcgcggcgcgcacgcccgctccgacgccatgtgctcgctgctgcgcgcaagcgcgcgagaacgcgtgaagaagctgcgccggctgcagcgcagcgtcgccacactgctggaccgccacttcggtagctacctgggcatgcgcgggcacgcagggtcggtgaccgtggactacgagacgcggcggctgcgcatggaggtgcacatcgccggcggagcacgcgtgaccgacatgaacgcgctgagcggcggggagcgcagcattgccaccgtctgcctcatcatggccatgggtaagaggggggtggttgaaaaggggttgtttttctgcttccaggggtgagggtgagggtgggggtgaggagagaggggatggggtgccctgggagggaagagcatggtgtggtgcaggagtttatgctagagaccactccacctggacacgggcatcaatgtatgtgtctcagtctctgagtttgccaaaatttagcgacccgcctctccctcccaacttcttcaccctctcnnnnnnnnnnggggggttgttgaaaaggggttgtttttctgcttccgagggtgagggtgggggtgagggtgggggtgaggagagaggggacggggtgcgctgggagggaagagcatggtgtggtgcaggagtttatgccagagaccgctccacctggacatgggcatcgatgtgtgtgtctcagtctctgagtttgccacgattcagcgacctgcctctccctcccaacttcttcaccctctctatacacctgcaggttatgtgggtcagggcgcgcccttcagctgcatggacgagtttgacgtcttcatggacgccatcaaccgacggtgagcgccggggatgggccggtgtggggccggtcctggaagggccaccatgtgaggagctcacctccgcagggcaagggagcacggaggcttnnnnnnnnnngtcaaccgacggtgagtgccgggggataggccggtgtggggctggtcctggaagggccaccgtgtgaggagctcccctccgcagggcaagggagcacggaggctccgtgcaggtgtaggagcctggacacgccatgggacgcacaatagccccctttgttccctcttttgaccaaggtttctccccctttcttcccacagagtcgccctccagttcctgctcgagtttgcctacaagttccaagaccggcagtttatctacctgacgccacaggcgagtgcagcaatgggaaaggcgttggggatacgggccagagtaggagcctggcaggtgcatnnnnnnnnnncatctacctgacgccacaggcgagtgcaacaatgcgaaaggcgttgggcatgcgggccagagtaggagcctggcaggtgcatgcatctgcatggactgccagcacttatcagcactgcagatcctcagagtccgcggaacgactatgaaacatcggcaggattgcgcctgctctaccgtgnnnnnnnnnntagcactgcagatcctcggagtccgcggcatgactacgaagcatcggcaggattgcgcctgctctaccgtgcccgcattccatcacctgaccccgccctcctgccccgttccctgaaggacctcactgctctccatgaggccgaggagaacctggtggcaaccaaaaagatctcnnnnnnnnnntaaaggtgcgtgaggcagtgcagctacagtatcacgctggctacaatctttcaatccttctcagcttccgtaaacccacttcaggtcgtctcaggatcactccaggagtgttgttcaggagcacactcgtcnnnnnnnnnntcttccccctggttttctccggaccgtgcgcatgcgggcccctcgctccgaagcctgatgatcatgtcagggccgaacggagtgggatcgggccgtgcaccttagtgcggttgtactcgcaaggctgttgattcggtattgagtttctaggactgtaccgagcctccagagccattgtggtgaattggcaggtacatagtgtcccggacagnnnnnnnnnnatgtcccgagccaccagagccattgtggggaattggcaggcacatagtgtcccggacagcactgttatgaagatgtttaccagcagctgatgttagtccctgactcatcgtgaagcctcgatgtacagaggtgcgtgaggcagtgcagctacagcatcacgctggctaaaatcctgcaatccttctcagcttccgtgaacccactccagatcgtctcaggatcactcccaggagtgttgttcaggagcacactcgtcaacaggagtgatccaaatgtttcccgccaaaagatggcaccctcccccgcactccatgccgcgctctggcaagctcttgagctgaatctgtctcgagtgctcaatccggcgcgagtacaggcagagaaccaatccgcacattgacgccctccctgcagtcccccagggatcccacgacctcgctgagacaggccaccagcggcggcagtgcgcccctggcccgcacccagccatgtccctggctctgaagcccgatgaggaaaagatgttcgagggccagccccagggcttcccatttggcgactttgacctggaggatgtgatgctgccggagggtgatgacgacttcgggttcccaagcgaggaggaggaggaggaggaggaggacgcccagaccgagtctggcttcgccaacgtgctgggtgaggggatgtgggggtattgtgtgtgggccctcctgtgcttcgcctcctgccggtgccgatcatgcggccccgaggcccacccccttggctccacaccccctcccctcccctcattcccccccattcacatacacacagtggtggacggcgtgcccaaggtgtcccaagaaaagtaccagaagctgaccagcatcctgaccaagatcctgagcggccccggccacatccgcgagaacgggctgtggcaccccgtggacgaggccaccggcctgtccaagggctgcgtgttcgtggagtacgagacccccgaccaggcccgcgccgcgcaggccgcgctgcacggctacgcgctggacaaggcgcacaagttctccgccacgctgtacgacgaggcggagcggctggctgccgtgcccgacgagtacgtggcccccgagccgcgcgacgccccgccccccgagaaccagtggtcctggctgtcggaccggcgcgggcgcgaccagttcgtggctcgcttcggggacgagaccgagatctactggaacgacgtggccaagcagcagccggaggacgtgtacaaacgctccacctggaccgagctgttcgtgctgtggacgccgcgcggctcggcgctggccacgctgcaccgccagggggtggcgctgtggggcggcgactccttcggccgcctcatgcgcttcagccaccagctggtccagcgcgtggccttctccgccgacgagcgctacgcctacaccttctcggaggtgccgccggcggggccgcgcgacccgctccgcttcctgctcatcgtctgggacgtgcggtcggggcgcaagctgcgcgtgttcgaggggccgcaggccgagttcgccgtcggcgccgccgcgcgccccgacggcggcctggcctgggacgcgttccgctggtcggggggcgccgcgcccggcgcgccctccttcctggcccacctgaagaagggtggggtggcggtgtacgagagccccgactttggcctggtggaccgcaagtctgtcaagctggacagcgtgcagagcatcgagtggtcgcccgccgagccggtgctggccgcctaccaggtggaggagggcaacatgcccgcgcgcatcatgctcatgcgtttccccaagaaggaggagctgagggccaagaacctgcactccgtcgccggtagggagcgtgtgtgggtgtatggggggatggtggagggggaggaaggggggggccggtgaatgggaacggatggatgggtggggacgatgaaaagaatggatcatctttgccgaggccctgtcgtgggnnnnnnnnnnggggagcctgtgtgggtgtttggggtggtggtggagggggaggaggggggccgcggtggatgggaacggatggatggatggggacgatgaaaagacaggatcatctttgccgaggccctgtcgtgggcggtgtgacttgatggcgttcgattcaaacaccgtctccactatcccccttccctcacacactcaaatagctcccccacctgacctctgcaggcgtgcagctgagctggcacccgcagggcgacttcctggcggtggcggtggagaagtggaccaagagccacaagtccaccaacacccactttgagctgttctcgctgcgcgagcgcgacacgcccatcgacatgctggagctgcccaacaaggcggagaagatccacgagctggtctgggagccgcgcggcgtgcgcttcgccatcctgcacggcgacggctcgcgcctctcggtgtccatctactccatgcgcgacggcaagctgccgggcgcaaggggtgtcgcgcacctgcacaccctggtcaacaagcaggcctcctccctgcactggagccctgcggggcggttcttggtgctggcggggaccaaggtgtgtgttggtttgagcaagggggggggggggggggg

SEQ ID NO: 33059 - DNA, 72 bp, Chlorella protothecoides
cagcacactgcctccatgccagccttgcatgcatcatgccccaacccgcaaggggtgcccagatcactccac

SEQ ID NO: 33060 - DNA, 113 bp, Chlorella protothecoides
ggtgtggtgtccagagggtcactgcgaccctcgaaggcgcacatgcaaaactagccccccaacagcagaacccatgcgcgccgacatcacgtcacccacgcatgcataccttc

SEQ ID NO: 33061 - DNA, 78 bp, Chlorella protothecoides
gcatgggcaatggaaggggcctggtcgcctcctgctgcacggcccaaagcgccggaggcgaaagggtgccgctccgcc

SEQ ID NO: 33062 - DNA, 77 bp, Chlorella protothecoides
ggaccatgtgcgacttgccctcgccccagtgcaggcactgtcaggcgcctgtgccgatctagcacatcagcggctat

SEQ ID NO: 33063 - DNA, 101 bp, Chlorella protothecoides
ctggagtcttaagagagagagcatgcgatgggcagcgggcaggccaaggctgactgcagcacggcgccggtcatcgcatggggggcaggagacatgtcagg

SEQ ID NO: 33064 - DNA, 61 bp, Chlorella protothecoides
ccatgttcgaagaatggctccaccatcctcacccctccacatcccatagattcctgtatac

SEQ ID NO: 33065 - DNA, 73 bp, Chlorella protothecoides
gtggcgccccctggcgttgcaaaaggggagggagtggtgggcggcacagcacgcggatgactggttgtgagcc

SEQ ID NO: 33066 - DNA, 68 bp, Chlorella protothecoides
ggaagcacatcctcacaggcacccttcccaacagtagattcactggcaccagtgtgccccagccacgc

SEQ ID NO: 33067 - DNA, 93 bp, Chlorella protothecoides
gatcgggaatgcttacagctgtctggaacatgttgctgcggatggagtgcagcggcatgcgctgcagagcaggtgccgaataaccagccaccc

SEQ ID NO: 33068 - DNA, 108 bp, Chlorella protothecoides
gggaatgtgtggtcggtgagcaagtgcctgagtctagccattggggtgaggggtttggggcccgactcccaccctccagctctcaacatggcctctgcatgacgctgg

SEQ ID NO: 33069 - DNA, 123 bp, Chlorella protothecoides
tgcagccacctcggctgcgggcggcatggtgaagcgccgggaggtaccttcctgaagagaaagcacagtgattgtggattagatggaaggagacgcgcatgcatgtggaggattcagtcctga

SEQ ID NO: 33070 - DNA, 6602 bp, Chlorella protothecoides
  modified_base (145)..(330): a, c, t, g, unknown or other
  modified_base (1541)..(1550): a, c, t, g, unknown or other
  modified_base (1986)..(1995): a, c, t, g, unknown or other
  modified_base (2362)..(2371): a, c, t, g, unknown or other
  modified_base (3050)..(3059): a, c, t, g, unknown or other
  modified_base (3138)..(3147): a, c, t, g, unknown or other
  modified_base (4198)..(4207): a, c, t, g, unknown or other
  modified_base (4442)..(4451): a, c, t, g, unknown or other
  modified_base (4509)..(4518): a, c, t, g, unknown or other
  modified_base (4580)..(4589): a, c, t, g, unknown or other
  modified_base (5456)..(5465): a, c, t, g, unknown or other
  modified_base (5604)..(5613): a, c, t, g, unknown or other
  modified_base (5885)..(5894): a, c, t, g, unknown or other
  modified_base (6440)..(6494): a, c, t, g, unknown or other
catgccagtatgccactccatagctgcattggaatgaatggtcggacaggctgaaagtggatgaccacatgctcttgcagggtccaatgctgactgtgcatgccaaatcacaccgcccttcctcaagccaccgtactgtgcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacagcctgggtgtcatctaggcaccacccaagaccagcccatcccccagcccccctaccttgatgagtttccgcaggtcctcgatccgcatggcagggctgacttccagcaagaaagggccaccgctgtgtcgcccctcgctgtcgacattctcgccatactcttcctccgtgtgctgcaggggtgggaggggggttgtccatctagcattccaggcttgggcaagatcttcaggtacacaccccatctgcaccccgccctcaagctggaagccaccatgccatgtccctcaccagctcgctgatgagcggtatggtgatggtgggaaggcctgcatacttgtctcccgccgcaacgaagccgtggggcactccagactcgtatgccgctttgcgatccttctccgcttgctccgcagtggggttgtacattggcttccactctgtttcatgggagtgcgtggcgattgaacccccggacagcattttgactgtacaaagttgagctctgcagcacccctcaggatttgctgcaccagtggggccccagtgagcatccaagggatgctcctatctctgccacccagggatgacggatctgtacctgagagctgtccaccatctgcttgcatgatgggaacgtacttctcgtcctcgctgtagaacgggtagttgttcggggggaccgccatgtagccggtccggccggtacctgaattgcaagtggggaacggtgagcaccccgattgccggtcgaagggttgcatcaagccattctacttacctggggtggggttgtgcttggtcacggcatccgtgctgagcaccgcgaggtcggggtaatcggccctgagtgcagacatggccgactcatcccagacggctggggggctcgtgatctcagtcattgctccctactcgctcattgacagctggcgaagcgcacgatgcgcactgggtaatgttgcgaggagccagggattccaggcacccacctgggcaatttgagtcaacggcagtacatcgctgctgcaagtgcagtacaacctaggaatggtccccaagaatcgggtattcgcgcggctttcgagcacttgcaatgctcaagaggagaaggagacagtatatctgtcatcagagtgacctcagctcctttcggcacacttgtctgagcgacgcgtgaaaccaatagcaccagtggaggcttctnnnnnnnnnncctgtcatcagagtgacctcagctcctttctgcacacttgtctgagcgaagtgtgaaaccaatagcaccagtggaggcttctgctgaaggtaggaccacggacacccgcgtcacatggcttgctaaacccccctctgacatcatgctcgtccagtttaccaacattttggtctccgcatgtcccttgaccgatcctgtaccaaatgatgctattacggcttgcaatcaattgctggccgcagcttccttacagcacgggtgaacctcaaactccgtttccccatgacaaagtaccaacttacaaatctacagactgcgattccctcatctcctccatcagagccagggttgaactgatctacagccgattcacagaatcgatgtatttctttccccccccttcctaataagggataaaccgcgatcttgaccaggnnnnnnnnnngcaggtgaacctcaaactccattcccccatgacaaagtattaccttacaaatctacagactgcgatcccctcatctcctccatcagagtcagggttgaactgctctacagccggttcacagaatcgatgtatttcttccccccccctcacaataagggataaaccgcgatcttgaccagggcgcgaacgtctccgtcgctcatgcaaacccaggaattgacatccgactatattattgcaaaattcgcatctcaaatacttgtatcgtgctgctaaagtgaatagcggtggagagtacaagcgccggatctcgtagcctcacgaccccttgcagtgctgctcagccagcaaaacccagatcgttgtnnnnnnnnnnatcaaatacttgtatcgtgctgctaaagtgcacaacggtggagagtacaagcgccggatctcatagcctcacgaccccttgcagcactgctcagccagcaaaacccagatcgttgtctggatggaattcttggccggcgccctcttgataactcttccacgtgacaaatccattcctttgggtgccggagctgtgctggctaaggcggtggatggcgctgtccgggcggtgaccaagcctcgctccgcgcacgctgcagcgagcatcgagcaggctggcgcccaggcagtgacgctggtctgggatcgcctgacttgcatcttgaagacgaagaatgggcaggtcagagccctgctgcgtgacatccagggcacggcaaggcccgggaggtgggcttggattggggaatgatgaggcaaaggggcgactgtacttgcggggatggatcgggcaagaggcaagcagacaatttggaagctctgccatgcatcacgtgatgcttttacaaactcagtcaggtgctgtgaatgtattcctgccaagctcatccatgtacaaattcattggcgcccaggttgctggccatcctcgggcccagcggggccggaaagaccacactgctgaacatcctggccggacagctgccgttcaacaaaaacatcgagctgactggcagggnnnnnnnnnncgctgtgaatgtattactgccaggctcatccatgtacaaattcattgtcgcccaggttgctggccatcctcgggcccannnnnnnnnnaggccgctggacagccttctgggccacgtcggctttgtcgctcaggaggacatcttttactcccagcttaccgtcaggtacctgagctgtttggtttgagtgttgtggggtgatgggtgcatcacggcgccctttgcctcgctgactgggcttagggagctccgccggcagccaaagccgtggcctgccatgtgcatagagccagtgctgtgaccgagatcgccaggcttcggggcatgctgtctaccacacagcaacatcggcgcactgccctcactcctcccagggagaccctcctcatggccgcccagctttctaatggcacctccacggcctcggagagggagcgagtcgtggatgatataattgctcgcctgggtctggccaaggtcagggccacgcgcatcggcgacaagaagacgcgcggcctgtcggggggcgagcgcaagcgactgagcattgcagtggagcttatcgcccggcccaagctcatttttgcagatgagccgaccacggggctcgattccttccaggcccacaaggtgattactcgggtgtactggggttggaggaccaggcgggctatggtgagggacttggggaccgcgcaacctgtgccttggtctctctgctgttggtgggagagtgtgggttgcttagtccacaggtcaaccagaacaaacctgctgatatgcagaaacctgcgcgaacgccgagccctccaccccatgcgccatctgacaggtggtggaggcgctgaagcagctggcagaggaaaaccacaccgtcattgcctccatccaccagccacgcagctccatctacaccctcttcgacgacgtcatcctcctgtctggtgcacatggactcgaggctgggtcgtgaaccggggtctcgcgacacaggcacactaccaagtgtactgtgttgaatgctgacgtttgtttgcagtgatgggttgaaatcaaacgttgtcctgaagcaagcaaccacctcccactctgactgaagacctctcccaccattccctgcctcccaacagagggagagnnnnnnnnnnccttgaatgctgacgtttgtttccagtgatgggttgaaatcaaacgttgttctgaagcaagcaaccacctcccagtctgactgaagacctctccgaccattccctgcctcccaacagagggagaggtcctgtacgcgggggaggcagatcgagcgctgtcctactttgatgcgcaggggcatcgctgccccaagcactacaaccctgcagagtaagatgggtttgagattgaggnnnnnnnnnnaggtgcacatgggctcaaggctgggttgtgaaccggggtctcgcgacacaggcacacnnnnnnnnnncaaggagactgcggctaggaaccgcccatgaactgggatgagatcctgtccggcaccagttnnnnnnnnnngaaggagaatgtggctaggaaccgcccatgcactgggatgagatcctgtccggcaccagtttctccatttgtatgtgcatggatgctgcctggtatttcaaatttcacctgtgaaatagcccgaccaccaaggcatttcccctcttcccaaagattcctcgctgacctggcggccgtggaccacagctcccccgacgcggaggacagcagccgctcccgcgtccggcagctggccctggcatggcgcgctgaggccggctcgcgggcactcgccgacggccatggcgagggagatgcggtgcccgctcagctcggcgcgaggaagggcggcggcggcgcgcggcacctgggcctcctcttccgccgctccctccgacaggtgtgggagagggagtgaggaagggttacagtgggagcatgtgtgtgactcagatggaacccgcttgtgatgtagcgccagcggtgggggtgtcggcacacccgcgtgaagtagtcgatgagcatgctatacgtaatgaccattgtggttccgcctgtcacagctctcgccgggtgccttgaaaagcttccatgtaaattttccaaccgtcttccaagtgaatctcacccgaacctccgcggtacctccgcacaggtactgcgggacgtacccaccctggtgtcgcgcgccggctcccagctgtcctccgcggcggtctttgcgggcatctactggcgcatggggctggacgagtccaccatccaggaccgaacaggcctgctgcaggtagggactagactttctctcaagtttggcttgcattactttggggctgctgtgatgtggtcctgcgcagcaggcggctgggagcgggggggcccaggtgnnnnnnnnnncacgagtccaccatccaggaccgcaccggcctgctgcaggtagggactagagtttctcttgagtttggcttgcattactttgggctgctgtgatgtggtcctgcacgacaggcggctgggagcgggggggcccaggtgnnnnnnnnnnggtgggagcatgtgggtgactcagatagcccccgcttgggatgtagcgcccgcggtgggggtgtcggcacacccacgggaagtaattgatgagcatgccatacgaaatgaccattgtggttccgcccgtcacaactctggccgggtgccttcaaaagcttccatgtacatattccaaccgacttccaagtgaatctcacccgaccccccgcggcacctccgcacaggtactgcgggacgtccccaccctggtgtcgcgcgccggctcccagnnnnnnnnnncctggagcgatccctggcaacagcggcacgtgtttgatcccagcctcgaatgcgtgctgggtgccgggttgatgccaattctctgctggcccctgatgccctaccatgccgccatgaccccagcgggcgtcccccgcgacttcccttcaggtggccacccctgcccactcacagtcccccattcccaccccaggtctgcgcggtggggacggccatgagctccctgatcaagacgctcaatgtcttcccgcgcgagcgcgtcattgtgcagcgcgagcggtcgcgctacaacatgcccgcctggccctacctcctgtccaagctggcggcggagctgcccgtcggcgccctcttccccgccctctttggctgcatcgtgtaccccgccacggggctcaacccgagcatggccaggtgctgggtctatttggaaaggagggaagcacagtcgtactgaagggcagtgatagcgaaaatacgaatatgttgccggggggccttgggcagggcaggggccacccgatcgctttcttggcggcgctcgcnnnnnnnnnnnnnnnnnnnnnnnnnnnnnnnnnnnnnnnnnnnnnnnnnnnnnnnttttcaggcgtcaatggaatggttcggcttctcctcctgccctctcccgcgacctccagtttccccacttttgcccttaggttttcacgctttcttgccgtgttgacg

SEQ ID NO: 33071 - DNA, 93 bp, Chlorella protothecoides
aggacggccagctggcggtccacctgctccccgcacatggccctcgccttctcgaccccgcctggctcgcgcagcagcgcgcgcacgcccgtg

SEQ ID NO: 33072 - DNA, 63 bp, Chlorella protothecoides
gggatggcaaagtccaggaaatatccaaagaggactcactctcaggcatggccctatgcacac

SEQ ID NO: 33073 - DNA, 72 bp, Chlorella protothecoides
atgatgcaaggcaagaccctctgacgctgccgggagcatttccccccaatcagtttggccggcagcatccag

SEQ ID NO: 33074 - DNA, 351 bp, Chlorella protothecoides
  modified_base (91)..(264): a, c, t, g, unknown or other
agtggtcgggcgctcagcagctgctctatgcacagcggagagggaatgcacccgcccagtcaaggccctgtccctgcacaccctgcgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatagcatgccgaggatttatctggcattttgtaggatagtgggttgggacatgcttctcaccctttcgaaaggccaaggcggtc

SEQ ID NO: 33075 - DNA, 61 bp, Chlorella protothecoides
ggaatgcgtaccgggtgcttgagaccagccacccccccacatattacctcccaccctctga

SEQ ID NO: 33076 - DNA, 81 bp, Chlorella protothecoides
agccaaggagcggatggtaataggcctcgatccacaacggtgctcgccataatgaatgcgtgtaccacacacaatgacgac

SEQ ID NO: 33077 - DNA, 61 bp, Chlorella protothecoides
caagaggacgtccaagaggagtagtgcctctgcgattaatgccattacagcacagactgta

SEQ ID NO: 33078 - DNA, 111 bp, Chlorella protothecoides
aaagatgcgcaggagtctgatggggaggcgccggagggccccaacacgctgccgcccggcacaccaccgaccgcctcgatccagggggaggtgccgccgcccgcggagagc

SEQ ID NO: 33079 - DNA, 116 bp, Chlorella protothecoides
tgatggcccaggcagatgctcagccgcacgccgcacccctgccccacaccctcggaccgagcagcaaggggcttactgcagtcccacgccgggtcctgggcgacgtcaccaaccgc

SEQ ID NO: 33080 - DNA, 64 bp, Chlorella protothecoides
cccattcccaccccagacgcatgcgctgcgccatccctacccacacccaccccctgccgtgcgt

SEQ ID NO: 33081 - DNA, 78 bp, Chlorella protothecoides
atgtccgaggggtgtgcgagtctgccgtccagtcctctaggcggggcctcgccgccgcccgtgatgctgatcatgata

SEQ ID NO: 33082 - DNA, 584 bp, Chlorella protothecoides
  modified_base (304)..(454): a, c, t, g, unknown or other
ttgttgccgcaccgcttggtgtcccacacgaccaccagcttctcctcgccgttggggacccgcacgtactggtgggcgtgcagggtggcgtgccaggcgcagcacagttttgaggtcctgtgctcgtcgaccaccaccaccccgcacacccgccgcaggtgccgcaagaagcgtatccaaggccccggcgggggccccccgcatgatgcccccccggtcctgggccgaccagttgcccacgcccacacccgtagtcatgcccggggggccgcagaactgctccgccagccggttgatggcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgggtcgggcacctgtgggaagggggtgggtggggttgagcaagagggttggtacggttggagcgattcgaggtgtagtgacacagtgcccgcccccgcaaggcatacccctgcattatctctacaa

SEQ ID NO: 33083 - DNA, 61 bp, Chlorella protothecoides
cagcgcagggactcctgctccttcaggcaatcaaagggcccttctcacctgccaacccaca

SEQ ID NO: 33084 - DNA, 61 bp, Chlorella protothecoides
ctccgcgggcagcgcgccgcccggcgagtccggcgccagcatggcgcccagctgctgcacc

SEQ ID NO: 33085 - DNA, 72 bp, Chlorella protothecoides
tgcatgcatgctgcggtcatgacgccatcacgctctggtacaggtccgacaccacgatcgtattgccacggg

SEQ ID NO: 33086 - DNA, 75 bp, Chlorella protothecoides
ttgcccatgtaccatgctcttttgttccccctcaacccacccccgcgcttgtaccatcgcggtggcccttgtgaa

SEQ ID NO: 33087 - DNA, 95 bp, Chlorella protothecoides
cccccccctctctcaacccccccctcccccacacaatcattcgccaggcaatggcgtttggctccgaccgctcccgcttcacggaggtcaagcgc

SEQ ID NO: 33088 - DNA, 80 bp, Chlorella protothecoides
tccggaaggcacgcgggctcgggggattgtgtagagagggggaggggggagggggagggggtggcagacctccatcccct

SEQ ID NO: 33089 - DNA, 111 bp, Chlorella protothecoides
agttgcctgttacccacgcttgcgatagatcgcctcggcacagatgagccgacacgccgtattgatgacttgtctcaccactaaccagggtgatggcgtacctgggcaaac

SEQ ID NO: 33090 - DNA, 412 bp, Chlorella protothecoides
  modified_base (104)..(267): a, c, t, g, unknown or other
gacgcccaagtggttgtgcatctcatgctagctgcccgtctagtcaatctgtgggttaaatgttatgagtgacaagcgaggcccctacacaagtggtgtactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcaagttggattggcgagggaagcatggtacagtggagcacaggatgcataatatacacccggcctggggctggcatcccttggacccctccccagatcatgggaagagagtccgcagctgacaattgagacggaactggag

SEQ ID NO: 33091 - DNA, 68 bp, Chlorella protothecoides
tttcaggccatgcacgatgcggaaggtgggtagaaggttgttgtcaggtgctgcggccagggtcggtg

SEQ ID NO: 33092 - DNA, 254 bp, Chlorella protothecoides
aacgaagcccagggaatgcagggagcctagaagtcagtacatggacggaaggggcgtggcattgaggcagcattacagggacggcagtttgctagccggcaccatctcagatgtactctcggaaacgtggagtggcagtcgcacaagagggcgcgaaagtgccacgagcgcgctgccccgaagccggaccccatgcgatcgaagggcatgtatgagtgcacggttcccgtcacatgcgttccaaaacaacctca

SEQ ID NO: 33093 - DNA, 61 bp, Chlorella protothecoides
gggtcggcggtggcggcctggcggacgcgggcgcgcatgggctccgccgtcagcatcaggc

SEQ ID NO: 33094 - DNA, 77 bp, Chlorella protothecoides
ctgggggggacagcgtgggggaagaaaggggtgaacggctcccggggtcagcgtgacacgagaccacagtgcagcca

SEQ ID NO: 33095 - DNA, 80 bp, Chlorella protothecoides
gatcaaggagggcgcgcgccggggaaaaactaaggcggtgcatctgcccgttgcgtgcacgccgagctccatcattgcaa

SEQ ID NO: 33096 - DNA, 61 bp, Chlorella protothecoides
gtttgcggtgctggtggccaccgacgtcgcagcgcgcgggctggacatcaagtgcgtggag

SEQ ID NO: 33097 - DNA, 79 bp, Chlorella protothecoides
cgacataatgccctcatgcggtgaggatatgttgtgaagcttccatggaggcgacaggcaaaggatcttgcctggcacc

SEQ ID NO: 33098 - DNA, 61 bp, Chlorella protothecoides
cgctgagccaactgccaggaaacaagatgccgctgagctatctgccaggaaacaagatgct

SEQ ID NO: 33099 - DNA, 61 bp, Chlorella protothecoides
gtggtgaacgatgaagttggtcacgctctgcactctgtgcaaggcaatgagcaatccgggg

SEQ ID NO: 33100 - DNA, 61 bp, Chlorella protothecoides
ctacggcgactccgtcatcctggactacctcgcctccaagcgcatctccaccggcgacctg

SEQ ID NO: 33101 - DNA, 61 bp, Chlorella protothecoides
gagtgaagatggccatggcgaggtgaggattgagtgcgagggggagaagggacctctccag

SEQ ID NO: 33102 - DNA, 329 bp, Chlorella protothecoides
cccgctggccagggcggtgcggcacaggtggggagtgaaggtggcggaggaatgggggaatcgatcgtgaggcatgggccatggggagggtccaggtgcatgcggaggatctctcctggcggcaccaggactggaggtatggcagggtgtgatcctggcggtaagccccgccctggcaagaattcattgttgcaggcatgactggatgcacaggctgggcaatggcctctgcagccttccgcatgtgccacccacccacacttccccctctcacctgcggccacatgcaggctgaggcgggagcatggcatcgccgacggcgtgccggt

SEQ ID NO: 33103 - DNA, 90 bp, Chlorella protothecoides
tcaacctcaccggcgtcttcctcgtgcgcccgcctcatggggacctgttctgcctgccatttccaggacatgtatccgcgggtgcccatg

SEQ ID NO: 33104 - DNA, 75 bp, Chlorella protothecoides
tttgggggtggggaggaagggagcaggggttgaagaggaggggggtgtggctttttagaatgtcgagggggcggg

SEQ ID NO: 33105 - DNA, 71 bp, Chlorella protothecoides
tgctcgaaatggaatgtgtcgctcagtattgcgacttcagcattgatagcaggaggagcttcaccctgacg

SEQ ID NO: 33106 - DNA, 61 bp, Chlorella protothecoides
ccagtgtggtggcccccgtcgatcggcgggacgcacagatgtctgcgaggcttgatacaga

SEQ ID NO: 33107 - DNA, 61 bp, Chlorella protothecoides
cctctaaaagggtccgcgctggactggcggtgcatgttcaccaccaccaccccccgttggg

SEQ ID NO: 33108 - DNA, 125 bp, Chlorella protothecoides
ggacagtgctggagccgatccaaacggcctaggcaaccgacaaacaatccctccccactctttctctccccgcagcaaaggcagccaccatgacgcatcctcccaggcatacaaggctctgtata

SEQ ID NO: 33109 - DNA, 363 bp, Chlorella protothecoides
cctccttttcggctcctctgcgactgctatggctgctatcttgtgctggacgccatcccatgtctggcatgtctgtcctgtagcgaaacactgcagggtgcagaacctcctgcaacacatttatccgtgcagtgacgaagaagagtggttacatgacagattatgtactctggttagaattgcattgctcaacctgcgacaacgtctctggagaatgagagtcacggtttatcactgggaataatcgataaaggaaagggggggcgtatcagtgaagctgtatggcattcggcgagcacaattcttgggttgcagggctctccagagctatataacgacactttatcgtcggggtctgaaaaa

SEQ ID NO: 33110 - DNA, 156 bp, Chlorella protothecoides
ggggggtcccggcggtgaggagcaggggggtgagcggcggatgtcatgctagcaatggcaggacagggcgattgcttggctccttgcaccatgcggacaaaccaacaggggatgtgaggctgaatttgctggaaagtacatgcattcccccagcag

SEQ ID NO: 33111 - DNA, 93 bp, Chlorella protothecoides
gctggaggggctgagccgccaggcgttgacgcgccatgccggtgcgggccgcggcactcctgcacacgggttggaagggggctgctgaggggt

SEQ ID NO: 33112 - DNA, 61 bp, Chlorella protothecoides
aaacaatgaatcgacaataacaaaaacgtcaagtcccttgtcgtacctcgatcatgtcagg

SEQ ID NO: 33113 - DNA, 101 bp, Chlorella protothecoides
gctggacgaactaagagtctgcaccgacaatatcctcttgcaccaagcaatcttacacgaaatctattctatttacaggcacaatcttgatcacaagcttg

SEQ ID NO: 33114 - DNA, 94 bp, Chlorella protothecoides
tctgggaccaagggccagcctcctcaccgcctgggggcgggcaggcggcaaggaggtgggcgcagccctgggcgtggcggcctgcgtcgcagcc

SEQ ID NO: 33115 - DNA, 424 bp, Chlorella protothecoides
  modified_base (160)..(332): a, c, t, g, unknown or other
ctaggcgtcgttcgtactcagcacagcgccacgacaggaattccctgtcagcccttgggcgtatagctgagcaagagcatttgtgaggccaaggtcagtccctgctcctcaatcattgggatgggattgttaagctgctgtatgaacgtcgtccacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctttggggaatacactatctcattagcgtggcagcgatgtctgcatcttgtatgctgcctcactgcctgctgccactgctggaggccagc

SEQ ID NO: 33116 - DNA, 61 bp, Chlorella protothecoides
ggccagctgtggcaggcaggaggatcagggggatccatcgttctgtgccggcatctggtcc

SEQ ID NO: 33117 - DNA, 68 bp, Chlorella protothecoides
cgtcacgccgctgcctggagggagggagggggtgtggggattggaagccgctgcagacgtggcacaca

SEQ ID NO: 33118 - DNA, 111 bp, Chlorella protothecoides
ggagactgatttggggatgaagtcaaagacttccaagtcgacatgctgagacaaggcaggtgaagcacaaatcttcgctgtcactcatcatcggccccacgcactgcttga

SEQ ID NO: 33119 - DNA, 109 bp, Chlorella protothecoides
cccaacctccccgccagccctgcacccagctgcccacacatcagccccctaccctcccccgcctctcaccatggaggcaccggtgcgccggcccatcagctcggcaatc

SEQ ID NO: 33120 - DNA, 171 bp, Chlorella protothecoides
ctgtgatctgtgtttgggagaatgttggtctgtccatgctctccatgtcgctggttggctgcttgcagcccatgggtgtacaggctcgaaccatcgaggtcctgggagagcaggctcatgcttgtaatgaaactgaagatcctagtgcatgtacagacatccccacccagc

SEQ ID NO: 33121 - DNA, 68 bp, Chlorella protothecoides
aaactggctgtgatcttcgcatgtgatgatggaagttcgagcgaccagggacaggtgtgcaagatttg

SEQ ID NO: 33122 - DNA, 61 bp, Chlorella protothecoides
cccccagcccatctggtacgaggactgcgtggcggaggacctgcaccaggccagggtgagc

SEQ ID NO: 33123 - DNA, 80 bp, Chlorella protothecoides
acatgcatgtttgtgtagtagaggggagacggtgacggtgtctagcgaggaggcagtggatctgttacaaactgatgggg

SEQ ID NO: 33124 - DNA, 61 bp, Chlorella protothecoides
gtggacaggcttgaaccaggcttgcggaggttccagaggtggggaggagcatgtgtctccc

SEQ ID NO: 33125 - DNA, 61 bp, Chlorella protothecoides
cttgcctttccagatgcacatcagcagctccctcttgcaccagcactgctgtgcagtggat

SEQ ID NO: 33126 - DNA, 77 bp, Chlorella protothecoides
aaagcctaagcctgcctggcctcccgctgcgcccagttgaggtatgcggccatgaagccgtccaggtctccccctag

SEQ ID NO: 33127 - DNA, 61 bp, Chlorella protothecoides
ctgggcgccagctgacacgattctcatgatcaagccagcatgtcacacaccatgctcgtca

SEQ ID NO: 33128 - DNA, 71 bp, Chlorella protothecoides
acgcgctcaactacacgagccccaagctgcacaccgtcattgccgaggacctccgccccaacaccacctac

SEQ ID NO: 33129 - DNA, 61 bp, Chlorella protothecoides
gattgtcacatgggagagcgtcagggtgagaaagtgcataaaacgaacacacagggagttt

SEQ ID NO: 33130 - DNA, 68 bp, Chlorella protothecoides
aacctgaatacactcgccaaggccttcagatagaacatgagaccaaaaagagccgactcgtggctggc

SEQ ID NO: 33131 - DNA, 64 bp, Chlorella protothecoides
gccgtgcaagcttcccctttgcttccattttggtggcctgcagtgtgatagtatgagaatggcg

SEQ ID NO: 33132 - DNA, 63 bp, Chlorella protothecoides
atccagcttggtcactatggcgcctgcatgcagggcgagtagacatggcttggggtctctaat

SEQ ID NO: 33133 - DNA, 70 bp, Chlorella protothecoides
ggcgagtagacatggcttggggtctctaatgtggtattcgaggagagagttctggtccctgccatgcaag

SEQ ID NO: 33134 - DNA, 78 bp, Chlorella protothecoides
aagttcagacccaacacgccacgcggtctctggccatgccgtcgccacgagcaacctcccgtcaagtcgcagcctgtt

SEQ ID NO: 33135 - DNA, 61 bp, Chlorella protothecoides
tggagcgctgtggttcaccaaggtaaagagattgtggtaccaaaacatcgcaaaaggtgga

SEQ ID NO: 33136 - DNA, 65 bp, Chlorella protothecoides
gagacgcgccctcgcccagtgcaccaagcctgtgtaccccacccgccaaaacaaggccacacaca

SEQ ID NO: 33137 - DNA, 61 bp, Chlorella protothecoides
caacttatgatgagtaggacaatcaacctcgtggttgaagggctggtggcctcaagactat

SEQ ID NO: 33138 - DNA, 61 bp, Chlorella protothecoides
ccctccagtccctcaacccctgcgctcggcacctgccgctcgcgccggtccctggcatccc

SEQ ID NO: 33139 - DNA, 67 bp, Chlorella protothecoides
gccctccgcctggctggccgcccgcctcgctttcacgcgcaccgccgctgtctggtccatggtgggg

SEQ ID NO: 33140 - DNA, 61 bp, Chlorella protothecoides
atgttgatgtggtcgattggccttggcaggtcaagcctgggagcgtgttcctccaggcaac

SEQ ID NO: 33141 - DNA, 67 bp, Chlorella protothecoides
ccgagtacggtgaggggcttgggtttcaagcccgctaccaggcggcgtagagggatgcaggtggaat

SEQ ID NO: 33142 - DNA, 71 bp, Chlorella protothecoides
ttggaagaagggcgagtgaagaatgatgtgcgagagtgctttttgtggagtggccccatcagaaatgcgag

SEQ ID NO: 33143 - DNA, 181 bp, Chlorella protothecoides
cttttcattgatcaccacccagttgcggtcgtagcggaaccctgcgggctttccgagaagtgcgtgggggggtccaggaagggttgctggtgtcacggaatggagatgatatcgttctcaaaggccacggcccaggacgtcggaagggggcgcaggagacggtgagtgcattaaaacacct

SEQ ID NO: 33144 - DNA, 122 bp, Chlorella protothecoides
cggttgcagccctgggatgcgactcgtcaggtttcccaacacaacccagccgtccgcgatgcccctcacgacagacccgcccaccctctcgggccctcccctggaatggcgcgcacccgacg

SEQ ID NO: 33145 - DNA, 94 bp, Chlorella protothecoides
aaatggaacagccagaatccagcgagagtggaccctggttttgccctctgctgcccatcctcatcccacactcaccaggtccaccaggctctgt

SEQ ID NO: 33146 - DNA, 79 bp, Chlorella protothecoides
gatggccaggcgccggcgctcctccgtctcaccgaagaggtccaacttgcttagggttagggttactaggccacaattt

SEQ ID NO: 33147 - DNA, 79 bp, Chlorella protothecoides
ggccatccagtaccacctgaaggaaggagtcgacactcgcacagggtgagggcacggagattgactccagaaataacat

SEQ ID NO: 33148 - DNA, 147 bp, Chlorella protothecoides
cctcaaattggcctgctcctcaggttgaccattggaattggtcttactgcggtctccggggcttgatcttcattcacgagctcgtgccgttggatacgcggtcgcagccgttgtgggagcctccggagcggctcccctgcacctgat

SEQ ID NO: 33149 - DNA, 867 bp, Chlorella protothecoides
  modified_base (426)..(435): a, c, t, g, unknown or other
  modified_base (677)..(686): a, c, t, g, unknown or other
ccagattctcgccctttgtccattgtgggttgcaaggggcgtgcgccaaacaattcccaccttcgatactaagattcggtcaatgtggaggcggctaccatcagctgctgccacctaccgccccgctgccgctgcctgctgccgtgttttgcgacccccaaccaacatcacacatcgcgagccagagtcactgcgatctgggtgcccgagggtgaaaggtgtgcttgggacacgtggacctctggtcatacgttgaagaccgcgcatcctctgttttcttcacaggctttttgtaaaacaccgtaggaggggtgcagaccaaactctccacctacaccatcccttcggacaaggattggctgccttgcgttgatggctgttttatctgtgatgccagcgacgcccgctgggttacggggttcagcnnnnnnnnnnatgttgcggggtactcccgcctccctctgttccctttttcctatcccaacgtcgccaatcccaaggcacctcaaactatatcacccgtctcccagaggagatcggggacagttgtaagaactctatctcagaaagtacggcatctgtccctgttacggaggcatatcgcctgccccgcaacagttggtttcggaaacatggtttcccgattttgctaggaacaggaggacaacgccgcagcnnnnnnnnnngcgccccagcggaacctgcgggcgacgacgaggagattcatcatgagaaggactacgatatatcacccgcgctgctacagtctacgctgacggtgccatggcatgccctagacaggctacctcgcagatatggctgacagaatcgcgcaacttgcggccgagcgtgaagcaactgagcatg

SEQ ID NO: 33150 - DNA, 122 bp, Chlorella protothecoides
gcgtgagctgcaggccgacttgatacagctttggaataaagagagctcacattcctagcgccatggactttgttgcagtcccagcattttgttgcaggaagtttgagtcgtgatcgcgcagc

SEQ ID NO: 33151 - DNA, 79 bp, Chlorella protothecoides
tggcccccccgcgcccacctcctcgacgccttcaataaccgggggcgggggcaggaagcgcagcacgtcgtccacgccc

SEQ ID NO: 33152 - DNA, 143 bp, Chlorella protothecoides
gaatccagacctgccgcagctgctggtgagagggcgggggttggccggggctgtcgagcgaatgggtgtggaagaagggagggcgatggccccacaggtcccggagcagccggttccaggggtaggccagggtccggatcccc

SEQ ID NO: 33153 - DNA, 73 bp, Chlorella protothecoides
gaccgccgaggcacgcgagaccgaggccccttgaggggtggtgggcccacgaaggcaggccggaatgaccgac

SEQ ID NO: 33154 - DNA, 78 bp, Chlorella protothecoides
tgaatgcgggtttgcatgcgcactccggtaacccccaaaatgcttcctggtatcctctgaatctgatatcagcgtgcc

SEQ ID NO: 33155 - DNA, 90 bp, Chlorella protothecoides
caagctgcctcggcattctgcccaccgccccccatccactcaaccctcctcttcctccgaaaatcccagctccgcctcacctcgcgcacg

SEQ ID NO: 33156 - DNA, 79 bp, Chlorella protothecoides
gcttctggctcacattttgagctcccacatcatggggcgacgctttggctggactcctccacactccccccttccaccc

SEQ ID NO: 33157 - DNA, 120 bp, Chlorella protothecoides
atcagcctcgggctgtcaccgtgcggggtcccggaaccggtcccatgccaggggatgccccccccccgctcgaatctcttggctggatcttgggcaccggtcgcaacgtgtcgcgcacgg

SEQ ID NO: 33158 - DNA, 6384 bp, Chlorella protothecoides
  modified_base (1313)..(1322): a, c, t, g, unknown or other
  modified_base (2002)..(2011): a, c, t, g, unknown or other
  modified_base (2275)..(2284): a, c, t, g, unknown or other
  modified_base (2665)..(2674): a, c, t, g, unknown or other
  modified_base (2925)..(2934): a, c, t, g, unknown or other
  modified_base (4114)..(4123): a, c, t, g, unknown or other
  modified_base (4811)..(4820): a, c, t, g, unknown or other
  modified_base (4910)..(4919): a, c, t, g, unknown or other
  modified_base (5363)..(5372): a, c, t, g, unknown or other
  modified_base (5842)..(5851): a, c, t, g, unknown or other
  modified_base (6087)..(6096): a, c, t, g, unknown or other
ggcgcgcgaggcgcgcgaggcggcggaggccgccgaggaaagggcggccctcgaacgcgaggcgcgcgaagcgcgggagcgcgatctggacgagcgggctgcgcgcctgccggccgagccggcggcggagcggccggatgccgtgcgcttgctggtcaggctgccaggcggggcgcgcctgacgcggcggttcggggcggaggacgccgtgccggccgtgtttgcgtgggtggacgtcagctgccgcgacgacccgactgcgcccaccccggggtcctatcgcctggttgcacaggtgggtttggtttgggagcggggcgtagggaggcagggtgttctggacatcatggggcatggccgcgacgggcaaggctcggcactgtgcttgtgagtgtttctggatcactttcgtaggaaacatggcatggatcatcagacggtcatgaatgaaagttggatcaagggcatcactgacagctgatgtagggcagtgatgcgagtggtccaaggccccagtgcttcgcgcagcgccatgcatcctcacctccatggcctgtggcccacgttactctcctgcagttcccacgccgggtactgctgcatgacagtcaggagtcactggggtccgcaggattcaatggcggccaggagatgctcctgttggaatccaccacatgaccttgctgccacccctgctcctcccaagcatcccctcctttcctcacgctctccgccacgcatgctctttctcgatcactggcctctgccccccccctgtaagcacagccctcgcatgagtggcattccaagttcaagctcaaggggttttgcaaggtttcttggaaaagtgctgcgatgcagccctgctagcgccagggagagacgagaccaggactgaggggcagcggctcggccgcgagcggccccttttccggctcctaggccttcaggctcggcgcccccgcccgcggcaaccccctgggcgaggcgtgggtcctgaagccgctgcgaaagaaggggaccaccgcgggcctggccccttgcgccggtggctagcccgtcgccgggccgccggcggccatcgcggctgcgccagcctgcacctcgatgtggcagcccacgctcgggcgccagccacccagcgggaacccgtgcaggacagcgcggcgcgtgctttctcgcgaggggggcctctcccgcaggcccgtcgccgagggccccgccctcggcccccccaggaattcgtccggtgcatcgtgcatcgcctgcgcctgcgtggctcgccacgacagcaccggcgcggtgcacacaannnnnnnnnnggggccctgccctcggcccccccaggaattcgtccagtgcctcgtgcatcgcctgggcctgcgtggcttgccacgacagcaccggcgcggtgcacacaagctcgagcggccctgccggccggacactctgcgcgtccaaggccgccgcctgattcccgggcagctgcactccggccccggccacgccagcgggcggcatcgcagggccttcccccctgcacgcggcgggggcgggtgaggggggcccgcaggtgcccggcgcaggcatgccaggcatgacatgcgtctggaccagggtcaaaggctccatcctgccacgggcaggcgtccgcggccgcccctgcggcgacggacgggcgccgttttccgcagccgccagccctcgccctcgtttgggcggggggctcgccgtgcgggggccctgccgcctggcctgcgcatcgtccgcccgtcccggggtcctcgtccccggccccatgcgctgcgcagggagtgggaggacgcggcagcgtcgcgagcggccagggcagcggcgcacaacggcctcctcggccccgcccctctgcgtcccgactggcggcgccctgctgccgcacgcttcctcgaggccccggtccttgcaggcagggccgcccaccctgcgccgcgtggagggcccgtgctcgccagcgtcgggcagnnnnnnnnnncggcggcgctccaccgccgcacgccccctcgaggccccggtcctcgcaggcagggccgcccaccctgcgccgcgcggagggcccgtgctcgccagcgtcgggcagggacccgcccgcgcgcttcagggatcgctgtccacccgcacccgccagcagaccgcccggcccagtggctccttgcgacggcgcggggtgcgtgtgtttggtgtaggccgaccacgcagcaccaggcgccgcgccgtcgaggacagcaggggggcaggnnnnnnnnnntgcgaggtgcgtgtgtgtggtgtaggccgaccacgcagcaccaggcaccgcgccgtcgaggacagcaggggggcagggagcgtccgccggtgtgcacgcctcctccgccacagcaatcagcgcggggtcgggtgcgggcgaggacgccgcgacaaggtcggcctccgccgtgcctgctgctggaggtgcaggcaggccagccagcactgccacgggcggcaggcttcccccccagcaccagtccggcgtcaggcgctcgtccatggctcgacacagggtcctcgtcttcccagcgacggttgatctgtgtgcaaggacgagcagggccgagatgtgcacacgcatcacacctcacccactccaaggaagagggcccctcannnnnnnnnntccctgagcacatcgctggcggagcagtttcgtcccgggctcgagatctcatgccagtgcctccgctggtgcaccgtcaggacacgcaggtcatcccttcggtcacccgcccacgctctcgcttccgggcacaccatgcccccaggtgatcgagtggtccccggcgctgctgagcagctgcgacgatgggaaccctgagaatgtgcggcccgtggggcggctgagggtcctgaagaccttgctcaccgacnnnnnnnnnntgcctgctccggggggcagacgccgccccggtcccgccgtgggcgctgcaacccctgcacccccgctcacctgggagatcgggcaaccgagtcggtgagcaaggtcttcaggaccctcaggcgccccaccggccgcacattctcagggttcccatcatcgcagctgttcagcagcgccgggggccactcgatcacctggaggcatagtgtgcccggaagcgagagcgtgggcgggtgaccgaagggatgagctgcgtgtcctgatggtgcaccagcggaggcactggcatgagacctcgagcccgagacgaaactgctccgccggcgatgtgctcagggagcccccaccccaccccactcatgcaccccacccaccctttcctctgcgcccgacctcctgcaccgatccagccacggccctctgcgcgttgccctggccacgtattggcggatgtggtccaggcagacccagcattcgcgccctgcagggggacaggggaggaggggactggggtcgcaagcacttctggtgggacaccgagcgcccttgccacccgagcgagcaggtgcaccgccagagtagtctacaggcggccgaggccgcagcatgcgtgcagggccatccctcccaaggcccatgcgagtcatgggttgtgggtcgagactcgcctggatccgcaaagatgtgcagcaactgcgcgggccggtccaacattggcagactgaagatgcgactcaggggaagctgagaaggggttgctagtaagcagccttcatccacgggcgttggcggggggaggacttcgcgatcatcctgcatgtccagctcaactgcagcccggggagcaggggaggagtccgcacccgccacgccttgttgcacccgagcgccgccggccgctcgctccgagagcgcagcagccaggcgctgcgcctcctcatttctgcggtcgatggggtgacaagagtccgattattgttttgcagctttccaaagcttgcggcccccttcgggctccacacacgtaaagaccctggacagcctggcccagcagctcacacctgggaccgacagctccacccaccctaacacttgcctcatcctatcaacgagcccccccagccctcccccctcccaccaagactaagctcactctggcatccactgtgccattgcatnnnnnnnnnncgcccttccccccccacaccaagactattcctcactctggcatccactgtgccattgcatcagcctcgcgccagcccaacagacgcagtggatgcacaggcagtttggtacctctgcgctctgacgcagaggacagaatcttgccaaactgggcggggaggggggattgtggcgtgtctcacatgccggcagtgccaggggtctgcccagcgggaagccatggtcaccaaactggacagcatgtactgcgtgtatccgctccagccgacctcaaccaccctcaggtgtatgaggtgggtccctggtctgcatggtcccacccatgccccaagccgaatttcaaagccaaatcaccggaataggcgcagcgccaacacgtttcagatggcaccatatctggcggccggaaacgcccacggcagccgagtactctttcaaggtcacccagtgcctgccatctgtgtagcgtggcgcacaggagaaagctgggatgctgaggatggatgggccatgctcagacttgcacacacacaggcgaccgcgcatcctcatggtgggcttcccagacggcgtaaacagggtgcaggaggtgccaacccctccatgcctctcccctgacgagctcccttgcccgaaggctcccgcatcagcagcccttcccccactccaccctgcccttgctctcacnnnnnnnnnnggcgtggcgcacagaaggaagctgggagactgaggatggatggaccatgctcagacttacacacacacaggcgaccgcgcatcctcatgnnnnnnnnnnatgacgagctcccttgcccgaatgctcccgcagcagcagcccatcccccactccaccctgcccttgctctcacctgcatcaaacagcagatgaatgctggaggggcaggcgtgcgctcgctcgccggccatttgatcgccggggcagacgcgcagcttcacgatcgaaggcttcgtgccctctgcgaccctcttggcgggacacggggattcgctgcagccctgcccaatgcccccgtccagccgctttccctttccccgagcatttattgccagcgcagccgtcgaggcgaccgccgtcgcgcctggcctcacttcaacaccctcatcctgcggggcctgctctgccctgcttggctcctcaccgctcggcccgccctggctccggctcctgggcctggctggctcctgtggcttggcatcggtgcgcaatggcgcggccgcnnnnnnnnnntgcctggccccacttcaacactctcatcctgcggggcctgctccgccctggctggctcctcaccgctcggcccgccctggctctggctcctgggcctggccggctccggcgccttggcatcggtgcgcaatggcgcggccgcgcggctgtgcgccgcggccgcgcgcgcgagggctccgtgctccgggcctagcagcgcctccagcagtttcaggtgcttgggggagaggtgcggcgcgcacggcagctcgctccagtcataccggagagcggcctccggggcaggaggcgtcgaggattggggcgtgggagcatcggtgtggggatcccctgtagcccccgccaggtcctcagcggtggccccatcgatgctcagttccggagcccgccgcatgcccacctctgtgccttgctcggccgcagcccctccatcctcctccgctgcaccgccccccgccccggcatcacgnnnnnnnnnnaccggagcctgccgcatgcccacctcggcgccttgctccgccgcagcccctccatcctccttcgctgcaccgccccccgccccggcatcacgcgcccgggctgcatcgcccactgccgcagccccgcccgcctgccctccgcactcctccccccgtccgtctgcatcctcagcgtcgagcctggccgccagggcacaggcgggtgtccagccgggtcccaccagcaccacgtcctnnnnnnnnnngcctgccgtccgccctcctccccccgtccgtctgcatcctccgcgtcgagcctggccgccagggcgcaggcgggtttccagccgggtcccaccagcaccacgtcctcaggcccgaccgccggcccccggcccccggcggccgccggcgcggcggcgcactgagtgcacaccgccgcccccgcccgccccaacagcaccaatgccaggtggcaggtctgcgcgcacgccaagcacgtggcgcccgcgccggcctccagcgcgccccaggcggcctctggggcacgcgcc

SEQ ID NO: 33159 - DNA, 61 bp, Chlorella protothecoides
cccagaggacaccaagaagcagtacgcccagatcagcgccatgctgagggcgctgggacat

SEQ ID NO: 33160 - DNA, 112 bp, Chlorella protothecoides
cgaggggcgaggagggcactccacagaggtacggggcggggaacacgtgctccccgcctccaagtccacgaagaggcgacggggggcgggaccccaggaggcctgccccttc

SEQ ID NO: 33161 - DNA, 61 bp, Chlorella protothecoides
tgatctcaggtgcggcggggcaaggacgtgcatatgcgggcatcgcaagacaatgctgtgt

SEQ ID NO: 33162 - DNA, 143 bp, Chlorella protothecoides
cccccccccccgtgctgtcatgccacacccgccatcccccctcctccttgttcaaaccctccaccctctcacgcgagcactgctccaggcgcgctccccggtgttcaaggcgctgctgacggggccgatgctggaggggcagg

SEQ ID NO: 33163 - DNA, 79 bp, Chlorella protothecoides
cttcacgatgccaaccatgctcttgttgatgatctgaggggtttcgggaacataggagaggcggaaagtggggtcatgg

SEQ ID NO: 33164 - DNA, 188 bp, Chlorella protothecoides
gaggggaacagaagatgcacagtgcgtggcagaggggcagggcgacatggcgcgcagcacaccattgtgtgggctgtccaggcagttccaggcgcaccctacccctggagctccctggggtcccaggtgcacagccaggaaagcgtgcacaaacccgccccaaacccacctgagcgggactggtagat

SEQ ID NO: 33165 - DNA, 63 bp, Chlorella protothecoides
tggtcctcgacgaccaggtactaggtgggctgggaacggatcgcatgcatatgcccgcgttcg

SEQ ID NO: 33166 - DNA, 61 bp, Chlorella protothecoides
attgggacccaggcaagtctcgcagatgataggaaagtccttgcgctcccacccatctgcc

SEQ ID NO: 33167 - DNA, 71 bp, Chlorella protothecoides
caaggggggatggatgtgaggggtgatcgatggggggatgcaggtgtggcgcatgcatgccctggagagtc

SEQ ID NO: 33168 - DNA, 61 bp, Chlorella protothecoides
gcgcttcctcaccgccatgctggagatggaaatcccgcaggaccgcgccgagctggccctg

SEQ ID NO: 33169 - DNA, 61 bp, Chlorella protothecoides
ggggttcaccaccggctggaccggggcgggtgccacgtctattgaccccgggggccgggat

SEQ ID NO: 33170 - DNA, 6527 bp, Chlorella protothecoides
  modified_base (349)..(358): a, c, t, g, unknown or other
  modified_base (1150)..(1159): a, c, t, g, unknown or other
  modified_base (1467)..(1476): a, c, t, g, unknown or other
  modified_base (3314)..(3323): a, c, t, g, unknown or other
  modified_base (3739)..(3748): a, c, t, g, unknown or other
  modified_base (4390)..(4399): a, c, t, g, unknown or other
  modified_base (4459)..(4468): a, c, t, g, unknown or other
  modified_base (4953)..(5061): a, c, t, g, unknown or other
  modified_base (6173)..(6225): a, c, t, g, unknown or other
ggcggcgtggcggggcgaggtgccgccggactccagcaccaggtccaccaccgaggcgtccagcacctgcaggccggggacggcggccagcgccgcctgcatcgccgccttgtacagcgcgcggtccatctgggcgcgggggcctcggacggcggggcccttgctcgcgttcagcatgcggaactggatgccagcctcatccgccacgcggccctgttgcgttttcaaggggggccggggaggcggcatcatggacctgcggaggtctgtccctgttgatgcaccacaccaatgcccgctggcatgcaagcctgcttttcaattccaccacctcatgcccgccacgcannnnnnnnnngggggaggcggcatcatggacctgcgggggtctgtccctgttgatgcaccacaccgatgcccgctggaatgcaagcctgctgctcaattccaccacctcatgcccgccacgcatctccgagcccaggctatgcccacaacctctcccctcacccccaaaacctaccatgagcccatccagagcgtcgacctcccggaccagggtgcccttggccaggcccccgatgctggggttgcagctcatctccccgattgtggcggagggggagggggtgatgagcagggtgcgggcaccccgccgagcggcagcggccgcagcctcgcaccctgcgtggcccccgcccaccacgatgacatccacgtcgcgggtggaggagaaggctcgtatcggacgagggggatgcctggtccagggccgcgccaccctgaacatgctcggacggagcctgtgcggtgggaggggtctgaggtgtcgagtggtgcaccgacgggactcatgcatgcaccccagcacccgccccatcactcacatatttcccgactggtggaagactagtgcatgacgcatggcaattcacccagcacagggcatgagaggggggccttgttgggctggcgaccggatatgtcagccggtgtcggaaatttcatgcagagacaagaaagaggggtggggcgagcaaaacaaacccctgacacacagcataataaggatctacatcacttcagccaatgctgtttagtattcattcaacccttcttccagcagacgattggcaagggtgcattgccnnnnnnnnnntgcattcattcgacccttctcccagcagacgattggcaagggtgcattgcccctcggcagccattgagagattgcatgttcagtgcccaccactgtcatcctcgcatgtatatactgtacaatgccgtgggatcatacttgtagatgcaacatgccttggtggatttcaagttgttgtggatgcccaaggcaccactgctcctgcacattggcctgcactgccaccctccaacaccaccgtggcccggcagcgcgcgggactgatagtctggaggccttaccttctccacgccttccggagcgcctcnnnnnnnnnntaggcaccagtgctcctgcacattggcctgcactcccaccctccaacaccaccctggcccggcagcgcgcgggactgacagtctggaggcctttaccttctccacgccttccggagcgcctcgaaatacgatccagacggcatgctcggtccatgcacattgatccattaacaaaaatacctgctgtgcattcaaaactttgtagcaacgcatcgaccgagccctggggaccttgtgacacggacgcggtgcttggctccctacacccgagaggaaagctctctcgcacgggactttctcgtgcccttgaggctcttgagacgagaatggattagatcgatcacgctgcaagcgcttgatcgcaatgtttgaggctcagatagcctactacctcaacaagtacttgggcacctacctggagggcattgaccccgcctccctcaagtaggcagagggggagggaggggcgcccatgatgataaaattcaacatctcagtctgtgtcatgcatatagtgatggacagcattgctccactatcgtggacctcgggtggtccatgacatacgtaccctgcatcaaatgcacaacaggatatccatatatcaaggcgatgtggtgctcaagaacctgaggctcaaggcagatgccctgtcagagctggatcttccagtgacagtcgaggctggcctccttggcagcctgaccctcaaggtgggttgttggcatgcagctggggcgacaaactctgtgtgcctggagagcacgctcacaccactccacacccctgcctcatgcctaggtgccatggagcgcgctgggtcaggcgcccgtggaagtgcgtatggaccgcctgtttttgctcgcaaagcccagggatgaggccgacaaggcctccatcaagacggctgtgagtgtgcccaagggggttggtggtattgggtatctgtgacccgcaagcagatcttggcgggtaacatcatcatacatatctgaccgtcgtcacttggatgcctactgcgttgggcgcatgtttggcgtgctggttgttgtcagtgactgcgccatgtgcgagcccacgttgtcctgcagcgctgatggtttcttggtgcctcttggccacccaggatgacgtggacacagccttccagtccagtaagaggcagcgtgtgcagatgcatgagtcgcagtggctcgccgagctggagaggctcgacaaggccaaggagaaggcggaagggggcggcaccggcggagggctatttggtggtgggcgcctgaagaatgtcatcgacaccgtcatcggtgggtggggagtatgtgtcttgtgatgacgttgctttcttggaacagtctgggaggattgggcacatacttttgtggggccatccacagcaaacaccttggcgcttggtggccgattgcaattcacagacccctgcaccccgacatctccacaaaccttttccctccacaccggccccctcccaaccccaggcaatctccagctgtccatcacaaacatccatgtgcggtacgaggatgacgtgaccaacccgggccaccccttctcctgcggcatcaccctcgacaagctggccgcagccaccgtcaacgacaagggggaggaggccttcgtgaccaccacccctctcagcctgctgaggaaggtgagagggggtgtgttcggcttgtttgcttcataacttgcccgctcggcatttctttgcacatgccccgggcactgtctctttgtgggctaccacgtcgtgcagggcgatgctgtgctgcgggtgcacgttcatgatgcgagtccctgcctgccacgcgcgcaggctnnnnnnnnnnagcttgtttgcttcgtcacttgcccgctcggcatttccttgcacatgccccgggcactgtctctttgtgggctaccatgttgtgaagggcgatgctctgctccgggtgcacgatcttgacgcgagtccctgcctgccacgcgcgcaggctctggacctgagacgcgcggcgctctactttgacacggacatagacttctggcggccccactcccactggcacgatctggaggtgggtgggaggcacctgcaagctggggcttggggatggcagcggagcacatgcggaggtcatgcatgccctgcgcacccctctggcacccagacctggacggaagcgcatgcctgcctgcgcccatgttcgcactgcctaaacccctccaccccttgcagccagtggagtgggacgagtggttnnnnnnnnnngggcagcggagcacatgcggtggtcacgcatgccctgcgcaccctctggcacccagacctggacggaagcgcgtgcctgcctgtgcccatgttcgcacttcctaaacccctccacctcttgcagccagtggagtgggacgagtggttcctccctggcgtgtcctccgccaggcaggagcgcggcggcaccgccaggcaccgagagtatgtgctccaggtgagggaggtttctggtgagggctggcggcagtgcgccatggcttgagggcaggcgcaggtgtgtggtggactctgactcaggcaccagcacgcaaggcttcgcaggagacacacaccaatccccactgctggtccagcgctcaccacccttccctcctgtgcgcagcccgtgggcgggcgcgcactgtacacacgcgtcgggaagatgcagaccacggccgacggggacccgcgcatggactcctccctggacctcgagtcggtggccctcagactgtcacgtgagtcgaggattgtgctggatggccatggcggtgatgtgcgggtgcatcaggatgcccctgcatgcaggacaacagggtgggagcacacaagggctggcaaatgtgtgaggcagccggtggccgacctgggctctgcacnnnnnnnnnncggtccagcgcccgccacccttccttcccgtgcgcagcccgtgggcgggcgcgcactgtnnnnnnnnnnccaggatgcccctccatccaggacaacagggtgggagcacacgagggctggcaaatgtgtggggcagccggtggccgacctgggctctgcaccacacaccacactgccagattctgtgtcacgttgttgatgtgtgctcccgcgtcgacagcccgagccctcccccctaccctgccctcccccctccccccttgctcctgccatcgcagacgcgcagtaccagtcgtaccagctgctgctggcggaggtgtcgtcgtacgcggcgcggcacccgtatgcctcctaccgccccggcgcgcggcccgccgcgggcgccgcggcgtgcgcctggtggcgctacgcgctgcgcgcggtgcagcaggtgcaagcagggcgcacgctgagctggcgcgcgacggtgcgcttcgcgtgcctgcgccggcgctacgtgtcgctgtacgccaagcacctgcgcaccaagggcgcgcgcatggtggggctgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctgccggagaccaccatgctcatgttccggcgcctggcgcacgcggaggtgcagcgcgagcgcaagcgcgaggcgcgcgccgcgtcgcgcgccgcggcgcagcagggggccgccgcggggtgggtgtcctggctgaccgggcgcgcggcgccggcgacggggggcggcaccgccggctcccccgacgcccccgcgccggacgacccggacatgcgctccgacttctcgcccgacgagttcgcgcgcctggtggacctggtgggcgaccaggaggagggcctcgtgtacggctccgcctccccgcactccctgctgcagcgcctgcgcgtcggcgtgggctccgcctcggccgagctggtcgggcgcgacggccgccgcgtcctgcgtggaggcctggacggcatcgccctggagctgcgcaagttccccaagaccctggccgtgggcctgcgcgtcgccgccatgggcgtggactcgcccgagggcgtgtttgtgcgcacgggccgcgggctgtcagctgggacgggcggcgagggtgcagggggcgctgggtcgggcgaggctggcgccgacggtgccgaagctggtggggccgtcgccgacgagacccccccccctccggaggaggaggcgctgacggtgacctttgtgcacgcgccgcaggacggcagcgccgacgccgaggtgggcgtggtgctgcgcccctcctacgtgcactactccgcgcccacggtcgcgcgcgtggccgccttcttccgcgcgcccgaggccctggacttctccaacctgcagctggctgcgggcgggcagctggagcgcgcgcgcaaggcggcggcggcctacgcggcggccgccatgcaggcccgcccccgcttcaacctgcgcctgcagctggacgcgcccaagatcgcggtgcccgtgtcggacgccgacggcgacgtctgcctggtgctggacctggggcagtttgtggtcagctccgaccgcggcgcgccgcgcgggctgtcgcctgaccaggccgcgctgtacgagtgcgtgcgcctggagggctccgacgtggccgcgttcttggtggaaggccgccacgactgggcggccggggggggggnnnnnnnnnnnnnnnnnnnnnnnnnnnnnnnnnnnnnnnnnnnnnnnnnnnnngcgagggggggtccggcgaacagggggccgcggggcacactcccagatcccccaccgccgcccctcgaccgccgcgcatcccgctgctggaacggtgcgggctcagcgtcgcggcgcagctgtcgcgcttccccgacccggaccgccccgcggtgcggctgcagcccgcagtgcccagcctgcgcttccacctctcccccggccgcctgcgcgccctgctgcgcgtgctgcgcgccgtggcgcccggggaggtggacgggggcgcgggggaggggggcgccgcgccgccccccgccccggac

SEQ ID NO: 33171 - DNA, 127 bp, Chlorella protothecoides
gagtatcctgtgccaaaggatgggagtattgacaggattgcttgagattctcagttggagtaacctttgccatggtagattacccattcccggattcgacccatgttattgtgcattgttacagata

SEQ ID NO: 33172 - DNA, 135 bp, Chlorella protothecoides
gtttggacttgaagcctacatgggactgcaggtcgtcccaagccgagtggacgatggtcatacgcccatgatgcattgtacacctatcaaatgccgcccctttttccccatcaacccaccttcagggtcctgcgg

SEQ ID NO: 33173 - DNA, 88 bp, Chlorella protothecoides
gacgcctggttggatctgcctcatccccacgtcaagcctggtcgcgctgccatccctgcacaccacgcccaaccctcccccagcacac

SEQ ID NO: 33174 - DNA, 146 bp, Chlorella protothecoides
cctggctgcagagaagcgcgtgacatccccacttctggtaggtgctccgtcatcgggctgtgtgctccgcgcagcgggctctgttactgcatgccccctcaccaccaccattaatttgcacaaaggcttcgtgtgccctccccacc

SEQ ID NO: 33175 - DNA, 193 bp, Chlorella protothecoides
cctcctctcctccctgctctccctgtgcccagtgagccaaggggttttgtttgggggcccgagtcacgcatgcacattatgtatgcgttcgcaagggtgggcgtccatttggctgaggatttgcatgcgccatagcccagtctctgcgaacatagctgagtcaggtggcttcccattgccactgcaccgagcc

SEQ ID NO: 33176 - DNA, 70 bp, Chlorella protothecoides
tccagacgctcagcaggcgatgcagggtctgcgagggtgtggtagtttctgcatgagaataaggccagac

SEQ ID NO: 33177 - DNA, 94 bp, Chlorella protothecoides
ggatagtctagtgagagaggtgggagggtgtacagcgggtgcagggtctgcaggacgatgtctggtggcatgtgccggggcagatggcacactc

SEQ ID NO: 33178 - DNA, 71 bp, Chlorella protothecoides
tgaacaggtgggtcaaagggggcgcttgagtgtgggaacgttgcgcagggagtgctccgtctcagtgggcg

SEQ ID NO: 33179 - DNA, 80 bp, Chlorella protothecoides
actgctctgcgcaaggtgtgcaagcggacatgcgatctgggcttttgtttgggtgccatgccatgcactctgggagatga

SEQ ID NO: 33180 - DNA, 79 bp, Chlorella protothecoides
aacctgaccaaatacattggataccccaccggaggcccccccccaaaaaacacaaacacacacctggccgcccatcttg

SEQ ID NO: 33181 - DNA, 80 bp, Chlorella protothecoides
agacgaggttgggaaaggccagtccagtctcaatatcctccagataataatcttctcaggaggtatgtgagctcagatac

SEQ ID NO: 33182 - DNA, 171 bp, Chlorella protothecoides
cagcggtttgtgtgcgcctgatacatcagagatagtaaccggagctcccacgaacataaggcagctgcaaggctgatcacgtgtattataatgaacaccaaataatactagcagggattccgttattcgcaaggcgctcgaggcagggaggcctggtattttaccatgaaa

SEQ ID NO: 33183 - DNA, 138 bp, Chlorella protothecoides
ccggggggggcttgttcatccaggccggggtgaaactggtgccccccggccctaaagtgggctgggggccgatgcggtcagtctttgtcaggctgggcgtgcattttcagcgcagcggtcagagggtgttgccaaggg

SEQ ID NO: 33184 - DNA, 146 bp, Chlorella protothecoides
ccccccagatctcgcacatgcacgcgatggtggccaccggcttccagctggtggcagacccctccaactatgtggtgcaccggccccatatcccctctgccggctacaaccacaccttcactgggcctgcttacaccaagagccac

SEQ ID NO: 33185 - DNA, 133 bp, Chlorella protothecoides
tgaggatgctgctcgcgctttgggagacgtcgtcgatgacgcaatctccattgaccaccatccttgatgtatcgccgagactgctgaccccgtgcaatgttgccccccatctcaaactcctcgccttccaccc

SEQ ID NO: 33186 - DNA, 15642 bp, Chlorella protothecoides
  modified_base (2516)..(2525): a, c, t, g, unknown or other
  modified_base (2665)..(2674): a, c, t, g, unknown or other
  modified_base (5908)..(5917): a, c, t, g, unknown or other
  modified_base (6081)..(6090): a, c, t, g, unknown or other
  modified_base (6247)..(6256): a, c, t, g, unknown or other
  modified_base (6330)..(6364): a, c, t, g, unknown or other
  modified_base (6588)..(6597): a, c, t, g, unknown or other
  modified_base (6977)..(6986): a, c, t, g, unknown or other
  modified_base (7403)..(7412): a, c, t, g, unknown or other
  modified_base (9643)..(9652): a, c, t, g, unknown or other
  modified_base (11588)..(11597): a, c, t, g, unknown or other
  modified_base (12244)..(12253): a, c, t, g, unknown or other
  modified_base (15047)..(15056): a, c, t, g, unknown or other
  modified_base (15347)..(15356): a, c, t, g, unknown or other
cccggggcgccccttcccctcccccccactcaaaatccatcaccgggaccgcagaggtgcgccaacgcacgagatttctggaggagcggggcctgggcccgccccggctcaagctgtcgcgctcgctggaggagaacttcctgctcctgccctcggtcgtcggggggatgtggctgctggccaacgtcgccgcggcggcgccctacaacagggtcagcgccttgtgcgcccggtggaatgcggtgctcatgcgcacccccgtgctcgagttcgtgtggtgagggcgccgcgcccccatgcccaccggcccctcgctgtgccccctctcctgcgaccacggctgacttccagtgttgcaaggccagctcggggcggctgctctgccattcttgatcggtacattgagtttcaggggatctccgagtccccagcagcatgcagctgtcgtctcactggagcagcctgcatgtcatgccgttgggtttttcccccttgctcgtcgggcccctgcgcaaacccttgctgggcccccaaacattctccttccactgaatttgcaccactctcgcttgacagtgcgcaacctgccccaccctcctgcattggttttcccttgtgctccacggagcgttacttcgggtcgttttctgggtttttgtatgatggcacaaatcgattttggtgcagaagctgagtggttggctttgaggtggggctggtccatgctgggaactcctgagcttttgcctgctggtcagagctttgtgactgaagtaaacggagcgtgatccgtgcatgaccaagtctgattagagaagagggccactctgtgctagaggggggaactgccagaatcgtgtggagctcttcaggatggctcggcattgtccgaggcatcctggcatgctattgcgatcgcttcacctcattccccggacttggagagggagccatctcccagacgtgcagtgcgggctgcggggtacatcacaggtgtacagattacactcgggaagaggccggaggttccctaacttcgtggcggcgcctctctacctcatcttccacacagtgtcagtgcaggtccagatcgccggcttacaccagtcgacatttgtatgcattacaaactccatgcagtcgatgaattgcagggcctctcgacagatcatcgcgcagcctgtggtatttgctaatcccacgatctgggggagcctgccgctcagggtagcgagtctcttttcatggccagaatttcaagctcttgaggagttttgtgatccgaagcgcattgggtcgcttcaaaggcctacctatgtcgggactggaccgcgctgaagcacacacccagagggcggatccttgtgtccgtgtgtcggaaggcatcaaacaacatcgcgcacgatcacacggttgactgctgattcgacccaccatgttccgtaacttctgacatacaattggcgatcagaggtcgcgaatagggtcagaagcctcgctcaccttgcttcagcagccgcacgaccaggaaactcggtgcaggccctgagcaggctcgaggggactgcccaccccaaggaaacccttgggctttggagacggccagcagatgcatgtgcacaaaatctccgcgtctgcgcacccttcaccaccggctgctccgcctcgtgcgccacattgccggcaaccccggccgggggcctcccagcaagccaccgggtgcccggcggtgagagggccgcccccttgcagcgcgacagcgcggcagcagggtgctccatccggaatggccagtcacagcgggtctgagctggtaagcggtgaacatgagcagggtgtgtctgggagtggggaagcgcaaatccctggcatttgtgttgcatgctccccaggaggtcgcacaccggcagctccaccgttcccatcaacccgtcgtgcccccagcgcgtgttggaggtggaccccatgcttcagagccatgcggagcacctaaggtaccgatatcagcagtaccagaacacgcggggcagcatcgagcggcatgcaggctccctgctcaactttgccagggtgggtggggtgattggggttccctggaacaggaggtatgcccaatggcctgcaggtcagctttcacagcacccaggtctgaatgcctacccaggggtacggtggaagctcacaccctcgccccgacgtcgggcaccaagcaccttcacatcacaccccacagggcgccaaggactacgggatccacaccactgacgagctcaccgtgtaccgcgagtgggcgccggccgcccaggctgcgcagctgatcggggactttaacggctggaagcctctggacatgagcctgggcgacaacggcgtatggttcatcgaactcccccacggtgcgttgagttgggcacctgagctcgcgcacactcctctgttgaaaagcatttggcgctggtgctctgctccctcgcgtggtggaggccttgtcgtcgcccggactgccacacccatcnnnnnnnnnnaacccaggtctgaatgccaacccaggggtgcggtgcaagctcacaccctcgccctgacgtcaggcaccaagcaccttcacatcaaaccccacagggcgccaaggactatgggatccacaccactgacgagctcaccgtgnnnnnnnnnncgatttgggcacctgagctcgtgcacactcctctgttgaagagcattcggcgctggtgctctgctccctcgcatggtggaggtcttgtcgtcgcccggactgccacacccatctccctccagccagcgcaagagacccccacccctcgtgcgcaggccccggcggtgcgccggccatcccgcatggcgccctggtgaaggtccgcctgcggctgcccggcggggagtgggtggaccgcatccccgcctggatcaaatgggccgtggtcccccagggcgagatgggggccaagtatgtcggcgtgcactgggcgcccacggaggcccacgcctgggtgcacccccggccgccccgccccgccaccctccgcatctacgaggcccatgtgggcatgagcagcgaggagagggcggtggccagctacacctacttcaaaggtggcggagatggggtagaggggcggtgtgtgatgatgtttgtatgcatgtgtgcttgggaggatggaggcaagtggggttcagcgtttggtcgagggcgagtgtgacgctgacactgcgcatggctgactcgagtggtgcagcgacagcatccctcagggaatgccgaccgctccacgccccccttctcccctttcctcatccacccgcagactcggtgctgccccacatccacgcctcgggctacaatgccatccagctgatggccatccaggagcacgcctactacggctcctttggctaccatgtgaccaacccctttgcaggtgtgtcgcaatcgtcgcatgtgtcgaatggcagaggggcacattgaggggacctgaagtgggggttagggatccttggctgcgtctgcgcccctccctgggactacttgtgggcctgcctccactcaacccaatcgatttctgccctgccgcgcagcgagcagccggagcgggacgcccgaggagctcaaggccctcatcgacgccgcccatggcctcggcattgtggtgctgctggacgtcgtgcactctcacatctcctccaactgcgaggacgggctggcaggtgctttgggtggcggcaggatggagggggggaggggtaggtgctgagagcgggtgcctgtgtttgccagccgggaggcggctcgtcccgaaaccagggatgggggaaggctcacctgctcgggcccccgtgtaacgctggcccacacctacgggagcccagggccacgccaccgcgcgagacctgccggcaccgccgcccagctgcctggggcatcatccctgcccttcgaaacccaccctgccgaccccctcccccatacccctgcccaggcttcgactttggacaggggcccgacgaaaactacttcctgcagggggatcgggggtaccataaggagtgggactcgcgcctgttcaactatgctggatacgagacgctgcgctacctcctctccaacctgcactactggatccaggacatgggcttcgacggcttccgcttcgacggcgtcacctccatgctctaccaccaccacggcatcggcattggcttcacgggcaactactcggagtacttcaggtggggtagaagagggacggcaaggctgggcgcggccccctgcggaaccaggggaggggactgcgctgtctacaggggtggtcatccagcagcacgatccaggcggcaaatggcggcagcagcaaccggtcatgtgcccaggcccatcgccccagcctacccttgcgtgccgggctcccttggcagcttcggccatggatgaatgctgctgggatgtggtttacccgcagcgacgtcgaagctccacgccctcacactccttcgttccccctttccaccagcccttccaccaacatcgacgccctggtgtacctcatgctggccaacgacatggtgcatgagctgctgcccagcgccatcaccatcgccgaggacgtgtccggggcgcccaccctttgccgccccgtcggcgagggcggcgtcgggtgaggggggtgctgggggtgaggaggtaactgggggtgaggggggtactggggctgaggggggttctggggtggagggggtactggtactggagaggggtgctggagggggggcgcatgcaggatggagtgaccaggaatctgcgcagaagggggcgagggactggtcacgcccacggcatgccgctgccgcgccggggtgatacccccgccgcccctcagagaattcccctgtcccggcatccgctcacagccgcgcagcgctcgcgccacacccctccctctcccccttccccccctgccccacactcagattcgactaccgcctggccatgggggagcccgacttctgggtgcgcaccgtgaagcaggttgctgacgaggactggagcatgacggccatggccagcgcgctgtgtgaccggcggtacagcgaggccacggtggggtatgtggagagccacgaccaggccctggtgggggaccagaccctaggtgggtgcgaggaggggtccgaggggtggcgggcggggggcagcagcacacggtcggcgtgtttggcggggccggagcgcaggctgctgagagcattctgggcagcatgccatggttgggtgcatcagcctgatccaggctgccacatggccaggcatgtcattgccttcggccagtaaccaagcgccatgcacatgagcaaccactcttacgcaggcccttacatgcacacccatccacccaaccttctttcgccccttggccagccttccagctgatggggacggagatgtacaccagcatgtcggcgcggcagcaccccttgccgcccaggatcgagcggggaatcgcactgcacaagctcatccgcctgatcaccatgtgcctgggtggcgagtcctacctcaacttcatgggcaacgagtttggccaccccgactggattgacttccccaggcatgttcacccctatcttgggggagtgggcaccgcgtcggctctgcctgggcctgcgggaattgggagctgccgccgcagggacatcaagagaccgccttgacattccctctcccgtagactcctatcttcctccctcatcccccgccgcagggagggtaatggctggagctacgagcactgccgccgcctgtggagcctgttgcagtccgatgacctgctgtaccccgcactggggcggtgggatgctgcatgcatggccctggaccagaagggaggcttcattnnnnnnnnnnggcactggggcggtgggatgctgcatgtatggccctggaccagaagggaggcttcatcgcctctaggcaccagtgggtcaccctggcagacgatgcacgccaggtgtggcctgagggagggggggaagcaatcctgaatgggcaagggttatgaggaagggagnnnnnnnnnngtgagttgagatacgccgtgccctggttcagaggccaagggtggctgcgcgccggtgtatgcatgcatcctcatgtgcacgaagcccgtctggcaggcatacttggtctgcgtctgaaggctcttccctctcgtggcactacccgacatacaggtgnnnnnnnnnntaaagttaagatacgccgtgccctggttcaaaggccaagggtagctgcgcgccggtgtatgcatgcatcctcannnnnnnnnnnnnnnnnnnnnnnnnnnnnnnnnnncgcccagcaccagctaccaggggctggaggtgaggaggtggacactcttggcacacgggtctagtgtatggaaaagggcagagcgggaaccccttgcgctcccgggagccaagaggtcggccaggcccaccattcgcgatgagcgctgcaccctgtcagtccctcgcccaactcctctgcccctccttccccgacccaggtaccagcgccccgccccggcaagnnnnnnnnnnattgtgctcccgggagccgagagttcggccaggcccaccattcgcgatgggcgctgcaccctatcagtccctcgcccaacttctctgcccctccttcccccacccaggtaccagcgccccgccccggcaagtaccgccccgtgctcgactccgatgcgcgggagtttgggggccaggggagggtggacggcgccacagagcacttttctcaggtgagggtcacgtatctgtgaggcaggggagctcggcgagctgacgctcccctctgcgggtgggaaggtccctggctgagtgcttgaggccggcgggctcgtgcactttgctcggagctgtgtcgttgcagccaccttcaaaccccattcccaaatccccgggcgcannnnnnnnnncagtgcttgaggccggcgggctcgcgcactttgctcggagctggatcgttgcagccaccctcaaaccccattcccaaatccccgggcgcagccacgggccccgcaagtccacggccgcgaccaggcactgatggtgatggtgccggcccgctgtgtggcggtgtacaagtgcatggacggctgattgcctgggccaggaagtgcgtgggcggctgaagctgacgatgacggaagagggcatgcggcgtcggcacatgctgcgcccccccccccctccacacacatcaacagtgcatgtggtgccgggcggctgcctccctgccatgccacccgcgactgcatgtgatcctggtcgtgaacctctccagctgcggggatgccatcgattgacacccgggcctgaccctgagagacacnnnnnnnnnncaacagtgcatgtgttgccgggcggctgcctccctgccatgccacgcgcgactgtatgtgatcctggtcgtgaatctctccagctgcggggatgccatcggttgacacccgggcctgaccctgagagacactcggggcacggggctgcgctgcatgcatcatggcgcaagggcacggcatgcagtggcgctctggggtcgcctgacccatgggctgtgcgatctcgcatgcgaccccagcaccctcggcacctttgtgcgcagcgctgcatgccaggctccgctgtggcaatcacaggcctgcactgcctgtccttctcgaggtgccgccctctggcctcgatcctggcttgaccgcccagactcggtcgtgggagggccgcctggatcgaggcgcagcccggtccgccggccgccatcaccacccgtgccgctcgcgcctatcgcggcatgggcccccgccccgccggggccggcgccgccgccctcctcgccgcgggcgagccgtagagcagggtgcagcgcccctccagcgcgcccatcatgcgctgcaccacctcggcgaagaagacgttggccaggtggcggtagagggcggacttgaacgcaaagtcgacggagaagtcgaggcgggtgctgccggggtgcgggcccggcgcgaagcgccactcattgttcaggtagcggaagagggtgctgtcccccacgctggagctgatggcctggccggggtgcagcgtgaccctagagatgtagctggagagagaaaagagtagggaaatgcgtgtcagggtggggcaggaaggcgggaggggggggggagagcagcatggagtgggttgtgggggaagcccttgtggctaggataagcttgccgaccgccaccgatccaagcactgctgctcgcctcgcaccatgcggagttccttcaggcccctcatactgcaagaagacccgaacccccgcgccactcccccgcgcgacctgcagcaccctccgccatcggcaagcaagctagcgagcagcgcaccgttccgtgaacatctggaagccgacctccagctcggcctccaggtagttgggcggtctgcgggcggtgatcaccgagcgcacgcaccagggcacaaactcgtggtagtgctccaccgcggcgacgacgtcgtagatctcctccggcgtgtacctgggcggtgcgggggcagggggcagcacttgggtacgggaatgcagggcgcgggataggagggtggggcggggttggaggtgggaagggcggtgcacaccgcaacacaccgcccaggggcgcagattcacacgcccaaccagcatccagacctgtaccgtggcatacactcacggtaggaccttctgctcgtggaacttcttggactcgccagtctcgaaagggctggggagcccgatgaaggcccgggacacggggagttgggtggctggggccgcagctggcagaaacccggcagcctgcaacgccggcaccccctcgggcacgcctggcccgagcagcctgcaggcctgcaccagcgcccggcaagacgcagcctgtcgcagcatgggcccctgcggaaggacgcggctcgggagagggacccacaccgatgcggggatacaggcgctggtccccgagaggtcaggttgccgcgcagggcgcacccgtggatcgacgatggagcaattacacaaacgtcgaaaatggtcgctggtgccaaattaccatgttggctgccgaattctgaccctcgggaaggatcctcgtcatcctccccataggcctcccctccaccccgaaggtgtccattggggaggaggggttacagcgtcgctggctcagggcatgccattggcacccacttcccctttgacatctcttccgtgtcgtcctaccgagaaaccttgttctaaatctcgagcggaagttaagtacctgagatttgatgatctttctgctgtaagggagccattcttgcagttttgggtgtggccaatcagttcatattggcatgaagacccatgggtggatgaacgcacagtcaggagccacccattgggatgtcagacgctagccttctgctcagccagtagacgttggcgctcctgagcagagagcacatggggaaggaatcaggggggcttggaatcggtgtgaggccacaagaattacacctctgcctggcgcagtgccttcctcccccattccctccctctcttgcaacnnnnnnnnnnttgaaatcggtgggaggccacaaaaattacacctctgcctggcgcagtgccctcctcccccattccctccctctcttgcaacacctaccaccactgctcgccgcttgaggtcagcctcgtacatctgtgctgcacgcctgtggcatcatgaggaagtgaagtgatatgcacggattagcatactttttacgttcaggatatgctcctgataaaaggacggagttttgactcttccatagtgatctctcgcccctacgcacgcacttgtcatcgaaatagtaactaagagcgtccagggactttaggccatatccgaaggcaaacgcccctgctccaaaggcgaaaaacttgccgatggcagcctgcggaagagaatacactgtttcttttagccctggcgagggttactcgtgaagttgatgcccaaccactcttgcttaccatgactgtaaaacagggtacccgccggggccctattctgctgacacaatccttggctgcactcccgctgggcttgcttcacgtttcgagatgagcacctttagctgttaccacagcagggttttgatgccatcctgcccgcactactccggggaagcctacgacgcggaggtaccgcgccgagggggtcccgtaccatcctgctcggcaagagcgagtcaggtcaacctgaggccatcccgccccataaggcaatgctctcatccgtgtaccaaaattaatgtccttgtgacactgctgccatcccatcggttgaggtcaacctggtgccccatgtcgggacgcatgtcccgaggccacggccatggtgttgcgctggcgcggctggagcgccaaagagcacatgatgatcgggtggcggacctcaagggtgaggtggcactccacagccggctcaagggcagggcgcactgggagatggccgaggtgcgaccgccaccaccctccacccaaccctggcccaactccgacgacatgccccgcgctctgcgccacgatcctgatgcttgggagtcggcaccacgcaagctcttcggctcggatggcctggcggcacgccagtcgagggccctggctcaggagcaaacttcctcaactccccatggaggggccatcttgagtactgcccgcagtcaggtgctcgacaggaaatcacactcacctttgccaatagagcgatgcgatttatccgtgctggatgtggatgcaacctcagaccttgtggaggaagacgtcactcatccttcaggatgcgctggggctgccaatatggcccaacctgcccaggacgacccccggtgccccatatctgagtgctcgatggacgagaagcagccttcccctcacaacttgagcccctctaaactcctagcagcatggtattcggatgcagtggctgctcagcatgcaccagagcagcctggacccaacacaatcctctcacctcccaggtgagggcacctcttttcacattcttgttcctttgctttacacgggccgtgtgcgagtcggctaaccaggcctcagcccacacctccagcagagctggaggcctcatagtcgacgccggctcgcaaaaggctgccagccttgcgagcgtcctgcgtgagcgtgcagaccaggtggaggcccggctggcggcccggctggccgagcggcaggctctggccgccgcccagcaggaggcgcgggagcaagccaagcggctcgcagccgaggaagctgcgtgcaaggtggcggcggtagaggccaagcaggccctcgcccgtgagcttcaggtttgagggtcgggtgtcggttgggtttcacctctgccttgaccgccgcgggagtaccctgtgctgcctttggctaggaacgtcatgtcggatgctcggtccaccacatgcaacctgacaaccccctggggtgcaccgtcccctcccagctatgtggnnnnnnnnnnctgggtttcacctctgccctgaccgccgtgggagcaccctgtgctgcctttggctaggaatggcatgttgggttctcggttcaccacatgcaacccgacaacccccgggggtgcaccgtcccctcccagctatgtggcagatgcgatctccatgttgatgctccaccaaggccttggtctgctgccacgtactcggctgccaccctttcctgcgcctgctcccgcacaggaccaggtgaaggaaggggagctgcggcgctgggccgctcgactggattctcccgcctaagcatacgaatcctctccccgtggcggatgctctcagacgccgccgccccgcatgtggggcccattgctgcctctggagcgcccagaacatgctcggcacacccaccccgccatcatggaaggctgtgcactcgctggcccgaggccatgcccgtcaatttcggcagctgctcccagctgcctttcagtccggtccagagcctggcatccaagaagaaaatcctgcagaaggcctactgccatggcgctaaactcctgctccctgctcagactgcgacttccatacatacctgacatttgactgaggagacaaagaagtgcacataattctccacccccctgcacgatctgatgactgnnnnnnnnnncaaactcctgctccctgctcagactgcgtcttccatgcatacctgacacttgactgaggagacaaagaagtgcacataactctccacccccctgcacgatctgatgactgttacacacgactaggtccttggaaggagtgcaaatcatgcggtggtggcgggctgcacgcgcttggcctcgcctgggggagaggagggagtggaagtggtgaggcagtgcaggacgggggagggagacgttggacgggggagaaaagacattgagctgccccaaagcagaacactgcaggccaacacccccacaaatgtatggacaggagaccttggctcaccctcctggaagccgttgcggaagcggcggtgcacttccttgaggtgcttcatccggccagtgccggtggtcttccggcggatggccttctggccccactggtctgcgcaggttgggggaaaagagaaggggagggcgggcctgagctcgaggtactgtactgtaatcagggcctgtgccaaggtcatgctcctggaccacgcgcgtaatggatccagcgctacgcggggaccggcagcgggtcgacatgtccaaattcaatcaaagacccggtccaccagccaggtatccagcttacaggtcctcttccgggcggatgggtatccgcaggcagcgcaggtgctcttctggttgtggaacgaccgccggccgcaacgacggcacagcgagtgcgtctttgtgtggcgcttacctacaatgggagcgtgggtacgatgattcggactttattccccaagttcgagcctttccgcccctccgccaccaggatgggctgcccccgctcaccgaagctgccggtacccttgccgcacttccccatggctgctcaacttccgaagaagaccgtcacgggcctcgtgcgatcggaaaagggatgtgcggggttggccgccaaggtaaaggtgcgaggcaactttgtaccgcatgtactgcagaggtggtgcaccgcagcgcgctcgaacagtagcggaggggtaccgccacggaggtaacgccgggtatgaatgctctccgcgacagacagagtaagggcccgattgcggcggagctctctctgccactcctgctcaacctggtgataaatgatttcgcatgacctgccaaaaagggacgaaccggacgaggcgctatgcttgacaccacacgtccgcttgtagatcccggacacttgcacgcgtggagcatcctcatcgtgcactagcaggcaaggagaggtgatgcgatacatgctgaatacttgcaggtggaattttggggtcccgtggccgcagggtctccctttcagtgtcctttcaggccccaaatcctttcgtgctcgccctggatcatgttgcccgcctcaggcgccacaacaccactctcaggaggagcagcacgatcatgcagcgctccgaggcgaaaattcaacatccggcaccctttcgttgtggtctgggccagggctcaggcccatcgcgttacccagcagaggccggcgttcaggcggccaggagcaaagtggacgcctgtggccaaaatgtgtacgagaccatccccgccatccatgcccactccagcccccttcgtcaagcgcggcccctggacgactacagggacaagcaggtgagtgtgggataggtgtgcgggacgccgagtgggcgtggagcgcctgctgtcccccaggctggctgttacgatgtcgcaggagcaccaccgccagtcagacgcgtgcaccacgccatgcgcatgcatgcctgtgccacaaccagtgccactgtgagcccggagcctctctgcttccatcgcctgaacccgcaaactgcgcagcatgcttcccccatcttcctgcggggccgcccagctcgcctggacaacagcatcgaggtggacgccaggtgagtggggggttgagcctgaggcccgtgcgctgtcacacacggcctccacacccgagctcactgcttggaaaactgcgcacagatctccttcccacccacccactccctggccggcgcaggctcgcctatttggaaaagcggcggcgggggggcgggatgtccctgctccggcgcctcttcctgggctgcttctcctctgcgccgcgctctcccgggctcggcccttcagcccggcccggctcccacctgcgctccgtgccgtgcgccatggaccccctgcgccagagcgccgcgtccctgaggagcagccagctcgcccctgtccccctggagcagggcccgcccatcagaccccggaatcgggcccaggcgcgggtcagggcggcggggttgggcggcccagcctgggcccggccgcccaatcctggcctggagcccgacggccgccggggacgggcctttggcagtcccggggacgcggggcatgcctccgtccccaactacgcgtcgccggtggccggcgccggggcgtccccagtggccggcgccggggcgtccccggcgcgagggccgagcgcttcggggcgcgccaggcggtgtctggcgccagccctgccacgtgtggccgggctggcggccgccagcaacgcgtccccggcccgagggtccccactgaagggtgagcttgcgggagggcaggtggggcggtgggatgggggcaaggaagggcaggactctggggggcagggcgggtggtgagttgccgccggggggctgtcgcgcggcctttgctttgcagggtggaagcggcggggtgtgcgcttccccacgacggcgtccatccccgcctgacgattccgacgcnnnnnnnnnngtttgcagggtgggagccgcggggtgtgcgcttccccacgacagcgtccatccccgcctgacgattccgacgccacccccaccatctccacttcaggcgtccggcccgtgggaggtgcgcctcagccgcccggccagcagccactcgctcggcaagcgcccgcacagctcacccacggggcaggcgcccagcccacttccaccggacctcaacgcgccggcctcctggaccccgacagccccgccgcgcccccggcgtccaggggcgccatggcaccggatgccggccccnnnnnnnnnnttcacccgcccggccagcagctactggctcagcaagcgcccgcacagcacacccacggggcaggcgcccggcccacttcccccggacctcaatgcgccggcctcctggaccccgacagcccccccgcgcgcccggcgtccaggggcgccatggcaccggacgccggccccccgccgcggcagccgccctctgccaagaagcggcaggtggtgatgctgccgcgccccgtggccccccggacgaggagcaccacggaggccggaccggcccctctggcggccgagcc

SEQ ID NO: 33187 - DNA, 61 bp, Chlorella protothecoides
aggaggccctgtcaaagattcactccgcggtgcctgcaatgctgagccgccgtttgacagc

SEQ ID NO: 33188 - DNA, 105 bp, Chlorella protothecoides
ggatggatgaccagggatgggagctgtcgaagttgtgctgtgggtctggcatcagctgccgcaaaggcctgggctcccgggctttactggcctgggttttccaaa

SEQ ID NO: 33189 - DNA, 74 bp, Chlorella protothecoides
ccgttgacgtcgcggttgacaacgttgaccctgcaggccgggtcgacgcaccgcttggtgtcccacacgtccac

SEQ ID NO: 33190 - DNA, 62 bp, Chlorella protothecoides
cgtgcatcaagacgtcacatgcacctacgtcctggcagcatttgctggtgacaaacctgatc

SEQ ID NO: 33191 - DNA, 93 bp, Chlorella protothecoides
cagccctagcttgccgctgctgccgactcttccaaggtcattgctactaccacccaccccgcgcttctccctttccaatcaccaggtggacaa

SEQ ID NO: 33192 - DNA, 135 bp, Chlorella protothecoides
ccagcaggccgggggtgtctgtcacctgcatgaggggttggtgcttgatgggttggggggcggtgactgggttggtgtgcggaagttacaaggcccttgcccgagggtcgacggtgtagggtgtgagagtggcgg

SEQ ID NO: 33193 - DNA, 3040 bp, Chlorella protothecoides
  modified_base (1050)..(1110): a, c, t, g, unknown or other
  modified_base (1828)..(1861): a, c, t, g, unknown or other
ttctcatggtatgtcagccagagtgctcaacgttaagctccagtagtcgtagagcatttttgtcacagacggtaatcaggaaattaccgctccccgagtacgttacggagatatttggcctcattcaaggtctggctagcgagcgatggaggaccataaacaagtttacaaaaaggtgtcctggcaatctatgaccgttgcgagatctttccaattctgctgtcagggcaatcatactctgcgcggaatcaaccaaacaggacgtctgcgaatgttgcgaggcttgcccatatcaggctcgctgcacataagtctgcataacaaaaggcccaagggttcttcgaggtcatgcatgtgtgattatagtgaccgagtcagattggcttggtcccctttttagccggtatgcagagtttaatattgtggggagggcttatcagaggtgcccaggagtgtttttcgcagatgtctatgcttacccattctaccagtgtgtcaccatttcggcgtctacatcagatacctacccggacaaaactttgaaggagttctgtgtcgcacgaattgaaggcccgcagatcattctctgtacaccttgaatcatctcgacgacgttgagggcgaatgtggtcccagtctcagtattctgatcggaagtctaatggcactcatgccgaggggtatgacatttacgtgcgatcctgtggaccttgctagtgtcaatatatagatctggtgtgtgcccttgactcattgtaccgcataacctgagaactgaagcagtctaataggaaattaggaaggataccttgaatctgactcgaacatgagcctgcaaaggggagctactacaagccttgcaatctgtagcacagcaggtatggagcacctgagggagccgagggtatgcttccaaaagcgataataaaggttgatcagagaaaagaaagtacaggacccacctggcatatggatcggcgtaggcaatttgtcttgctccctaagacgccactcgcccattgagccggtatcaaagctgccataacttgnnnnnnnnnnnnnnnnnnnnnnnnnnnnnnnnnnnnnnnnnnnnnnnnnnnnnnnnnnnnnattctggggccgactgattgaccgcagcttacattcataagcagccgcaagcgtgcgaaattgggagcgcaatatcccaagcgcaagatagcatgctggcatgctccgagtagtcctctcattgaccttgtgtaaatatactttcattctgtacagctctgaagaagttgagaacaatgatcaaagggaatgcctgactgcgaatgagggcatcagaaaattattgacttgatactctgcaacattgaaaactattcatactctgcaagtgtttctcaacttactcctggttgtgctgatagcgtatcgctattgtgatgtgggctgagagaagagggaatccctctgcgactgaaagagacagggagagaagactgaatgaatggagcacagcgtccacgcattggagcagcccacttgtatgttgcctgaatccaccgctgcagactaaaagattcctaatattaagttcccaacgccgatattgcaatccacgacgcagatcttcgagcaatgttctctgccctgcgttttatcccagcatctgcgaatattaagggtagtgaaccgatttcaatgccctgtgatgtggtaagggggggccattcttaacattgagatgcaatttatcaatgcccccacccaatgtcacggtatgctcgcaccggctccataaaggcaccaaatggagtgcaagattgagttctctgaggaatgnnnnnnnnnnnnnnnnnnnnnnnnnnnnnnnnnnccaaactctgggcggcacacctgtggacgatgattatccgaaggtgcacaccatccatgtatccattagcagtactcgagcaagtaattacaatttctggttacatttagctactaaaagagacactgcttttatgggtatgtccttagatcgtgcagtcgtgggaatgattgagcaggattcaaagtttagaagcacagggatatggggcggcggaaacgacgtagagcaacggaaaagtgcgtaggaatcgcaccagtttatattaagcggctaaacatcttaggttgttgagagccgctgacagccagttggatattgcagggtccactgccactcggcgtgatcgtcactcgcattgcattttatcgcaaaaagatagtcttctccttgtaaacacatgtaggattggaatcatagaagttgtggagtgcctgagaggcatgtgtacctgccttgtcagaggcttaagcgctggcctctgctcgaatgacaaatctattgccctttgtcacctcagtcccaactagtagtgcacaattgccaggccgccgattctagcggtattaatcacctattgcttctgtagtaatgttgagaagtccggaatagccggaagcatgcacgcacgcaaactttcatttcaggcagttgtatcgcacagagcatcaaaacatttgctatcatttttacatcgttgggcattcttggcgtcgatggaacaagatcctatcaatgattctagaacgtcgtgatcttcccgcgacgtagactcctctaattaatacaggctcttgctgattatgatgttgcacggtacggacgtttaccgatgaaaagaatcattccaaagatcgtggcgacgcttttttcatatctatcacttctaatgttctttagcatcccaagggcattgcattagcttatctcattctcccgtgggattagctatccctgcagtgtggtatgtaagaggacgtgatatcagtcaaccgtaacaatttcccatctctatcaagaattagaaggacgtcgtttgtgcaggagctcagatactggcaggtgacaagggggaactctacacaaatattactggagttttgctgctgtaagaagtgcaaatccaggtgtatatttgccgaggggcacgctatgctttgccatcgctaatgaactttc

SEQ ID NO: 33194 - DNA, 123 bp, Chlorella protothecoides
ttggctgcatgatgtccggagcgatgcccctgagtccagtgtgcgcgtcgcttagtgcctcctccccccccccccgaggatgcgaacacccaactccccactcacgacctctcggcagggact

SEQ ID NO: 33195 - DNA, 119 bp, Chlorella protothecoides
ctatgcccgcgccttcttggcggcggggggaaagcaggctcctgtcggagggagcgccatagctgggggctccctcccggcgctgccccgcccatcgaggggcaagcggggtgccagag

SEQ ID NO: 33196 - DNA, 89 bp, Chlorella protothecoides
ccgtggacgaggcactgcgaagagactacagcgacatcatggagctgataaactccttctctgcgccagggaccgatgtcacagacacc

SEQ ID NO: 33197 - DNA, 71 bp, Chlorella protothecoides
tgaaccagcacacagagacaattcaagcttttatattattaccttctcgcagtctgggcattgaaggaact

SEQ ID NO: 33198 - DNA, 132 bp, Chlorella protothecoides
caggagctgctgaaccccgacatggtggagttcccggagctgccccagcccagacctgccgggccaggcaagtggaagggatgagcgctgagggcagaggatgttggggtttgggagctaggcgcggtggcg

SEQ ID NO: 33199 - DNA, 82 bp, Chlorella protothecoides
ctggtcaatgaactcgttgccgccgtagtagcgcgcgccggggtagccctcactgtacttgttggtcatgatggaccccaca

SEQ ID NO: 33200 - DNA, 61 bp, Chlorella protothecoides
ttcgccgcatcgtccccggcgccgagctccacctcgctggtcccaggcgtcatgggcttct

SEQ ID NO: 33201 - DNA, 61 bp, Chlorella protothecoides
ttgggatgcggcaccacggtccgtgcctgttgctaccctctcctctcatatagtcaaggtg

SEQ ID NO: 33202 - DNA, 64 bp, Chlorella protothecoides
taggggcgttggatagtctggacagggcgcaggccgacctgcacaggcaatacggtgagacgag

SEQ ID NO: 33203 - DNA, 118 bp, Chlorella protothecoides
cagtcctggggtgccatggatggggctgtgtacccccaaagtgccccgcaccagtgcagggtcctgaccagttcgtcatgccatccttgcagagggtgtggagcaaggcactgatgca

SEQ ID NO: 33204 - DNA, 90 bp, Chlorella protothecoides
cccgccccccaacatccacccaccccacccgccccgcccacccaaccccttccttgaagcgtgacagtgacggcctcagttccgactgtc

SEQ ID NO: 33205 - DNA, 61 bp, Chlorella protothecoides
agaggatgacgaggtggtgggtgaggggggcgagccgggatcctcgacccccccactccca

SEQ ID NO: 33206 - DNA, 27439 bp, Chlorella protothecoides
  modified_base (3703)..(3712): a, c, t, g, unknown or other
  modified_base (4714)..(4723): a, c, t, g, unknown or other
  modified_base (5660)..(5669): a, c, t, g, unknown or other
  modified_base (5856)..(5865): a, c, t, g, unknown or other
  modified_base (6786)..(6795): a, c, t, g, unknown or other
  modified_base (7112)..(7121): a, c, t, g, unknown or other
  modified_base (7218)..(7227): a, c, t, g, unknown or other
  modified_base (7361)..(7370): a, c, t, g, unknown or other
  modified_base (7467)..(7476): a, c, t, g, unknown or other
  modified_base (8232)..(8241): a, c, t, g, unknown or other
  modified_base (8406)..(8517): a, c, t, g, unknown or other
  modified_base (11363)..(11372): a, c, t, g, unknown or other
  modified_base (12414)..(12423): a, c, t, g, unknown or other
  modified_base (12562)..(12571): a, c, t, g, unknown or other
  modified_base (14858)..(14867): a, c, t, g, unknown or other
  modified_base (15876)..(15885): a, c, t, g, unknown or other
  modified_base (18222)..(18231): a, c, t, g, unknown or other
  modified_base (18624)..(18633): a, c, t, g, unknown or other
  modified_base (18988)..(18997): a, c, t, g, unknown or other
  modified_base (19274)..(19283): a, c, t, g, unknown or other
  modified_base (19768)..(19777): a, c, t, g, unknown or other
  modified_base (23994)..(24003): a, c, t, g, unknown or other
  modified_base (24920)..(24929): a, c, t, g, unknown or other
  modified_base (25122)..(25131): a, c, t, g, unknown or other
  modified_base (25516)..(25525): a, c, t, g, unknown or other
  modified_base (25778)..(25787): a, c, t, g, unknown or other
  modified_base (26334)..(26343): a, c, t, g, unknown or other
  modified_base (27096)..(27105): a, c, t, g, unknown or other
ggggggggggaagggaggtctagagcacacaccgtgcatgtgctggagcgggtggtgtgcgaggcagggctggcgcataccaagccgcggtgccgacacgtgcttttaccagcccagggcattcgacaggcggtcacctctatggcctccggggctggcatgccccagtggtactgcagcaccagccagagggcctccgacacaaagggggcgtggcgcgggtggtgcatcgccagcaccgcgtcggtggggccggccgaatccgggccccgcgcgtcgtgcccgcgctttctctcaagctcagcccgcacggccagccgggccagcgcggcggaggccgcgatggtcgggcagggcgccttgtccgaccccacccagcgcacgtgcgggggaaggccgctgacggagccctccgcgaagcgcgagaggtccagggtgcgcagcgtactcagcgcgtgctgggtggccaaggcctccaggccccggtcgtctgtggaggaagggtgtggggaaagggggggggcgcagtgggcgcacctacacgaggaggcgacaggcacataccggctggccctggctctatgcataccgaccgccagccattcatgctcccctgagcactacccattcatgtccctccgtcccgtacatggccggccccactccccacctggtctcccagcggccaggaagagccagggcaggagctggcgaatggcgtcagccctcggcaggggccccgggaggctgggcatgtctgccgggcctgggaagggcactgcattggatgcaggggagggttggggatccctgccggggatgtgcccaggggaggcgtggctggggagcaggaggggagggaaagagcggcagtgtgccagctcagctttgacggtctgcagccggtccactcggcaggggctgacggcagccggccgcgctgcaacatccgcgtatccggccgtgcatgtcagccggaggccgtggagggcgcccatgtcgccctcgtcctaaagctggcgaggcgccagcgagtggctgtgtggtgatcgcacctaccggtgcctccttgggccaggtgggagccacacagcaacgaaaaagttgtcagttctatcgttttgacgtcttcagcaaccgtactgggcgcagatagcagggatgtaacgctatttcatgtgtggagtagggtcacgtacggctcgtcgcggtcaccacgagaggttccggcgccagcttgcccttgtaatggacaggaagctttatgtcaaggacaactgccatgggggacgcgacagtctgtgcacaatcttgcagcgaatgacgttgagcttcccatcagcgtcccttatactcaaagccgagttgtcccctcccagtgccatgagtttgaggggtgaacatggccacttcagataaggggcaaaggtctgactttaggacctgtagcctttacttgccgcattcaaagacattcctgctcgctctggggttctgatgaattttttctcctctgtgtaagggaaggcgttaacctcacatgctcccctcacctgtgatcattaatccgaaactcctgtgagtgcaagacctcgacgagtttactgctaggtgggctctcagttagagtgcccaccagcaggaagcaaatgtccaaggtcgattgcatcttagtctcaacttcatccgcaccagtcacttcaaggggtagcgttgtcctgcacccagggagtgtgcacccaaagtccaaggaactgcatctcccaaacctgcctccaagatttcccgtcctcgacacacgctagacggcatgtgcagatgtcaggtgcatggtgaacgacttgcacatggagatgggaatgtggactgccgggcgccccctacttgtgagggagcaatacattctcctggcaaactcttaagaagccgcctatgaggctgcctccaagataaccgtacctcgaggtggagatgtgctcgctctaggtccaaagattacagttctattctaggtgaacgagcatttacagtagagcgcttcacacccccgccagggtcgacggatcgacaccaaaaactcttttgcggagatactctcaaactgatactcgaccccagcctggacatcgcatcctccgccgacctgtttgcattcttttgtcggctactccgcagcgaatcctccccggagttggctttggtgcctcgacctcgctgtgcacaggcactacggcacctcgtgaacccatctccatttggcccggccatggatgtcaaggtgtcccgcgaaagcagcagtctatgcatgaatgcctcgggagcgctccacgacacctcgcaggcccttagcgaagaggtacggatgcccttacggggacggcaacgaggtggcagatggtagaagtcgggtcgcgcggctctcgtttcaccggcctgcaatcaggatggctaggcatgtgcttgggagtgcccatacccggactgagtcgattgccaggctgcagtgcgaccctgctggttgccggaggggctcttgcccctggggcctccgcccactcccctgcccatcgacccgcaggagcgggtgtgctggatttgcttggagaactcgggcactctcattctaccctgcaaatgcccacggtggggtggtggggggtttgtgtgttaccacctgtgtgcagccttaaggaaggaagcctcatcagcccttgctgtccattgccctggctggcagcaggcagggtttgacatgccctccaggccatccaccatcacccaacaagcccgtcgtgccccggcgccacacaggcatgcgcacagccgctgcctggcccggtggcagctgcaatctgcgggctcgcggcgcgagacccactgcgacttctgcaacagccagctcccggactggaaggcggtgctgacccccctccccgacctctccgcccccgccgtcatgaacgtgaactttgacggccgcacctacagctttgaggttcgggccggcatggcggggtactctgaattcacagagtccatccgccgcgccttcaacctgccggacgacagcgacctcaacatcaccttcacctgcgacgagcccacgtcaggcgcgtggatgtgacggagggtggtcatgtgtgatgcgggggctgcagccgggaacgaggtgtctattgttcggcgggatggatgcacgtgaggtttggcagtggcgggggcactgcgtctatcatatccccttgccccatgcatgtcgaaattgatcgtcgctctgctgactggaggtccctttcctcgtcgaggagcagatgcaggcagcctcctgacactgcatggaccgggggcgtacgacgctgcggtgcactgtgcctccatctcggcggcacgccgcatcgccagctcctgcccttccgaaggttcaggtgagggctcaccatcatgcctgggcactgccttggacagggggtgaaggagaaaggcggctgcaagagacgggtttagtcgtcgcgcatggtcttgcggggccttgcatgtggacaactctgctctcaaccccaccgccaccaagccccttccaactcccgtcatgcaacttgcagcgtctgtacagtctgctgggtcgagcctggggtcatccccctcgaccctgggcagccctggggccgagggggccgtgcccgtgcggcgcaggcgaatggcnnnnnnnnnnatcagtcttcgcgcatggtcgtgcggggcccttgcatgtggacaactctgctcccaaccccaccgccaccaaggcccttcccactcccgtcatgcaacttgcagcgtctgtgcagtctgctgggtcgagcctggggtcatcccccatggcgctgggcagccctggggccgaggtggccgtgcccgtgcggcgcaggcgaatggcagcgctgggtcggcgcttccggtctgtcctccaggacctgatgaccgcgtcacgcactgcgcagtaaggggcctgggcttgcgacgcaagcgcagcccttgttttgctgtttgggcgtggtttggattggctcaaaagccacagctttcgtggaccatccaccaccactccatatgcttcctgtatcttttaccttggtttctgccaccccttcaagccagagcggctgtcactgctgttctcccccacctgctcccatgccacccacccgcccaccctctgggtgcacaagcctgcccaggcaggttcactggcgcggaatgaccgtgccgcactcttgtcggccattctttttcgaaatttgtactaagggtttctcaaaccatcttgcctccacttttctgccgcgcttggtaacgccagaaagtctgaagtttgagagctcaagtctgtgagcaaagcgcgggaagaccgatgctgctgatgatgaaaaataacactgagctgtcacgaatggatgagctaccggcgtggaaggacaacggctcgatcgtttcggacgtccgtagaagcactttatgccgaatacttagagcgttgtagcatgtcgatatcctacgggcggttgctcatcgtgggacgggagggcgctccggaagtcgagttccctcttgacaagaagctcgtgctcattggaaggtacgctgctcgtccgtgtggtggaacacttactccgttgtcaatgtagtaggaaacaaccgtaagtaacccctttcggtgacgcgcagggatcagtcnnnnnnnnnntgctccggaagtcgagttccctctggacaagaaactcgttctcattggaaggtacgctgctcgtccgtgtggtggaacacgtcctccgttgtcaatgtagtaagaaacaacagtaatttacccctttcggtgacgcgcagggatcagtcctgtgatatctggattcggaaccgcaccatctcgaggaagcatgccgaggtctttgtagacgatgccggggcggtgagtgggaaggaagctgactaagaaggggctggaatgcgctgcaagcttctcaatggaccgtgtttgatgcctctgagtggcactcactggctcccttgggccgggagcggtggagggtcccacccagcagcacagccttcctttcaaggctgcgaaccgacagagtaaaccccctgcccctccaccccttgccgcaggtgttcatcaacagcctggggcaggacccggtgtgcctgaactcccagccggtgaccagccctcaggagctgttctccggcgataggattgaggtgcggctggatgaccgcacccgcaccttcttcttccagggcgacgaagagaccatcaaggtgcaggcacccacgcgggccctgcagcaggccaaccgcgccgtgccccaagccgcccgggccagtcccaagcccgcgtcagcccgcaagcgcacccgcgcctctttggccccgtcaggaaaggaggacgtggcgccggcctccccaggcaggggcccaggccccgccaagcgaaggggtgccggggcgccgcccccgcctccaccccccctcccatccagccgcacactgggcagagcggccctgggtctgacggcgcctagcactctgaccgggccagcctccagcgacgcgccggcacctgtccctggtgctggccaacccccagcgtcgaggccagccccgggccctgcacgcttcgnnnnnnnnnncccccggcgctggccaacccccagcgccgaggccagccccgggccctgcacgcttcgttcccagcgccgcagacctggtcgcactcaaggccggtgagtgccactgggtgctcggcggggggtgggagggggggaaggggggggctctggttgggggtctgccgggcatttggcagcctcttgactnnnnnnnnnntggtgagtgccactagctgctcggcgggtggtgggaggggggaaagggggggcctctggttgggtgtctgccgggcatttggcagcctcttgactcgcaagcagcacgaggacatgagtgtgttctggactttgctagagtgatttgcggaattctctgaaccgacgtccctggaccccggccctctttatgcagggctgaggaaagctgctgggtccgcacaggcagacgtccaggcagcgagcgacgccgtcccgccggcgctcttgccagagacggtgcctggcgcggagcccgccgtgccagctcaaggtgcccgagatgtggggctgaagtcgccgcgccagcccggcgccgccagttccccgctcacgacgctgaatacggggaggaagacgcccaagtccacggtccggcgcaagagcgtgcgcttccaggcggaggccggagggacgccggagggcgcccctgccgacgtcaccatcacgctgcacctgcgccgggggggcctggttcgggccgtggatgtggacggcgccctcgacaccctggcgttctccgagtggggcctgggcagcatgccggccgaggggcgcggcgcgggggctggccgctcggtggccgaggcgggcgctgctggaggtgatggctctgaggagggcctgcctgccttcgaggacggccagcctgaagctggtgagggtcgggttccacctgacgccctgaccgccgccgtcaatcagccgggcgaggccctgctggcccttaccttcccggcctcggccagctcagacaacaaagaaaccggcacggtcgccgatccggcgtccgtactccctccgagagacccgatctggaccccagggggaccctcacagacccccgcgacacagctccggcgcttgctccccggcaccctgnnnnnnnnnncggcgccctgaccgccgccggcaatcagccaggcgaggccctgctagcccttaccttcccagcctcggccagctcaggcaacaacgaaaccggcacggtcgccgatccgtcgtccgtgctctctccgagcgacccgatctggacctcaggggccccctcacagacccccgcgacgcagctccggcgcttgctccccggcaccctgcccacgccagggtcccgcttctccttcggcacgcccacgcccctgagggccgccagcggatcaccgctgacagcaggcgatgcgacgccggcaaggtcgtccgtcgtgcagnnnnnnnnnntcgactgtcgtgcagccggccgccgcaacgccggcggcggtcgtgccaggggggctccaggcgccagcccccacgcccgccacgggccgggcgcccnnnnnnnnnngtcacccctggcagcaggcgccgcgacgccggcaaggtcgtccgtcgtgcagccggccgccgcgacgccggcggcagtcatgccaggggggctccaagcgccggcccccacgcccgccacgggccgggcgcccnnnnnnnnnncccccctggatcatgtgcattgcccccccacacacatgcaaacccaaaaagcaaatgccataccccctgcagagcctgctgacgcctcgcacaggtnnnnnnnnnngggaccgcggcacgctccggaggcaggctggacgctgcggccgtggcagaagccctggccggggtgatcggcagcggggacgtgacggtgcacatgccggcggtgggtttgggaggtttgcgtggggagggaggtcggtggagccctgccatgctgagcgtggtactggctctgcctgtgccccggtgggtggctgcatcagggaggcaaggggcaaccagcaagcccctggatcatgtgccttgccccccccacacacacatgcaaacccagaaagcaaacgccatacccgctgcagagcctgctgacgcctcgcacgggtgggcaggggcaggcctacgccctgaccatcacccccctgccggcgacggtcacctcccacgccgcgcagcccagcacggcccgcgcccgcagccgcctgtctctgggagttggacaggtgtgcctgggggggtgactgtgagacaggaggggtgtggcatgcaatcctagtggaaggatggggtgtgcactcagtcccagcccgccttgcactggcgtttgtcgtcccacccccgttgcctacagtgcttgaactctggcatccactccactgcaacacttcgatgcagagggcgttggacgtcaccgaggaggtcatgagcgtgcagcagatggaagaaggccagggctccccgcccgccaccgtggcagtgatggccgcctcgccgccaaagggcgagccaagcgctgcgacgtcggtcgcccgatcgacgnnnnnnnnnncgcacaggtgtgcctggggggcagcctgaggggggactctgagacaggaggggtgtggcatgcaagcctattggaaggaaggggtgtgcactcagtcccagcctgccttgcactggcgcttgtcgtcccactctcgttgcctacagtgcttgaactctggcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagggccagggttccccgcccgccaccgtggcagcgacggccgcctcgacgccaaagggcgagtcgagcgctgcgacgtcggtcgcccgatcgacgcaggctcggtccgctcggcgagggtccggcagggtcatcatcgtcgactcccctgccgcacgcgggccggccgcggccgcacagcccgccgcccaggcggaggaggccgccgcacaaccctcgctgcagctgacccccttggtgcgggctttggagtggcagctgaggcaggccgagggcgccacccgcgccgcgaacgcgcgcgcggagcgcttcaggaaggtgcgcccgggaggggggaggacagatgcgtcggcctggcgaatggatgtcttgggcggtgatggcggtgatcttttcgcacctgtgggcccttttcgtggccgggagccgcccccgcccccaaacagatcgggtgtccccagccccgtggcgcctcactctccggccccgctttcctcccatgcagacggcccgggcgctggagagcgcgctgctcagggagcgcagccgccggctgcagctcgaggccgtggtgcgtgctgcgctggcggccgaggagggagcggcgacggctggtgacgaggacgaggccgtggatgagggggttgcggatgagggctcagagccaggggtcgctgaggcacaggaggcggaccccccagcagcacagcagcagcgggtgagacagggggtgagaggggttgcatggatggtccaggacgggcacctggattgatgcatcagactgggcgaggttcaggtgtcttcaggtgtcacgccgcctgccacgagcgatagctcggagcggccgttgcttttctgtcagagggcacgcatcgtgcgcatgcagaaaactctcttcttgaactgcttgcgaacaccagcccacgatcgattccccttcccgacccccaccaggtggtggtggtgggcagcacggctgtaccggaaccctcgcgcactgtcctggcaggagcggtgagggtggtgcggaccagtccgccacttggagttccctcggccacgacgcccactgtccgcaccctgcccggcgcagcgcgcgtctgcaggcccgccaccggccccgcggacgccccccccgcgccgccctcgacggtggtggtgttgcggcccacgcagggagcgccgcccgcctctgcgggcccctccaccgtctggcgccgcggtgcgagcagcgcgcgtcgctcgctggcgggcgtcgcggtgcccgagtggctgcacggcgaagaggacgccctgttctacgcctcgctttcctcccgcctggcggagctgggcggggacgtgtcgggggccgaggagcctgccggtggagctggggttcctgcggaggtcgacgacgaggtggctgctgtgcaggcggaggccacggtcgcgaccatggaggaggctactgttgcggttggggaggccaccagcgcggcgcctgctcccccacgagagtcggcagagcagggtcccgatcccgcggccgactcaggctcggaggccggggagttttgcgcggtctgcggcagcagccaggagggcgacgtcctgctgctctgcgacgcatgcgacgcggcgtgccacctggcctgcgcgcgcccgcgcctgcaggcggtgccctcgggcgactggttctgcggcgagtgcagcgcggccgaggcggcggaggaggaggcgaagggagcgcggagcacgcccgcaagggtgaggaggggcgaggaggcgaagccagcggggcggaggggcaggggcgaggccgagcctaccgtgagtgagcaggagaggggggccaagccgacgaggagcagtcacaaggctgaggtagtgtcggcaaggagcagtgggaaggaggaagccaaggcgacgaggagcagtcgcagggacgagaacaaggcgatgggcaccggcggcaagggaggggccaagccgacaaagagtggtcaggaggacgaggtcgctcccaagggaaagaagcgtggagcctctgcacgcacctccgctccagcacaggtgggaagggaggtgacccaatgttgatgggtatggaaccaggtgggttggacatatcgacatcctgtgcatcagcccagccacattggcggcattgcagggggggatttttgccgacctcgacaatccacatgcccccctgcctgcctggcagagtcctgagaagaagcgcggccccggggcggggcgtcggcgggagcctgctgccgtggtggagggtaagcaggtagccagcccggcgcagagccggcggtcgacccggggcacggcttcccagccggcgacagggagcgccgtcgccaaggcagcctcccggcgcagtacgcgctccgaggcgggcaaggacgaggcggataccgcacagaagcggcgcacgcgccgcggctgaaccttgcacatcgtggctcgacctccagactgcggcctcatgttgttgtaacccatctgttctgagcatgggctgccaatgttaccaggttgacactacagatggccggccttacagaggggcactaccatggggcgatgaagaatgtcaggaggcaagggcgcggcaggggaagaaagggggaagaagcaagcgcagcgggtaggcgggcgtctgatactgagcgggattgcccaaaggggaatgggtgggggggggagtgcggcgtcggtctgccaaacgcagcatccacaggacgacgccatggtggtctcacgccccgccctcctcttcacctccttcgggcccagcctcgcgctcggtccgtgcgcgcgaggccgggcctgacccggggctgnnnnnnnnnnaccagcctcgtgctcggttcgggcgcgcgaggccgggcctgacccggggctgtcgttgccgctgccagcgtgcagcgcgtgggagaggaagtcgtcggtggagccccagcggtcagtcataccatccagcgctttccgcttgcgcttggtctggcgcatggcctcccgcatctgcagccggtcgcggcggcggcggatggcccccgcgtgccgcgtgtggtcctcgggggtgtccggcgccagctcgaaggggatgtcctggggcacgccggactcgttcatggacaccacggtggcgtaggcgtcgccgcactcgaacaggccccccgcctcgggcgtctcggcccagacgctgatcatgacctccacgctggagccgaagatggcggtggcctgggcctcgatgtacatgatgtcccccacccgcgtcggcgcggcaaaggcgatggagtccatggaggcggtgagcaggtaggccccgcgcgcgacgcgcgccgccgccacgaacgcgcactgctccatccagcgcatgaccgcgccgccgaaggcgatgcccagcgagttggcgtgctgcggcatgatcagctgcgtcatgtgcgccgccgtgcgcgcggggcgtaccacgcacctcgcgccgggggggcgtgcgcccctctgtgaccccgggccctcggcggcgccggggccctcggtggcagagacggggccctccccgccagcacccaggcaggtcgcgctgcccaggctgggcagcggcgcctccagcgtggcgcgggaggggcggtgggccacgggcagcagtcggcagccggcctccgccgcagccgcgtccgggtcggagcgcaggcgctcgcggtccgccaggcgcgcctcccgcctggcagccgcctcgtcgaagatctctgcgtgacggagacgggaggacaggattcggattagtggggcggtctgaaaatgtggatgacacccttgctactggcagggggacacgattgcgagactgacgcgggcgagagcaggtatgcaaagcagcagccatacnnnnnnnnnngccggcaggggcacacgattgcgacactgacgcaggtgagagcaggtatgcaaagcagcagccatacccccaggaggaggaagaaggggttgtacacccaacccccgggtcacctccccccctcctcaccctggtagtnnnnnnnnnntggagaaggggttgttcacccaactcccgcgtcacctccccccctcctcaccctggtagtagctgtcggtgggcacaaccttgggcggcagcttcttctgaggcggagccccgccgcccgccccccccctccgcgacagcgcgacaaaggtgaggtaggcggagcagcagtggtggcgcgagccggtggacaggtcctcctcctccacctgcacgcccacctccatggaggaggcgaacacgcggttgaccatggcggcgatggtgacgatggactggaggcggcaggggcgcagaaagtgcaccgtgtccaggctggcggtgaccacgggggcgcgcgccagggtcttggccgccaggcccgccgccacgtcgatccaggacaggacggtgccgccggagcagatgccagcgcccgtggtgtcggcgggggagacaatctgggtcatgaccacgcgcgtggagggcatgggcacctccacatgggacaggttggtgtaggagggcgcgcgcggcatgccgggcccccccgcgccggccaggctctgcagggagggtgggcgccgcagggacaagccctcgtggcgctgcaggaagtccatgccattgccgttgctgggcttggactccagatccttcacccgggcggccagggcctccacctgattcatcagggcgatcagggcgccggggtcagccatgccggccggtgggtcggtgggtgctgcgtcgacacgggcacggggctgtcagcgggtcccgccgaggcctccgggtcggtgaaacttatcggtggtacttgtgagggggccgtggcgtgtggtgggggtgagcgggaggaagcaagccttgtatcacactggacatcgcgccctgcggggtgggcggagcctccggtcaggaggcggggtgcagtgggggtgggaggcttcaatatttgctccaagggtgccggctacttgctaatctggcagtgtcgatgcatgggcccttgtgatggcccgcgctgggaaagggcctacccggatttttcacgcgatgacagattttcccgggggggcgcgttttgtcctccgaggaaaaattggtgaagatcccctatccgttattagattgcaggctgttgattgacagcacagcccggacagcatgctgcagcatacatcagggtagtttacaatgatgttaaagatcaacctccatgcagggtggagatgaacgttatccggtcgccttgatcaactattgtgtccaacgttccactgtgttgggggagggagattggacttgcagtgttgcagcattgtagtcctaatggcgtgccactgttgagggaaaggacaggaagcagcacctgagagactgcctgaacgcagccgttgcacatctctgacccacctgagttcccagtcgacatcattcacaaggacaaggattccggggcgcctgggagatggattgggtgcaagctgtgaaagggtcttcgtatactattcagtgtcagacagtatgctgacttcaattgccaaagcctcaacgtatgtgtcagacaacgatgaagctgtgccgcctgtctacaatcaccaactcccccaattcacttacacagatgatgcttgcacaaagagctctggccgcgatgtcagcacattgtcccttgcccagaagatcacccgacttagtgtcacctacatgggatgatgagatgcaaaaagggccccagcaatcgctcagacagaagctagaatctcgccaggtcccaaggaggcttttgatgtgtagtatgtggtgtggagcagcatcatattcattgtaatcttgcccttttcactacggacctcctctttgccgtcctctgctgggacgtcgaccgagatagacttctgattatcgaatagaagatccaggcccccactgcatgattttggagttcattggcattcgtgacgcattgctttctggacgatcgaggtatgtcactctccaggaatcctacctgaactcgagcaccaccttcaccatcgggggatacacgcgcgtgcgctcccaatataggtacctaaagcaagagtatctaatcccgtgtaagatgctttgcaggaattatggtgtggaggcatggactccatgtgggcagcttgcagggactcgtacgtgctcgtggaccccgttgcgcattcgagagcgcgaagaagcccagtgccattccactcctggagtgcgagagtcaaagtgtctcaaacatccggtggatcctaatctcaccaacttcccttggatacagtagnnnnnnnnnnaactcaaagtgtctcaaacatccgatagatcccaatctcaccaacttcccttggatacagtaggagtctcaatccaccaggcttctgacctcgacagaataggctctctgcaccccactgtgccgggtcgtcctctcctcgttgcccgccatgcgaccatactcagccatcaacacttgcccagaactctgaatcggaaggtggaggtcggcagggtcgtgggccaggcatgcggacgcgtctggaaggcccgggccgctgcaagtcgggctgcggagtgctatgaggcatgggactccctgctgacgcccgggtgtgcccatgtccacctcctagcttgtgaccaggtcagaagcgccatgcatgtagacctgagcagcgtgtatgtgtatgctggacctaatgctgccattttgtcgtcgaggctggatgaatctgttaacgattgccctcccagcctgttgcccctgcagatccagcgttgattcacccccgcctctccaatgtgcagatacaggacacgtatgtcgtggagaggtatgcatccttgctgcccccgtcggagctcacagcctgcggcacagcgcaagagcaggcagtgcgggaccagaggatcgtctcccgtggcctcttgcgagagaccctggccctctacctgccagactgcacaagtgggcgagagctgaggctggccaggggaccccatggcaagccctgcctcgcgccagatgggcatcacgagccctcggccctacacttcaatgccagcaacaccgtccacaccatgggtgcgtttggttgggagcacattgttattgctctctcgatggccttcttccgaaggagtttggaaaggtatacttgtccagtgtcagcccaagcgtcgcaagttatccccacatgaaggaagccgatacctctcacatggtcggcattcaaattgacgtgcagcagactctccttccagcatgcacgcacgaccgtcctcaaccgacgcaggagtggcggnnnnnnnnnntacattgtcattgctcgctcgatgaccttcttcggaaggagtttggaaaggtataattgtccagtgtcagcccaagcgtcgcaagttatccccacatgaaggaaaccaatgcctctcacatggtcggcattcaagttgacgtgcagcagactctcctcccagcatgcacgcacgaccgtcctcacccgacgcaggagtggcggtggcgcagggcggagaggtggggctggacctggaggcctgcggccgcctggcacgcaacgacccgctttcctttgcgcgacgcagattctcgcccctcgaagccgaggccatgcaaggtgcgggcggtgtgtttggccgtcgtgccgcagggctcaagcgggctctgtccttctccagcagctgccacgcgggccacgacgttgttgccaattgcaacggggggcccctttccccgccctcccctcgccagggtgcacgagcgaggctgagcgcagggccctcttcatccgcctctgggtgctgaaggaggcgtatctcaaggcgcggggcaccggcatcgcgggctcctcgggcctgagaagcttcgcctttgggattgaagatcgtgccggcagccccgcgcacatcagcctgcgccccgacccagcccgccctgacggcgactggaccttctggctgctcgagccgtggcatggcgtgctgtccgcgctgtgcatgagcagtggcgtcagcgaacacgggcccgagggggcgggcttgcgcctgtgggcgatggacgccgagggggcgcggagggggtgccgaccagcgcgcatgatcgcctgcgggcgccacactgcgcagccttcctgggaggacggcccgacccaagcgaggtcgaggctgtgatgtagggttgtctggcagcgggcaggtttacagttggttgcctctgcaggcctgcttctgtctcatgcagaagcttcttgcccatatggtcctgtgttggtagagtacttgacggccccctcctccgtcttcaccccttgctgctcctcgctatattcttgtagtgcacaagccatgatagggtacagcaatgagtgaattgggagagtacacgggtacaaccactctaaacagctgtgaccacggagggggggcggagtgggggtccagtggtggctcccgtgaagaaggagagcaggcctgtcgcctgtgtctgcaggcatggagttgggtgggcatctgtgaggcgggccacggccagggaggcagcggctgtgcggtgcggctggcgtttgctcacacgggcacgagagtttgtggggcgttggcccgatttctggcctcctttgacacacatacacacacacaccaggcctcacacaccagaccagcccccgccccacacacctctggcacatcgtcgaggaagaggtcatctggcactttgtacacgccatgcagtcccaccacgagcgccgagaggccaagtgcgtagaagagcacggcgccgacggaggtgaggaagaagacgacgaccagggacgccaccgacaggcccagaaacttttcgcgatcggagatctcgcggccgttgaagacaaaggggccagaccgtatgaggtaggcgtagaaccagaccagggccaggccggcgagcaccaccacggaccagggattgaagaacatgaccagggcggtggtggcgatgcccacgatgccgtagttgaccttgaagtacgcaaagttcttgcgcaggcgccccatggcctgggagtggtgggaagggggagatcgggagggttggtgggggggaaggagccaaccgcagcagattttgggggaacgatcgaatcccacaacgtcatggagcgcagcagtcgagtctctcaggggcaggtcccccttaaggaccagctttccagacctccatctgcgccaaatagtatcctgcccacctcggtggagccgtggaacttagcaaaactggaccgctcgaagacctcggaccacggcctggcctgtaatggggcaccataggctacttgagaggcattcgacctgcaggatagacagggaacgagcaagacccctcgtccgtccgacaccatgtcacctgcccaagggaggctgctgcattctccttcacgttgttgtacatggtcgtcagtatgctggcgacattcgtcctcgaagactcctgtgcgtcgcttccgaccgcgaccacggtgccaggtgctgcagcggccatccttgagccgtgtactccgacgaccagggggcaaggtgtgcctccactgccagtgtctccggcccgcaaacagagatcaccgtcttaatatagtcaaagtatggcaaatagtatannnnnnnnnnatgccagtgtctccggcccgcaaacagggatcaccgtcgtaatatagtcaaagtatggcaaacagtatagtgatactgttcaccgccgtgatgtgcatggatctcctccgcactccaaacgcgcctgggcctgggcgcacaaccaccattttcgagggagtctcgctttccagcttgcattcggccccagatttcatttcggtctcccaagaaacaaaccttcgaagcacatgtctaataatcgtaggtgtgatgcagcacctcttcaacgagcaaaacggatagctctatgggcaggaatgtctccagcttgaagcccctgcacttcaggtggcacacattgccacaatgtttctaattaccattggggcttcttgaggactgatggacccnnnnnnnnnnctcgaagcacatgtctgataatcgtaggtgtgatgcagcacctcttctacgagcacaacggatagttctatgggcaggaatgtctccagcttgaaccccctgcacttcaggtggcctgtcacaccacacattgccacaaatgtttctgattagcattggggcttcttgaggactgatggaccctcccatacaacatgccctaccaaggatcacatggccccctcgaacctacctgcaaccaggatgcatgttttgggatcagacaggatgtcttgctcatacgctgcctggagtccagttacagacttgtgcattcctgatcatttcaacacagccctggtcacagcactggagnnnnnnnnnncccccctcgaacctacctgcaaccaggatggatgttttgggatcagacaggatgtcttgcacatacgctgcctggagtccagttccagacttgtgcattcctgatcaattcaacacagccctggtcacagcactggagatggcatgagatactctctatgtgcccgatgaagggatcccatgggtgctgacgtgttttaacttgcaacatcaggatagagagcacccaagggcaggagtgcgttcacgtctgcgctgtcttctactccctccctgtnnnnnnnnnnaaacttgcaacatcaggatagagagttccccagggcaggagtgcgttctcgtctgcgctgtcttctactccctccctgtgagggagagatcctgtccctcccctccacaatctcacaaagtgcttcaaatactctcaacagaaaagccgtaccagtgcaactcgcctaggagctgcaaactcagcccattggacacagtaccttggacccagaacaacgtatccacttgcccgcgcatcaggtggtctgtcctggtaagaggcttatgacaaattcgctttagaacacgattcccggggaaacgcagctgtgagtgggcagtagtaagggtggcatgagtcaaccctgggactgatccagtgtgctgtgcatgatgggctaaacctcccgatgcacccattcccacgcacgcacctgttacgagccgtcaggcgcatccgggcttcaaaaggtgggctccaagtacagagggaggtgggttaggnnnnnnnnnntcctgttgcgagtcttcaggcgcatccgggcttaaaaaggtaggctccaagtacagagggaggtgggttaggtgcatcgacccgtcaccatgtctcacagcctgacaggctgcaccggggcccgggcccagggattcttcaccaccacgaggccacagctggtacacagcgcaccggggctctgcagacaacagagacccttcaggaactctatcaagtgctcgtacaagagtctgggcagagttgcggtgagaggggcgccctgcatggacgcgatgagtccccatgccgtcgtgcgagttgttagccgggtacccaccgtccatggccccaatccacagggccctatcaccttggcgcggggaagccgtgattccgacgcatccaagcatcatgattacgtttgggagtgagtatttggcatgttattgtgggtcccacaaatgcattaattgcatgggacatatgcagtggatgacgccctccgcagtggcacaacccctcctcatcatcggtacccttcacatgagcagaccgccggcgcaagcaggagacgcagaaaacaggtcgagcgagctgtggagtttgcagggccagattctggcggatctgagggctcagctgcagcaggagagggaggccaggagcctggaacgtgcggagtggctggcacagatgacggcgctgcacgaagagagccgctccctgcgtgccgaactcctgtcgctgctgggcaggcatgtggcgggagcccacgacgcacatgtcactgcggtggaggcggcgcgcagcaccaagggcggcggcgcagtccttcctgcatcctcccctgccgctgtgcctgacgacgatcgctcggagactgaggtgccgcagcctgctcccacttctccacccatgagcagtgaccaggagacggagcgcgcgccctggaaggatgacctgcgccttgccctggcggcctcggaggacaccgacatcctgagcatccccgccgagaactttggcgactacctggcttcccggcggagggccggaaaggacgaggcggcacagtctgggggtgaaatgtcgccggagcatgctgtgtcactcccaaccatggcggcacagccagtggccaagctggatcttggcccctccgaccctgcccgccctgccgccccccctccaggccctcccccactgctgcgggagggcgacgacgacatctcctggatgaatgctctgcactctgcgatggcagaggccgggtatcacgccggcgaggacgacgaggaggagtggtactttggctccggcaccaccagcgccctgctgacgctccaggtgaggggccgagggccgtcggctggcccgcgagcgtggcctggagtgtcagggcctgatatctgcctgcaggcaggctgcacgtcaagagttttacgcccctcaccgttccttgctttccttccaaatttcaaagcaggcgtgcgagggtctggaggagacgggcgtggcggacgaacccacctggcgcttcctgctgggcgatgcttacgacgcgatggtgaacgcctcagcgcagggcaaggctgggccccagtcgggcggcgtcggccctggcgccgacgccggcgacgcagaacccgagctctttcttgaggcggcggagctgggcatcgatgcctggatcctggaggaggacggcccccctccccccggcacccccccgcccggccgggagaggggaggcgggggcgacggcgagcggtggcccatcctgaacgagggggacggcggacgagaggtgaaggccatgcagatcgcgctggacggcgccggtttcttccccggcactgacgacatgcggtggtggcagtttggcagctcctccatgcgtgccctggctactttccaggtgtgggggaggagcattggggagtaaagcgggagaggtgcctgcctatgcggcgctgggctctgggatgtgggatcgggggttgggacaggttccaagtggtgtgccggctctcggagcagagccagcgcacccacagtgcgacgctgcagaggttccagtcccaccccccctggccacccaaccctcccgcgcaggcgtgcaatggcctgcccgagagcggtgtgtgcgacggagcgacctggcgcaagctgctgggggaggggtcgacccctgctgacatcgccatcctggctgagcgtgagtctctggtggtggcgggtcccttttgcgatgcttgcccagggaagtcggcgctgtgggggaggctggcgtgaggttcttcgggcaaggctgtgctttgtactcactgcatgctgcaatgcgcccatgccacagagcacgcggagggtgcagaggacgaggacgatctggcagggggccaaggcgtgtggctgcttggggaacagcgctgggagaggccaggcaggctgaccaaggattgacagcccggcggggagcatttgagaggcgttgagagagccaacttccctggaattaattatcatgacgctgatcccgccccttgaaattgattgggcgatgtaaggccgatgcacctcctgtcagtgatgaaggcgccatgtgccagcaagtgggcaagcgccgatgcgatgttgacaattgcgcatcgcgggtgcatgccggaatgcacacgctgagtgagtattctaaattggatacaacgcacacgccgccatcgaggagtcctagcccctcgcgcaaagattgcattgactgcgacaccctgctcactgggccggcatgcaggccgaggcctgtgccgcgatcgtcagcgtgcctgggtctaggtacgccatgggtgcactcgagcagtgcatgggatttgtttgggccggatgcgagcaccatgtgtgcctttgtttggaggggttgctggcccgaaggcctccccggcaactcatcaagaccgcttccccctccccaggctgagcctgtccgccgagcaccgtgtgaggccggtatttggtacaagagtgtcgaaggagaggaaggcgggtcaggccgaggtcctcctcgccctcctcaggtgggcgcctgtgcctgcgtagtcctgagaggctgcatgcacaacccctgcccgctctgggagaccttgtcatgctgtcctcatccctctccaccctccacatccatccttgctccaggcgacatgcagcatgggtgggcctcgccgccccactcctgctccaccccccggcccccgccgccgcctcctgccccgaaccttggcagggcggcggtgtgccgccgccgcacggcagcggcggcgactgcaggcccgtgcgcgtgcaggggcccgaggaggtgttccagctggctgcagggaactccctcatgctcaccatggcctcctttgccgtgacgcggcgggcctactccaaggtgctgggacttgtttgcaccaaggggggatgggtttgaaggtgtggtgagcttggcaccgggttgtcccgcgcgggccagcaaggcagccgcgccccaaggtacgccttgtccaaacccatcctgggcagctgatctcctgggcctgatgatacctggccctgcatccagttgcccagccatgctgcctctcacacacacgcatcatggtgacactgcccccacacgctcccccccgcagatcacccagatgttcatcaagcagtaccgggagcaaacgggcgtggacgtccgcttccggctcagcttcggcgggtcgggcacccaggcccgcgccgtgatcgacggcctgcccgccgacatcgtggccctggctctgcccctggacgtgatcaagatcgcagaggcgggcctgctggaccccgactgggcgcccaagttcccgcaccagagcatcgtggtggagtcggtggtgtccatcgtgacgcgggcgggcaaccccaagaacatcagggggtgggacgacctcatacggtgcgtggtggtcggggtttgggggagggaggggggctgcaggcacactgatcccggagatcgctgccaggtgcgcggcggcgctgccgcagcctgcaggtcgcgtgccggcgcggtagttcgggcccctcacgagcagaccgatctgcacaccgacccatccacacacgcacacacacgtccaccgatcccccctctccccccctcccccttcatagtcccgacgtgagctgcatcgtggccaacgccaagacggcgggcgtggcgcgctggatcnnnnnnnnnncgtagttcgggcccctcacgagcagaccgggctgcacaccgacccatccacacccgcacacacacgtccaccgatccccccccctccccccttcccccttcataggcccgacgtgagctgcatcgtggccaatgccaagacggcgggcgtggcgcgctggatcttcctggcgctgtggggtgttcgcgctgcgcggggcgaggcggcggccatcgactacgtgacgcgcgtgtacgaccaggtggtgatccagccgcgcgacgcgcgcgaggcctccgacgtctactacaagcagcggcgcggcgacgtgctgctgacctacgagaacgaggcggtgttcaccaacctggtggtctcgccccacgagcagctgcccttcatcagccccgacaacaacgtcagggtgcgtggcgtgggggctgggggtttgggggggcactgcgccctgcacgaagccatcacatcgcagcaaacagccccgggggcgggtccccaccctgagacgcccgcaccctggaccctggcaatcgccgccactcgctctcctgctttccaccagatccagtgccccgtggcgctggtggaccggaacctggacgagggcgggcccgtggcgcggcacgccgccaccgcctttgtcaactacctgtacaccacggaggcgcagcgccacttcacggcctgcggcttccggtcccaggacccggagctggcggccgccaccgacctgccggcggtcaagggcctctggacggtggagaaggagttgggcacctgggcccagatcatccagcgcttcttctccgacggggtgcgggcgcatgggaggcgtgggggggccgaggagtggggggggtgtccgcggtgccagggagctcagggactcgacggtgggatgctcgtgatgggagggtcannnnnnnnnnataggtggtccgcggtgccagggagctcagggactggacggtgggatgctcgtgatgggagggtcaagtggggtatgtttcaggggcgcatggagatgcggtggccatggcgggctgggcttgagcagtgtgcacaagccagggggggctgtactccgtcgcgtccatgcacacaagagcgtctgcacacgcnnnnnnnnnncatgcggtggccgtggcgggctgggcttgagcagtgtgcgcaagtcaggggggcctgtactccgtcgagtccatgcacacaagagcgtctgcacacgcgcacttctcatgcccatgcagggcatactggacaggatacagcgggatgtttctcagcgaaagctggatgcacggctggggaggacgcccagcaaagccggagcgcccgcctgagcgacacgcacttgatgttgaaatcccttcccttttccgcacagtgtcctccttgtggctggacatccacgttgaggtcctgaagtcccccagacgcagtcccttgccggcagcagtcagggtgttagccatgagggccagacagatgcccggcaatgagatctgagcgcgcnnnnnnnnnntcccagacgcagtcccttgccggcggcagtcagggtgttagccatgaggaccagaccagatgcccggcaatgagatctgagcgcgcgcgcacgcggctgaatttgctgcctcggagacagcgcgctcgggcaacgtgctgcccttttaggaatgagacacattcattggtatggactggtcgatcctctcgagctcatcgaccttcgagagacattgtctgttcgtacgggactgtgggcatagggcgcgaannnnnnnnnngctcgagctcagcgaccttcgagaggcattgtctgctcgtacgggactgtgggcatagggcgcgaagtctgtacttgccaaggaaggcgtgcccagggtgcacaggagagcgttcccggattctgaattcatcaagcagtttttactcggaggatcagttcctgctgcacggagccacccggtgatcatcatgtatgctgggagggtgatcgccacactgccgtgacgggctgtatgcgtctgtttgcgcacatacccaccgtgacgatgaccctgtatgtcgcaggagcaaggtcacattcaaggtcatcctgacatcggatcccaagctcccctaccgggtgttcagcgtgcccgaggcagctccattcacagcagtcctccgcttcgctgccgaggaggtgcgcgcgagtgggtttgggggccggatgaagcaagaatgcccgtgaccgggggcggccgacgcatgcttcatgcgagaaggagcccgtgtcatttctgtccctggcccccatatccccgcagttcaaggtaccagcagccaccnnnnnnnnnnctgaccgggggcggccgacggatgcttcatgcgagaaggagcccgtgtgatctctgtcccctgcccccacgtccccgcagttcaaggtaccagcagccaccagcgccatcatcaccaatggtgagaatggccatgcttccactgctttcttgtgcagaggatctccaagtacagcatacacgctcgactcagcctgtgccatgctgcatgcctccagaagcatcccccgacatctcatgcaaccctctaaccccttggcagacggcgtcggcatcaatccctcccagtctgccggcgacgtgtttctgaagcatggcagcgagctccgcctcatcccacgagacagagtcggggctgcagacaggtgtgtatgctgaagctgggccttggagctcttcatgtatctctgtccatcagcccggactggtctgaatcccttgcgccctggttgaatgggttgctgtttccgctttcatccgtcacatcatgagggcaccgcctgaaggatacaggcgctgtaataagagcgatagtctgagtagagtcagtgagtgcgtagttatatggcatttgaagggatagggcaatcgaggatggtgctggaccacgggaaactgactgcctctgccccacaataccagctgagccaacatgcatccgcaggctccatagccgccctggactccctcaggaccctcccctgctccccgaccgacagaaatacattgaataccatcacttcatgagtgggannnnnnnnnngagggcaatcaaggatggcgctggaccacgggaaactgacggcctctgccacacaataccagctgagccaacatgcctccgcaggctccatagccgccctgaactccctcaggcccctcccctggtccccgaccgacagaaacacattgaataccatcacttcatgagtgggaaggcgatgacatcgcgtatgctgggcgagtctgtcagcagcatgacgaggcggtcgatgcccatgcccatgccccccgtgggcggcagccccacctccagtgccgacaggaagtcctcgtctagcgccacctcatagtccacgtctggacccgcgccgggc

SEQ ID NO: 33207 - DNA, 61 bp, Chlorella protothecoides
aactcacgtggctgccgggagtgagaagaatttggaagtgcacgcgccctgggagaaggag

SEQ ID NO: 33208 - DNA, 77 bp, Chlorella protothecoides
gaatgcggatgagagacaggaggggcgatgtgggagctcacagttcattaggttgcgcgcgcccattcacggcagta

SEQ ID NO: 33209 - DNA, 78 bp, Chlorella protothecoides
atgtgatattttgacactcggtaactttgattctatagacccgattgacctctaacaagcttggttcgtctttatatt

SEQ ID NO: 33210 - DNA, 71 bp, Chlorella protothecoides
gttcatgctcctttcacatttcactccttctctcttttttgggtgatagtaccaccttttgtgcatgtctg

SEQ ID NO: 33211 - DNA, 96 bp, Chlorella protothecoides
tgagccgctcgggaacccttgcctctgtcaggcctggacccgatttctcaccggcttgccatggttacgggaatttggtgcatcaatgcatcgtgg

SEQ ID NO: 33212 - DNA, 61 bp, Chlorella protothecoides
tcaccactcttcatagggtcttccaaatccacccccccagtcccctccactatccacccta

SEQ ID NO: 33213 - DNA, 80 bp, Chlorella protothecoides
cagcacagcattccctgcggttggggggtgatgttcggagctggtttccaattacatctccctcccatactcccaagcgc

SEQ ID NO: 33214 - DNA, 79 bp, Chlorella protothecoides
ccctcctgcctggcccaccacccatgcgcccgacaccccatcccgcaatccatgcgcctgacacccagtcccgcctgcg

SEQ ID NO: 33215 - DNA, 90 bp, Chlorella protothecoides
gcagctcatgcctgcagaccatgcatcctgcctgcactcccaccacactcttcccataccacgcaggcatcagaacccacgcagccctcc

SEQ ID NO: 33216 - DNA, 151 bp, Chlorella protothecoides
ttccctgggggtcgcaagggcgtgtgcaaggccggcaaacgccgaccagccagggtgcacgacggtggtgccaaccgcacaccggccccaccgccccttgtgacgacaccagctcaaggccatgtcctcgcacccataggaaaagtggctg

SEQ ID NO: 33217 - DNA, 438 bp, Chlorella protothecoides
  modified_base (147)..(299): a, c, t, g, unknown or other
agcgcctacccctccctccgaccccgccacgaagcccgctgcgaggggcaagaaggccgcggccaacggcaagctggctgacctggcggacgagtcgttctggcccagcatgggagatggccccgccgtcgcgtccgccccggtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggcggacgatggcggcgcggtgcctgccgacggggtcgacggcagcaaggtcgcgcctggtgagggctccgagcccgcagccggcgtcaagcggagcgagggctctgtctccgtgggactgaccgtgcaccaaggg

SEQ ID NO: 33218 - DNA, 73 bp, Chlorella protothecoides
tcgcgcactgccaggcctcgccaccgggatcccaggacccctcgcgcactcaccttgttcaggaggttgagcg

SEQ ID NO: 33219 - DNA, 78 bp, Chlorella protothecoides
ggcggcgctggccaagcgcaaggaggccgcagagagagtcgacggcagccccgccccagaaaccgacgccacagcggc

SEQ ID NO: 33220 - DNA, 154 bp, Chlorella protothecoides
agggggagggcggcggtggaggcttggagttgccaagatctatgccaaaaactatgccaggcagggtcgcaccccgcagcgcacctgacattccgagggttaagaacggaactgaattttgaatttgctaaggatgccggcgtggccgcgaagg

SEQ ID NO: 33221 - DNA, 409 bp, Chlorella protothecoides
  modified_base (106)..(347): a, c, t, g, unknown or other
gtgcacacgccagccagtccctgcagagggatccacatccccaagcaaatttcgcgccctaccactcacttccggaaggcggccatgtaccgccccgcctgccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacctcgaaaccggattgggaggtgtgtaaacccttgccgtgaagggtctgttgctcagca

SEQ ID NO: 33222 - DNA, 78 bp, Chlorella protothecoides
aaggagtggtagtagcaagcggactgtcgcagataagtggctgaggcaaccctaaggtgcattatgatgtgggttccg

SEQ ID NO: 33223 - DNA, 69 bp, Chlorella protothecoides
caggctgagcggccgctcgcctccccgcccagccccccatcatccccaggctcagggtcgacagcagca

SEQ ID NO: 33224 - DNA, 77 bp, Chlorella protothecoides
gcgcgccgccgcgagggcgggggtggccagggcgccgagcaccacctccagcgagttggggttcagctcctccagcc

SEQ ID NO: 33225 - DNA, 61 bp, Chlorella protothecoides
accagatcccgggcgttacgcgccccacgcgactccagctcccggtctcgcagcacttcac

SEQ ID NO: 33226 - DNA, 19919 bp, Chlorella protothecoides
  modified_base (190)..(199): a, c, t, g, unknown or other
  modified_base (751)..(760): a, c, t, g, unknown or other
  modified_base (1426)..(1435): a, c, t, g, unknown or other
  modified_base (3208)..(3217): a, c, t, g, unknown or other
  modified_base (3641)..(3650): a, c, t, g, unknown or other
  modified_base (5371)..(5380): a, c, t, g, unknown or other
  modified_base (5857)..(5960): a, c, t, g, unknown or other
  modified_base (6625)..(6634): a, c, t, g, unknown or other
  modified_base (7201)..(7210): a, c, t, g, unknown or other
  modified_base (7276)..(7285): a, c, t, g, unknown or other
  modified_base (7730)..(7739): a, c, t, g, unknown or other
  modified_base (9156)..(9165): a, c, t, g, unknown or other
  modified_base (9871)..(9880): a, c, t, g, unknown or other
  modified_base (10377)..(10386): a, c, t, g, unknown or other
  modified_base (10868)..(10877): a, c, t, g, unknown or other
  modified_base (11770)..(11779): a, c, t, g, unknown or other
  modified_base (12503)..(12512): a, c, t, g, unknown or other
  modified_base (13376)..(13385): a, c, t, g, unknown or other
  modified_base (14533)..(14542): a, c, t, g, unknown or other
  modified_base (15325)..(15334): a, c, t, g, unknown or other
  modified_base (15703)..(15712): a, c, t, g, unknown or other
  modified_base (15842)..(15851): a, c, t, g, unknown or other
  modified_base (15944)..(15953): a, c, t, g, unknown or other
  modified_base (18137)..(18146): a, c, t, g, unknown or other
  modified_base (18534)..(18610): a, c, t, g, unknown or other
gagcatgtgggagaggggggagcatgtgggcgaggggggagcatgtgggagaagggatgcaaggggagggcagggatgcaagaaacggcaatgcaatgcctcatgcaactccctggcatggatgatcatttattgtcaaggacagacgatccgaccccaccccccacccacccactcccccctacattcnnnnnnnnnnagggggggaaggggaggtcagggacgcaaggggaggacagggacgcaaggggaggacagggatgcaaggggcagcaatgcatcgcctcatgcaactccctggcatggacgatcatttattgtcaaggacaggcgatccgaccccaccccccccacccacccactcccccctacattcaaaccctgtaggagctggcgcgacgcaccgacaccctcatccgcctgatcgagaaggagaacgaggaggacgaggagcggaacgcggcatccaagaagggagccaagtccggcggcgcgccagcacgcaagcgcgccgggtcggtcacggcggcgtcctccgcagacgtcaaggagggcggcgacgacggcaaggaggaggtgggcagcgcgcgcaaggccacgcgcgctgcggccgcggtgtcccccgccaagaagtaggcaggaggagtgtttgttgagacagaggggtcttcatggaaatgaggtctcctcctcgagttggtgggtgctgcactgcagttgggagactcagacccctccccacctatggcgnnnnnnnnnncccagttggtgggtgctgcgctgcacttggagactcagacccctccccacctatggcgccgtcgcacctcgtgtggttgctcccttttctgatgtacacaagatggcaaagcagggcagcaagggtgcaatcacgctgcacggcgggtcaaacagcagtgtgcatgtgacaatggatcgagccaggcaacagctgcatacagagaacgtcggggatgcctgcctgctggcagcctacttgctttcaacctccagcaagatctcgttgatgcgctggatgggcagcctgaatgagacgaggaaagcttggcggatgattgacagagtgcagcgggatcaggatgatgtacaggcaggtgaccctaggcttacattccaaacgctttgcaagcacaaccctgccgactgctctccctgagccctatcaggaggaaaactggcactctgacagctgcatacccccagacaggccactccaaaaccactcacgcccagggagggtggtaccctgtgtttaaagcgatagtttagattttcgtgagagctccctctaacattgcatgtcaccctgcaatacaggcaacaagagcatgcacccaaaagctggttaacgtgataaagaatgccgatgcttgcggaagcaccagtccatgaacacccgtcaaannnnnnnnnngaagctggttaacgtgataaataatgccgatgcatgtggaagcaccagtccatgaacacccgtcaaaactgactcaccccagacgtgcacgcttcccgtgctcttcacgcccgccgctgccagcagggcccgcaactcttgcgtcttgctggccgtagtttcctcacgagggaccccgccattccatgtcagcacggccatggtgcgagacggcacctcgatgatcttgacgtttgggttgtcgggccgcggcagggtgtccttggtgtacttgctgggcatggtgaatgccacctatgggtttcatgagggggcagggacgctcctgcacctgaacctctgggaccactctgtttgaggttccctcctcaacccagagaggctgccacgcagccacggcatacagtacttgctctcttctgcaaagcacaatgcaagccacacaccagcacaaccaggatcagttcaccttgtagactccaccaccgtcctgctgggacatgactggcgctgtcatcccgatcttctcgttgtgcaccacttccatcgccacaggcgaggtcatggacaccttctcggctccttcacggtccacagccttgttcttcccgaagatgaaccccgccacctgcctgaagccagagcccatcgccttgttcatgtcacagccctccagtgtgacctgaggagtgtggttgcatgatgttgacgagtatgagggtctgacattgccagtcacacaagggggtaaatatggcgaattcagtaccaccctttgatggaattacctcagcggtcaagaaaggggcatagctccgaatctcggcagttgtgccgaaaaacggcgtctgccgtgtcttcagggtccttgtcaccacatactttggcttctcaagcttgcgaacctcccacctgcttgtgatgatgcatgcttctgaataggtaccactgtctcttgggatttgaatgcgtgcccccaggttctcctctccccgctgtttgttcaatgcatgcacgcaccagatcgcgatcggccatgcaacgagaagtgctcccgctgccgccgccacagatccagccacagtcgtgagtgcaaccatgtgtggagtcttgagaggttttaaaaatattgagaaagatgatagtgtgtgcatcaacgcaagggcatgttgtcgtcgacgtgaccttcccgccatcatggaaccatgacggacccccttgcccccacaatttaaggcgcaagcctcctcgctggggaccagaagtacaggcagtgtccgatggcgagcgtgagattgaggtcgtgcattccatcagggcagaactcaccctttgtaaagcacaatgtggttacaccgcgatgcatgcggagtcatggagccacactgcgcctacccagaccgttggcattcttcaatcgatggggtaacaaccccagtgcaacaatcaaggtgacattgaatctgtgtgctgagatgaacccggcagggttccacacaatggggctgctccgaccagctcctcggttgttttggatcgcaggagctttcggctctgcagcaagccctcaaggaggatccgctgccagccagctcgaccattttgaatcttgtcgacgccctggagagcagcaacacggggatcaaggtgggaaatgatgcatgtagttcagcacatgcccaccggcttgactcctgttctcctcgtctgtttctgccattcaagctagaaatctccacacacccatgtccaacccaggatcccacgcgatcnnnnnnnnnnatagttctgcacatgcccaccggcttgactcttcttctcctcgtctgtttctgctattcgagctagaaatccccacacccccatgtccaacccaggatcccacgcgatccccactgatcgagggccggtggaggctgctctacaacaccaaggagagcaccgcatcgccggtgcagagagcagccacagggagcaaaggtttatcaatcttccaggacatattgctgggtgatgcatcggccctgccgcgcgtcgtcaatgtcgtggagtttggcagtcttgggaagttggaggtgggcagcgcggggtgcagggtgggttggaggggagcgacggctcaggtgtataaacccaagacctgcaaactgttgtcattgactgttcatcccctcagcttgcatggaagagcaagccatccagcaannnnnnnnnnattgtcattgactgttcattccatctgcttgcatggaagagcaagccatccagcaaccgcgatagcactgtcttgcaggtggaggcgcaggccagcaccactgataggcctctggagggcttcatcccccgctctggtgccggcctgccctttggcatcctgggcgtcagttccacccagccgcccgacaagcctcacacccgcatagattttcagttcagcagggccgccttcaagagctcgaagatccccttccaggtcccctaccccgtcccctttcgcttgctgggggacgaacgcaaggtgaagggatgtcacagggtgggagggggggcggtgaggcagcacagggggctgagcaggtgggggttgccgggggtcgcgattgcacagaggcaggccgcatccctgctcatggccacgctgccccttccggtgcttcctcagggatggatagacaccacatacctcgcgcgagacggccgtctccgcatcgcgaggggtaacaagggcacggtcttcatcctcgccaaggatgacccgcctgcgagctgagtccagcttaaacttccagcagccaccctgacccacgccgagcccagctgcatcgtctcatgtagtaaaaaagctgttgtgaatcagaaggggtgacggctgttagaatgcatgtctggctgtaatacttgctgcacaattgccagtgtgcaggcgtagtcacctggtgtgcctgctccctgcctggattgatggcacgacatccgtagctgaattgaatctcaattctcccaggtcccaccagatacaatagtagttcccaggacaccctgtttggtacctggtgcggaagtactttaacatggcaatggagtcttcaatgtcggccatggcagtgtgcttgttcctccctcttggcctcgcctggaacacgccgcgcttccatctcttggccagctccacaaccgtggtcacgtcgactatcctgaggacccaaggccaagacagggcggctgctcaggcagtgggccaaggcagcacaccgggtcaacaaaccttaacagcaggaggtggcatggcggctgagaggcagcctgcaagatccaatccctgccaacctgtggtccaggcgttctgccaaacgcggcatgtgcaccctgaggaaagcgaggtcggtgtggacgctggagcctgcaagctgcgccttgtggttggccagaatgtgtttgtccagaaattccaacacctgacgctcagccgctgcaaggtcgatggtgctctttgtcactgcctgtcaagtgaaggagacttgctttaaatcggggtgggtgctaggggtgatgaacatccttcttcctcaacggtcaagtgtctccagcacccactatgcatgggcaactagtagctcgcattccccagggcctggtaacgcacctccttcagaccgctgctggtgtggtgctcctggcaccactcgttcattccctccagcacatccactggctggtagatgacgatctcaggaccttgaacttcctcggtgagagtgccattggtgaggatgacggcaacttgaagtatggcgtcctgtgcagggtctagccctgacatttcgaggtccagccacaccagtgggagcttgagccggccggggtggtctcgaggagtgttctgggccggcagggcatcccccaagtcttgcagcgccatgaaggcattggaggatnnnnnnnnnntaccagtgggagcttgaggcggccggggtggtctcgaggggtgttctgggccggcagggcatcccccaactcttgcagcgccatgaaggcattggaggatggcatgctgccgcaaaggcaaggggcgcagcctgctaagcagcttggaaacgacgatgtctcaagcacatctcatagatgtcccgataggacctagggaagtgaggatcgcctctgatgttagtggcggtttcgccttttcgagggggcacggttcaccctaccaacgcagatcgttagcatgatcgttatcgaggcgctcactgcatatactcaatacgcatgacactgataatgattgtgtgtggtggaagcgattatggttgtgggggaaggacatgcaagcgtttactctgtgcacaccccgcaccgcgcgcgcgaatcggaaggggaagacctcgacctctgctggacgaactaagagtctgcaccgacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcacggttgcccctggtgggagcagccatgacgagttgcctggtgtcgagagttcgccacagcgagctcgcgaccctcatacgaaacggctggtgtgcatccatgctcttgatcagatctcaatcaaacgatgtgagacccgtgatccactcgcccagcacctccccaccgcctgtccctcctcctgcgcccaagccttgccgtacaaacgtgacctgggatgtgatggctgggcggggcctgaaacccaaggagcaaccgaaggccacacgagatgttcaaagtctacaggcagccctcctggagtcggcgctgggccatgtggtgaggaggaggcggtgaagggttcaggtaacttgctgctggcatggaagcgcaagtgccagctgaaggtaactgtccttgcttggctgaacccacatcacacctcctctccattcctcgtagccgacccttggatggtcaaactctgcgatgcaccaggctgctttggacaatgacctctccccggcggcagctgggctccttggcgatgccccctctgatctggtcaaggtggggtgaaggtgtaggggctgagcatgcgctccctgaactccccctttcatgcagggttggccccgctttccaataaaccacgctcatcactcatgcagcatcaannnnnnnnnnaggatggccccgttttccaataaaaccacgctcatcactcatgcagcatcaacataaacccaccatcaggccttccttactcgctgcaattttgagttggaggaggctctactggaggaagggccccagttggagctctgtcccctgcatgccagaatcgtggctgctctgcggcaacgtattgagatgatcgtgccatacaaaggtgtgtgcgttgttgtgttgaatgacgtgttggggtgcattggtgtcacagagtgtggcaacggaacgaagggaagtggcagtgcattaaacatcaaatccgtggcttcaggtttgagattaccaccgactcatccaccgcactcgcagcctcctgggctagtgcactggcgaccctgggatcgccggttgccgccatggagctctacatggacgccgcaggcatcatctggagggcggtgggggacgagtccgaggacctcacgtggtgagctgtggtcttgatgaatgttcaattatctcaacagcgtgtgaaggaccatgatggggtattatggcccagttctgctggacacaacactnnnnnnnnnntgactcatccaccgcacttgcagcctcctgggccggtgcactggcgaccctgggatcgccggttgnnnnnnnnnncatctcaacagggtgtaaaggaccatgatgaggttttatggcccagttctgctggacacaacactcacctgggcgctgtctcagatccagaaaccactcctgggcctcaggctggcgcatcgcaccgtcttgagcggggtgctggcttcctcagagctgtatctgctcacggacaacagccctgggcacgaggacacctgggcggcggtggaccgggccgtgggcgaggcgctgaaactactgggcagctctgatgcggtcgggggggctctcgggggcctgcgagacaaggcctacgccaccatcctggatgtgatggcatccaggcgtggatgaggcaatatttgtcaggccacagtgttttgtagcctggcttcagtgtgtctccttgcctggtgaggagtaatggatcatgtcagttttgttggcactcctagagatgggnnnnnnnnnnaacagtgtgtctccttgcctggtgaggagtgatggatcacgtcagttttgttggcactcctagagatgggagcaaattctaccacagtaactccatgcagagcctgaaatttctactccaagtctacatgcgggcacacggggtcctccacaatccgtacatcaccaaggtgactgcctgagaaacctgtgtggccatctccaaatcagctgggtgctgaccatgttcatccgcgcgctggagcggaggcgcgacggtgcgcaatgtcgccaatgggcttcatgcatgcaggagtgcacaacgcccgcacatgcaacggcacggccgacatcagcaaactaatacattgcattgtatgttggtacgggcattgcacgggctgcgctccacactaccgtggcctcgcctgtcggctgcagggctctccgccaggcccagcgtcaggcccctggcacggctgtgccggcaggagacgctcgccatgtcccagagtgtggagtcagggccggcagtgcactacagcgcggccctcacatccatagatgccagccagtacgaggcacagctggccaccaaggtggcttggctggagaccctcttccaggatctggagcacccaccctttgccatccaccgctcggagcccgagcattttcgcatgaggtgaggacaagagtgacagcccaatcaagagcctctcccttcccaccttcagtggctatcgtccttcgtcctcccaccacctttcagacactctgcctcttggatccctcccgcaggaccgaatttgatgtgtggcactccggcgacagcctggagttccagatgtttgaaaaagaccccaagaccggcgagcgcaggcccgtgcgcgtggaccaatttcccgtggcctccaagctctgcaactccctcatgacggccctgctgagggagctgccgctgtgccaggagctgcgttcgaaactcttccaggcgcgcaggaggtgtgggtggtacggcgatgacgtcgaggataggtatcttcgtccaagcctgcatgggccttcatgaattgaccaagggacatgatgagacagctggccaacccaggcttctcctccatctccctccatgaaccaggttaacctgcacacgaccctgagcgggcaggccatggtcacactcctgtaccacagaaagctcggggatgcatggcaggaagctgcccagaagctgcgggtctgcctgggcgacctggcgtcccccatccacatcatcggtcgcagcaggtgggggggcctgccactggtttggatgcctgcataccccagcaatggtgttgacggtcgcatgtcggctgcggcctggcctggtatgaccgcccttgtgctgaggcccagccatgcagcggcaaaggtgtggcagtcatgggcacccnnnnnnnnnngtggtgttgacggtcgcatgtctgctgcggcctggcatggtatgaccgcccttgtgctgaggccctgccatgctgcggcaaaggtgtggcagtcatgggcaccctgtgccggatcacacacaaggccgccctgccttcaatgtgtgttggcctcgacaggcacctgtggctgcccatcccccacccaaacccctctcctctcctccatcacgcaggggccagaagatctgcctggacgcggacgaggtggaggagaccctcacggttgagggccagacgctgcgctacgtgcaggtggaggccaacttctcgcaacccaacgcgggcatctcggtgcagatgttggcctgggcgcggcgcgcggcgcagggcagcggcgcgcgcgacctgctggagctgtactgcggcaacggcaacttcacagcggcgctggcgccgcgcttccgccgcgtggtcgccaccgaggtaagcaagcgcagcgtggccgcggcgcggcgcaactgcgcccagaacggcgtgaacaacgtgttcctggctcgcatgcgctctgaggagttcaccgaggcctggaggatggggggcaagaaggagaggtgcggggggtctgggctggtggcaaagtactccttgcttgaggacagggggtgaggtggaattcgtctctcttgtaagcatggtgctcgcaggaagtagctatactgtgggnnnnnnnnnnattgagtacaggggttgaggtggaattcgtctctcttgtaagcacggtgctcgcaggaagtagctatactgtgggtcggtaagggatgttcagcgcctgcccgtggttcccatgcttccaagtatgcgactcgtgtgagcttgaggctgcagggtatctcctctcattcccctgatcgagccgtccacacatctcagccctcactctctctcaactcccacactgcacaggctaaaggggttggatctcgtagagtgtgacttccagaccctgttggtggacccaccccgagcaggcttggacccggacacccttcagctcctccatgaattcgacaatgtcatctacatcagctgcaatcctggcacgtgacagcaagggacagatgttaagggggtgcctgtacatcagagatcatgcaggggtaccctttcctgtgcattttttgggtctgcgccatgctcatatgtttcgtgccatcacaggattctccaccnnnnnnnnnnattttttgagtctgcgccgtgctcaaatgtttcgtgccatcacaggattctccaccgcgcgtcgtctccacaatactcccccccccaacacgccatgtacagagacgctccatgccaatctggtggctgtcaaggacaccttcgacatagtggagtatgcggtcttcgatcagttcccctggaccccccacattgagagtggagtgtatctgcaacggaaggctggagcaccacggccgccgaaatcatcgagtatccccgatgtcgctccggagaacacggctgctccacagggcgtaaaacggaaagcagaaggggtagaggccgcatcttaattttaaaatgcttgaactcccggatttggacgagcctggtgtcgaaatccttagaaggaataacttgggagctgcggccccccccttcctcaggcgaacaactccggacatgaagccgtcccagcctcgaggaggggcaagagatcnnnnnnnnnnatgggagctgcggccccccccttcctccggcgaacaactccggacatgaaatcgtcccagcctcgaggaggggcaagagatccggacctctatttcggggccgaggtccggcaattgaggcagaacctgctccagcagcccatcaaactccgtgttgaagcatccaattctgcgagtcatacgctagtgagtagatgcacggctcctgagaaggaatggatgctgccgaacatcgcgagcgctcgcataagtactgcacctctgactgggcccatctccccggtgagctgctagcaccggtgcgaccggtctgatgaataccttgaaaattcgataaggagctgttcgtcgttgagaggaacctgggagcctactaagaggcccatctcgtctcttcggaccccttgtaggtgttcgattggctgtggagcagccctgcctcctgtgcatccatcaatgagacttgcaagaactggcaccaccttgtgcacgccaaagccccaaatctttatcccagggtgagtttgtgggcatgacacatgcttggcgaccttgagatgggataatcaggtgctggagctgctacagggtcaggatggctgccccaatggtaccaagcagtgccagattgcgggcaccacaccacactcctgctccgcagggtcgagcctttgcttacgagcgcttcaaaagcgtgcagagactccatttttcagagcggacccatcacctgacgtcccgagaactggctcatgcagtgcaaggtttgtggtttcccagcctgctctcgaaagtatcgaggtggactgctcctggctggtattgcaatcaaccccgatcagacgacatttaaggaaaattaactcttctctaccccctccagcgaccatgcnnnnnnnnnncgctcctggctggtagtgcaatcatccccgatcagacgacattcaaggaaaatccactcttctctaccccctccagcgaccatgcgcacgctggtggaggtccatctgagtgacacgtgcagcggcatagtagtggccccgcttcaggattgtgtgcatctccgccgcctgaccttatccagaacgattgttaaggatggggctctggcatcgctgctcaggtgaggcagcatggtagggagcctcagagtgcttcttggcatggtcgcattgatctctgcactggtgtacccatttcatgcggtcacagtgtgtcaggcacagcgcacctccgtgggctgttcccagaggcaagatctgtacgcccttgtcggcacttttcggtatgtttacatcgcactgtaccatcccttgaccaccttctggtagccttaccaccctcgtctctctccacccctttcaggcatttaccagacctccggcacctggagattgtacactgccattcgctgagaggtgcctttatgaccagcctggatgcctgccccctcctcactttcttggcagttcaagactgcgagtcgcacatcacggaagcgggattgcaggcggtggctcggctgagtcaccttgcggccctgaagttgagaatctactctctgccgttctcacccagctccatcaaggccatgctggaacacctgggaagcctgaggtgtgcagnnnnnnnnnngaaacctactctctgccgtactcacccatctccttcaaggccatgttggaacacctgggaagcctgaggtgtgcaggaacctggggggtgtcgttgctggcaatgcccttggtgccctcacatgaggctctgatcccacctcccccatcctttcaccccaggccccttctcaccttctcaggttgttctccatgaacaccacctggtcattctccaacgaacaccttcagtgtctggcagacagcccctgcgcccctttcctggaagaactggacctgtcgcggaccagcatggccacagggtgcgctaggcaaaaggctcatccccactctctactggttgatgtcacttcattggcatgactgatgcatgcccaagcggcggagccggaggcagtaaagggggcctgcatgagactgctgggcccgagtacctgtttctgcgcgacatagatgggttccccttcacaccggtgcactccacagtacggacagcaatgcctgggccatactgctctcgttcccctccctgcggagactgcgtcttgccaactgccgcctggatgcacacaggcgggggttggcagccattgctgctctgctgcgacacctggaccttttggaggagctggacatctgccgcacccccgagctgagcgccaaggcgctgcgcctggtcctggccgccagcggcgccgggctgcgcgcactgaccctggagctgcccgccgggcggctcacgcggctgcccccgcctccccgcgtgctcgcgctacgcacgctgcgcctgcgtgcccccggcgtcgacgccgccagcgtgctgcccatcctccatgcctgcgcgcccagcctggtccacctggannnnnnnnnngggcgcggacagcgtgctgcccatcctccgtgcctgcgcgcccagcctggtccacctggacgccagcttcgcgctggctgactgcaccgtctcgacggacgccgtggccgccacgctgggcgcgctgcgcggcctgcacgagctcagcttgcgcgactgcgcgggactgcacaagggacacctggcctcgctgggcacgctgaccgacctgcgccagttggaggtgcacgcggagctgcgggccgggaaaccgcccggggagctggcggggctggggcgcctgcaggccctggagagcctgcgcctgcagggcctccgccccgaccccgccgacctcccgggcctgcgcggcctgagggccctgtgcctcgacacccgcgaagacgcgcggtggatgcggcgcgcggcggccgtggggccctgcccccaggtgcgcagcctcgccctggtcgggcgcgtccagctgggccagctgggctgggcggtcgaggccttccccggtctgcagagggtggacgtcatctgcaacggcacggtccccaacctggagctgctggctctgcaggagctcccccgcctccattgtctcagcgtcagaaggtgggtggggcgaggccggtggcgagcgggtggtgtgctggggcaggggcaggtcgggcgggcgtgtgcgagacgggctcgcttccctgacgccctccccgcgttcacacagcagcgccggagggaacgcatccctatcgttggggtgggtctgggaggtgttcccggcgctggagcggctcaacagcaggtggcgcggggaggttttccacgaggaggaggtggagagctgggtgttgcaccgctaccgggccctgctgaagcgacggctgggtgccccattgtagacgcctcgaaaagttacacgctaggatttagacggcccgtacatggtgcagcctgcatgccaagaacacatgggtccttttccgctttgcggttgccggggtccacgcacgacaccaacgggtgcatttccacgtgggacatacaacactcggaagaaatagcaagccttgcccaatcagaatctgcaaacgccagccattgtgcatatccattgatcccagtgcttgcttgcattgcaaccatgaaatatatatcccaannnnnnnnnngaatagcaagccttgcccaatcagaagctgcaaacgccagccattgtgtgcatatccattgatcgcagtgcttgcatgcattgcaaccatgaaatatatatcccaagcgggccttaacaatacaggtttcccacgcacgcactgggcatctcatgagcatgcttggtgaccagttgtcctgcctggcattgaatcacggccttccctgctcagaagcggtgcctcggcgaggcccagctgaggtggagctggtccgcgaggggcgagactggcgagacctggaggaaaggggcacggctggcgtgccgtgtggcctccggccggtccagtctcatgctggcatggagggcgaaggctgagaaggggggcatagggtcctggctgggggcagagggattgtgttttgggaggggagtagcctcttttgcaagaatgtggcttgaaggggccaatagaattgggggccatggcgggttggtgatgggatctctgttgcctgctttggttcccatgccttcccatacggaatccttgtcagcttgggagtgcacgatatctccactcattcctatggacgagccctcaacacactctgtcatcagctctcccgaattctaacacgctgaaggacctggatacttaagggtatgacttccaaatcctgttggtggacccaacccaagtaggcacggatccaggcactccgcagctgctccttgaagtagacattataatatacatccgctgcaactcaggcatgcgacggcagggggctgcaaatgnnnnnnnnnntatggccgagccctcaacacactttgtcacgagccctcccaaatcctaacacgctgaaggacctggatacttaagagtatgacttccaaatcctgttggtggacccaacccaagtaggcacggatccaggcactccgcagctactccttgaagtagacattgtaatatacatccgctgcaacccaggcatgcgacggcagggggctgcaaatgagggatgaatctacatctgaacggctatagggaaattaatcaagctcagtaacaagtcactgacgtgctttgcacactccttatatgagggcctcacttcaccgagcccatcaacatacttcacgccacccaacgccatgtgtacagacgctccannnnnnnnnngtagggaaattactcaaggtcagttacaagtcactgacgtgctttgcacactccttgtatgaaggcctcactttaccgagcccatcaacacacttcacaccacccaacgccatgtgtacagacgctccannnnnnnnnntgaggtattcgtcagccaagccccaggtacagcgcggccgccgaaatcatcggtctcccccgtggtcgctccggggataccgttcctccacannnnnnnnnntgccaatctggtggcgttcaaggacatattggacatggtgagggatgcagtgtttgaccaagtcccctgggaaccccacattgagagtggggtattcgtcagccaagccccaggtatagcgcggccgccgaagtcatcggcctcccccctggtcgctccggggataccgttcctccacagagagtaaaacggaatgccgaaggagcacaggctactgaagatgattcttagaaggcatcttttatagaattcgatacagcgcaatctggaaatgtgcacaccggggggaagctgaggttccgatcattcattgttacccgccaagagaacgagcaggaaatccggaaggcgtttgtagggtcgaggtcccggacttaagacccatcctgctccatcagccgataaaatcccgtataagcatgcaaaattttgcaaatcatatgttttcgcatagatctacagcttctgtggaggtatgtatgctgttgacgctctcgagcactcgcacatctaccgtacccccgactgggcccagcttcccgagaatctcctggcccaggtgtgaccggtccgatgtcttctatggtgtgtatttgaatgtgggtgggtatgggacggtgcccggacccttccttctgcaccatcgcttcgctccgacccccctccgcaggtgttcggatggttgtggagcagccctgcctcctgtgcctccatcagtgaggcttgcaagacctggagacatgtagtacacaacacatgcccaaatctgtacccaagggtgcgtggaagggcacggtaccatgtgtgctggcattctgattgggcaagtagggagctgccggctgccgccgggtcaagatgcctgcccagataacatccacatgcaagattgcggcatcacaccgcaatgccgctttgcagggccgggcatttgcatacgagcgcttcagcagcgtgcagagacttgactatgcagcgcgggccgtccacctgacatccggagagctggctcgcgcggtgcaaggtacatgctttctcgtcaaaggttcaaaacattgaggggggtggctcactggcaatggagtcacaggcagtcaagagatactgaggggatcttcatcaccctctgcaccctgcagtgaccaagcacacgctggtggacgtccacctgagtggcacgtgcagcggcattgaagtagcacccctgcaggagtgcgtgcatctgcgccgtctgtccttcagcgacacagatgtcagggatgttgctctggcatcgctgctcaggtgggttgggacagggggacccgcagggtgcgcctcgggatggttgcatcgcatcggtgtgtttggaccaagtcattgagcacagcgcagcttcataggaggtttaggaggccaggcctctaaccactgctgcaaccatgggaatgataacgctggtcgtgtatgatgattgaccaccctctggcggcctggtcacccccatttactcaccccaaattccaggcatctgcccgagctcgggcacctgggtctctcccactgctatcaccttcggggggacttcctgtgcatcctggatgcctgccccctcctgacttccttggcaatctaccactgcgggatgcacatcacggaactggctctgcaagcggtggcccagctcagccacctggaagtcctgagtttggagttttgcgacttgctgttcccacccagctccctgcaggccacgctggagcatctggggagcctgaggtgtgcaggggctggaagagagtgttgctggcaccccttgatgcattcccttgcccaagacaaatccagttgtacaggcacggccacccaaactccccaccgtcgcgtcacaggtcattctccatggccggcaacacagcatttaccaacgactacctgaaatgtgtggcgggcagcccctgcgcccctttgctggaagacctggacctgtcgcggaccagcatctccaccatgtgcgctggggtaatctatccattctgtgctgttcacctcacgtgcttggccgagtccggcacaggcccaagcggcggagcctggggcggtgcagagggggcctgcatgagtctgctgggcccgtgtacctgcgtcagcgtcgactggaaccccccaaattccagcatctcacaccgcaggggcgacccgggnnnnnnnnnngcggtgcagagggggcctgcatgagactgctgggcccgtgtacctgcgtcagtgtcgactggaaccccccaaatcacagcatctcacaccgcaggggcgacccgggcgcgtgggtcttgctgcagcacttcccctccctgcggcgcctgcgcctggccgactgcagcctggtccagggcgtggatgccatggccgcgctgctgtggcgcctgggttcgctggaggcgctggacctctgccgcgcccccgggctgaacgccgaggcgctgcgcctggtgctggccgccagcggcgccgggctgcgcgagctggcgctggagctgccctcccgctggcgcgcgccgctgcccccgccccacccggggctcgcgctgcgcgctctgcaccnnnnnnnnnnnnnnnnnnnnnnnnnnnnnnnnnnnnnnnnnnnnnnnnnnnnnnnnnnnnnnnnnnnnnnnnnnnnnggcgtgggcgcggccagcgtgctgcccatcctgcgcgcctgcgcgcccaccctggtccgtctgttcgtcgccttctcgctggcgcggcgcgacgccacgccggacgccgtggccggcgcgctgggcacgctgcgcggcctgcgcgagctgacgctgcaggggtgcgctggactgcacgaggggcacctggccacgctgggcacgctgaccgacctgcgccgcctgcaggtgcacgcgcagcggcggccccgggtgtggtacccggagctggcggggctggggcgcctgcaggccctggccagcctgagcctgcagggcttccgccccgaccccgccgacctcccgggcctgcgcggcctgcgcttcctgcgcctcgacgcctccgccgacgcgttctggatgcggcgcgcggcggccgcggggccctgcccccaggtgcgcacctttgccctcatcgggtgcatggaacccgagtcgctggactggctggcccaggccttcccgggcctgcaggacctgggcgtggcctgtgccggcacgatggcgcaggagcagctgctgcctctccgccagctcccccgcctccagcacctgagcgttgggaagtgagtagggcggggcgcggacgtgcgggttttgtgcatgggcaggggctgggtggagtcgagcagagggccggcatcgtgcaggggtgcagaccgagcccgtccccagccacgcccccccccttccccactggcgttccacccagcactgccatggcgcgtgcgcaccagatggactggatctggacggacttcccggcgctggagtactttgggacgtcgggatgtgtgcactctgaacccaaggtggaggaggactgtgccatgcaggcacagctggcagcggaggagtagaggcaggatgccccatctcagtcgcctctcaatgttaaaggcttgggacttggtggcaaatggtgtacgacagcccgcatgccaaaatagatagatcccaaaccgcttttcgaaatttgtggcccgcacatgacactccctggtgcagctttatattggagaactgacaatcagcaggaaaccgccccttaccccaacttcaaattgcaaacccctgcctctctgcacatacatgtacccaagtgcttgcatgcatggcaagcatgtaaacagttttccaagccaggcttgacaagaagaattttagaaccatgcactgggcaatcacaggagcgtgcctggcttctcacttcctcacctggcatccagccaggttgttcccaagctcagaagcggtgcctcggcgaggc

SEQ ID NO: 33227 - DNA, 107 bp, Chlorella protothecoides
cctgtggcttgcggtgcacagccagactcccctccatcctgggcaccgggtgccaagctcgatcgccatactacaagcacagcgaggcaggcaggaagagaacccca

SEQ ID NO: 33228 - DNA, 63 bp, Chlorella protothecoides
tcgctcagcgaatgctcttgaactcgtatgcgaggcatcgaccccggcacgagaactccgcgc

SEQ ID NO: 33229 - DNA, 183 bp, Chlorella protothecoides
gtcgccgggccagagtgggatggaccgctgggcgacaaacatgcaatgatttcggcccaagcacccccacgccatctcaacacctgtccaacctggagaccatgggcttctgcagacctgggcctgcacgccatgcccaggacccagaccacaccgagccccacgccccacctctgcagcagc

SEQ ID NO: 33230 - DNA, 61 bp, Chlorella protothecoides
ctgcaccagcgcggcgcgccggccgaaccccgggtcctccagctccgcgcagaggtaccag

SEQ ID NO: 33231 - DNA, 64 bp, Chlorella protothecoides
atctgctctgctcggtccctactcctccatcgtgcatcctgccacgccatgtcaagagtgtcgc

SEQ ID NO: 33232 - DNA, 76 bp, Chlorella protothecoides
gagacgccttcttggggggagggggagacgtcttcttggggggagtgggagacgccttctttggtggcggaggcgg

SEQ ID NO: 33233 - DNA, 76 bp, Chlorella protothecoides
tgcaacaaaatggagatggtcttgtcaactctgggggaaattagtctagactcctggccaggggcagggttgcagc

SEQ ID NO: 33234 - DNA, 73 bp, Chlorella protothecoides
gctcagcttcctggtgggcctggtggactccgactccatgccgctcaacgtctcgcgcgagatgctgcagctg

SEQ ID NO: 33235 - DNA, 61 bp, Chlorella protothecoides
tgctgatacatatgctggctctcccccatcgccttcatgcagacatctgactttgcagctg

SEQ ID NO: 33236 - DNA, 137 bp, Chlorella protothecoides
cattgacactgtcgtgcaatgtcgatggccccagctgcgtgcgccgtgggccttgaagcgtccagaagcactggcgaactcggcgctgcatcccgcatcaaaggccgcccccacctcctcccacatcctgcaggcca

SEQ ID NO: 33237 - DNA, 70 bp, Chlorella protothecoides
gcgtcattccacgctcatgcagctgccgtgaccacaaattcctcccctcccccacctcccagacattctc

SEQ ID NO: 33238 - DNA, 378 bp, Chlorella protothecoides
  modified_base (101)..(319): a, c, t, g, unknown or other
acctgcctgcaggtactggcgcgacacccgagtgggaagctccaacaatgagcagatggctgcctttgagggcgtgtgggacccgagctccatgggctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgggcactgatctgggcatccccatctcctccggccgccccgactttgccgccgtcc

SEQ ID NO: 33239 - DNA, 61 bp, Chlorella protothecoides
ctcgaccgttcgctgtcggcacgctgtacaacaaatccagccaggtcggccaccattgacg

SEQ ID NO: 33240 - DNA, 9464 bp, Chlorella protothecoides
  modified_base (298)..(307): a, c, t, g, unknown or other
  modified_base (1779)..(1788): a, c, t, g, unknown or other
  modified_base (1959)..(1968): a, c, t, g, unknown or other
  modified_base (2187)..(2196): a, c, t, g, unknown or other
  modified_base (2379)..(2388): a, c, t, g, unknown or other
  modified_base (2827)..(2836): a, c, t, g, unknown or other
  modified_base (5182)..(5191): a, c, t, g, unknown or other
  modified_base (6418)..(6427): a, c, t, g, unknown or other
  modified_base (6938)..(6947): a, c, t, g, unknown or other
  modified_base (7956)..(7965): a, c, t, g, unknown or other
  modified_base (8181)..(8190): a, c, t, g, unknown or other
  modified_base (8575)..(8584): a, c, t, g, unknown or other
cgggcacgcagcaccaggcccccactcagcagcgggtgatgaactccccgtggtcgacgcgggcgccgggcaacggcctggccgccgggcagctgctgcgcagccagcaggcgcgggcggcggcggcggccgcggcggccgagtacgcggggagcccgggggggcagatggacgcggcctccatgctggacctgctgccgcgagacctactgcattcctgacctcatggtggggtgggtggcgctattgtcacgcctcaggatggcatgcgctggaaacagatttgctgtgccattcnnnnnnnnnncgcggcgtgattgtcacgcctcaggatggcgtgcgctggaaacagatttgctgtgccattcatgtgacagcacgcaggtggatgacggcgggcagggtgcacgcggtgggggaaggaatgctggcgcttggccaggcaaaggaggcaggcagccaggcaagggggatgaataggaaaacgcacgctggcaggggcaggccatgagcatgtaagggatgagagcacagcattggcatcgagcgctatcgctcgtggtcggtgtcagacgctgccacgcccgacatctcctcctcgtcggcacgctcctctccctgcatgctccctccgcctggatgtgcatgagacaggggcagtgagagagaagagatttcaggacctgcatcatgaccccctcacgcacagccacctgccaacctgagctcgtttcgacgccctcggccatgggtgctggcgcctcggcgggtcctctgcttggacccgcagtccccagggaggcatgtgcagcgtgctgcggggaaggaagggataggtaccacatgtgtgtggtatgcctccagcgtgaggtgcaagcaggcatcccaacagccgcacctgcttcaggcagtccagctcggcttgaagctccctctcgcgtgccttgtggaggttgaggagcgctgccacctgctcatgggaacatgcagcggagctgtgggggccactactccacagcatgtgttctgcctatgctcaggcttctagagctagcagaagaaagccactgaactgtgctcctcggcacaatcaccaccccagtccgctgaccttgactgcggtgtctgctcgatgctgggcgtccgagtcggcataggtgacgagctggcgctggatcctcatgcaccgagtctccagctcagcatgctgcgccgtcatgctgtccagggcggctgcgctctgctgaccggcgaccagcagctccgagagcagggtgaaaagcatactcccctctgacgccgggctctcctccaccccgaagttcaaagagtacatggtgccctcggcctctgaggggtcagaccagcgcaggaacacccgctgcgaggtggtgggatgggaagaaggttgggggggcgcacgtgagtggcatgtccatgagggcatgctccctcggcgcaccatgcaaggcagaatgggaatgatgccgccgagatcctcccaggtcgttgctctacagcaccgcacccaccatttcctgcgtgccggtcctcttccctggacgtagctcgacggcataggtgggcctgctgggaccagagtctgcatcattgctctcgggccgcctcgagaaggccgccacaacatgatctaggcaggcagggtgcactgaagtgatggctcccttattcaggcctgtgctcgtggtttggcgtgaaaagcaagactcagttgtttggcttgcagaattttggtgtggttgccaagcaccagcgtgnnnnnnnnnntactcagtttgttggcttgcaggattttggtgtggttgccaagcaccagcgtgacatccttcgcatgctcgtcgagcgatggacctacattgggcagtgaatgttttcgtcccgtttgtaatgatcatatcatacgccgaatcgtcgtcattcgaaggcatgaggcgggtnnnnnnnnnnttcccgttcgtaatgatcagatcatacgccggatcgtcgtcattcgaaggcatgaggcgggggatgtacccctcgccagtcctggcgtcgtcaactcggctgaaacgtgtcatggccatgcccacactcgagaccgcaccaagagagcatcacgtcccctccatcttacttcacggcaaactgaaaagttcccgaatgaccggcgatgcgatgcacaannnnnnnnnnacctccatcttacttcatggcaaactgaaaaattcccgaatgaccggcgatgcgatgcacaacttgaaatatcatcgcgaaaagttcgggcgcgaatgttgcgatgagtgcacatcgcacaggccacctctcagattggaggcttgccgaacgttacagtcctgatgcagcaaccatgattgnnnnnnnnnntatgagtgcacatcgcacatgccacctctcagactggaggcttgccgaaggttacagtcctgatgcagcaaccatgattggtcgacataggatgcgcagagcatctggggactgtttgcaaagctgctccgaaagaactctgggccagcaagatccagccagccagctccgccagtctgctgtcccttgccatgggcctggcgcggcactacctctgtacagggtagaggcaaccatttgcttggcaagaagtacttggcataatctgtcagggtgctgtgcacggacacaggatccattaatggcctcatctcccaggcgtcacgtccgtattcccaggctgttcccgtatgaagtccacccacaaaggtcatgctccatccccctttacgtccctttcactacccacctgtagcgtcttcagcactcccgacagccnnnnnnnnnnaccacccactaaggtcatgctccatccccctttccgtccctttcactacccgcctgtagcgtcttcagcactcccgacagccagtccagaccttcatacagcccctcccctcttgtggagatggcaccttggacatgccacttgcggcccttgagggctggcaagcccatggcctcacaagtctccgccggagtgagtgctccaggctgtgagcccaatgggggaaggagaggtcatagcaatgcgcaaatagagggcaggggtgtggcgatctatgtggagtgatgacagaggcaaggccaaggcatactgctcgacttcgcccaaccccttcaggatccagcacaagccggcaagctctcaccaggtcttgcttgttcgcaaagacaaggatggcagaatgtcgcatcagggggtcatcaatgatttgctgtgggggcaggaggggtaacttgttgagattgccttgtgacagaatgacatgctttgccaggcattcatcctgaagctcagcttctcacaaaaatgcaagggtgcatcagggagacgcatcaccagaccctgatgctatctgccacaaacccaccttgaactccgcagacgcccgcccaatgcgctcgcgatcgcagcagtccacgacatagataagggcatcggtgttgttgaagtaatgcctccacagaggacgcagcttctcttggccgcccacatcccagaccgtgaatatgacgttcttgtactgcaccttttcaacgttgaagcctgtgttgtgggggaccaagggaaggtacgacgacatccagtggaaaacagaagttgcaccgccaggcacacttgacacaataagcggcgaccctcggacccaatccggccctgatcagacgtcgcccgggtgtggaaggttgcatttctgtccatattcaacccagtcctacgtaccgatggtaggcacggtgctgagcacctcccctatatgaagcttgtagaggatggtggtcttccccgccgcgtccaggcctgcagaagggcgcgttcgcggtgagcatcgcactgctgcatgcacttgaggccatccccgcccccatctcagtctcaccgagcatgactacccgcatctcccgattgccaaacaggccatcgaacaggcgtcgaaaggtgttccccataggggtaccgacgcgctctctataccaattgaggtccctggattctataagagagagcccctcgaatcagaggatgtcggccaggtcccaccgagctataatgatggtatcggaggttcagaaagggttgactcctgttccacaggtcgcagacctccggcgtttgttgtgaatcctcagagtccaatgccccgtgctatctcctgggagcagccttgggctacgcacttcgtctgcacacccaccaagcgagttcgtcgtcgttctgttttcccacgacatccagcgttacctcgtggagccagcagtaccctcgctctcgattccttgcttgcagataacttgcatgcacgcaccagccctcccccttcgagattgacgtactaggttcaccagcatgttggctctccgctcggcgccggttggtgtcgtttcctcccggccagccttcgctggcaggatcagggctcccaaggcgcgtgtgccatcgctgctcacaccccacgctaccgccctcccagtcgaggtgagggcatggcgatgcctgcttgcattaccatttgaaagattacataaatcaacctggctgggtcagtgcatgattgccctggtgctccctcgacatgcagatcaagacggtagctcctttgggcgagcgggtggtcgtgaaagtggtcgaggccgagcagaagacgcagggcggcatcctcctgcccagcagtgcccagaagcgccccacacaaggggaggtggtgaacgctggcaccgccaaggccctcaaggtctgtgatccccggtataggcttccatgagggtttctagatggaggtgtgcctgctcccccccatgcatgtcggggagggtgacgatgaaggtaaggacactgctgctattatttcctcacataagcatgattttttctgaacaagcagaagggtgacaaggtggtctactccaagtatgccggcacggaaatcgagctgcagtcggaggactttgtcatcctcaaggtgtcgttgggtttgcaggggcttgccatgcagtggctggggatcaggcatttgtttgtggtcacgcatgcctggaacatgctttactcaggtgaagtgccacagcatggtgccctccctcacctgcctggctgcctggcttgtgtgtgagaccatgtgacacctcaatnnnnnnnnnnggcatgcctggaacatgctctactcaggtgaagtgccacagcacggtgccctccctcctgcctggctgatgcctggctgccttgtgtgtgagaccatgtgacacctcaatgacacatgcatccccctccgccctctctcaaccctcctggcatcttcccctcgacaggaggatgacgtcatcggcctgatcaacggcgacgacatcgccaccctgcgcccctgccaggaccggctactggtggagatgcaggaggctgccagcaagaccgcgggcggcctgctcctgaccgagagctcccaggagaagcccaccatcgggcgcgtggtggccgtcggccctgggcgcgtggaggaggaaagcacggaggcgacgccattgggcgtggaggccggggccacggtcctctactccaagtactcgggcaccgagttcgagggcgccgagggcaagaagtacatcgtcatccgcgaggccgacatcctggccctcgtggcctgaagcagttgcaggggccggggcagggtgggaggtggcagcggcaggctgcgcggccgagcgcactcggcaccggacgtgcctgcggtggcatctgggtccgccggaggtgcagcgtttgccattctcagactcctgcctcgagcacacctgcaccgtcgttgctccgactgcatgcagcgccccttgcatcaaggactggttgcaagacacgctcgaaagcatccagagtacaagttggaaaccggcagggcagcgtacacaaggtctcaagggcgaagagttaggcgtggaaggcatgggggaccaagtcgagtcttcttcacccgtggaaatcagtctcttggatgcacttgaggcccccacaagtccacgagcccagcccgaccattgcatggcagcaacatgatctcaatcaccccacgctctcagggctgcagccgcgtcagggtccatccgccctcctccccgccccgccgtttgtacaccaggcggtcgtgcaggcggctgggccggccctgccaaaactcgagcgcgtgcggctccagcacaaacccgccccagtgctcggggtagggcaccggctctcgctcgtcggcgtactgcccctccagctccgccatgcgctcgtccagcgcggcgcgaccgtttcctgccaccggcgcactctgacggctggcccaggcgcccagctggctgccgcgaggccggctgttgaagtaggcctccnnnnnnnnnngccgttccctgccaccggcgcgctctggcggctggcccaggcgcccagctggctaccgcgaggccggctgttgaagtaggcctccgactcggcggcggggaggcggcgggcgaggccctccacccgcacctggcgctgcagcggctcccagaagaaggtcagcgccgcggctgggttggcatccaattcagtccccttgcggctggcgtagttggtgaagaaagcgaagccgcgcgagtccagacccttgagcagcacgacgcgcgcgctgggggcgctgcctgcgcccagcgtgctcagcaccatggcgttgggctcggccacgcccgggtgcgcgcgcgcgtcgccgaaccagcgctggaacagggccagcgggtcggcgggcgcgtcgctttcctccagagtccccgccgtgtagctctgccgcatgccgggcaggtcggcgtgcggcgaggccgtggtcggcggggcgggcgccgtagcgggggcactgcccgccgtgccaccaccnnnnnnnnnncgtgcggcggggccgtggtcggcggggcgggcgccggagcgggggcactgcccgccgtgccaccaccgtgtgcggagccggaaaggccacccctcgtcgccgccgccgccgcgccgcccaggcgcaggcactgctgcgtcccggggaaggggggcaggtcggccagaccgtagcgggcggccaggtcgggggtcaagaaccgtccgcccaggtagtggtgcgcgccggcgaagcgcgccgcacagcgcttgggcgccgtgagcgagacgagcatgtccgggcgcaggccgtgccctgcctcgtccccggcctccacatcccagccggagggcacgtcgatggagacgagggcggggcaggggcgcagcacggcgtccccggcacccgtcgcccgtgcggcggctcccgcgcccgccgccagcgcggcaaccagcgcatcgaagggcgggcgcagcgggccgcggaagctgaagccgaagagcccgtccagcaccacgtcggcgggccaggcgtgggcgtccgggcccaggtcctccacgggcaccaggcgcgcgcccgcgcgccgcagctgggtcaccaggccctggaaggggggccgctgtgtggggcgcgggtaggccacggccacctcgtacccgaagtggcgcaggtggcgcgccgccaccagcccgtcgccgccgttgttgcccgggcccgccaggacgaggacgcgagggtgggtggccgtggggtactccgccgccaggctacaggccactgacaggcccgccagctccatcagctggtccagagagaagccaccggggcccatcagctccgcgtctatcgccgctgcatcggcctttgacctggaggatgcagggaggggggcaggctgtgggttatgaattgaaagctcacaaagagtagcgtgcatgtttgcgagcgagcgtggaagacgcataggtctatggtgcctcaaaggaagacacctgcccagggatgagcacacgcggaccagagcaggttnnnnnnnnnncggtgcctccaaaggaggacacctgcccaggggatgagcacacgcggaccagagcaggttcaaccccacttccaccacacagtcacacaaagcatcaactcacaggtaggccatggcgggaggcagggatggaggtgctaatcgatcaggtactgaagaaaagtatctgctatggaaaggctggagggcggggcgaagaggggcacggcaaggggnnnnnnnnnnttgaagaaaaagatctggtatggaaaggctggtgggcggggcgaagaggggcacggcaagggggcgggggagtatatggtctacgtgggggacctagggagaggaggatggagcgggagaggaggcgccagggcatgagtagtgacaactatgaatctcctgactagactacagagattcttaaaggatcacgcgggatcgaggggtgtacccggtgggttatggtagggggcgacgtggtggcctccgagacggtaccgaccttggcgcgaagtacttcgtaaacactgccgacaaaacgcccggagcccacatgtcctatcagagttttcacctcaagtaagttgttcgtgtcggtatgcctggggaacccatcggccagcgnnnnnnnnnngttcagggttttcacctcaagtaaattgttcgtgccggtatgcctggggaacccatcggccagcgcctgttctgggcatgcagtgatcgggagaggagacatttgcctgccccatcttcatctatggatctgcaccgccccaacaccctctactcgtcttaaagtgatattgatacaaaaacaaaatatctctagaaattacccccactttcgatatactcgttcgtgcagctgtacttcgattgcaggaagcaagatcaagtccagccagatcttgccgagccgtgttagcagttacgttatgccggcagctcacccacgcgcgaagcactgcttatcctgcagcattggtgccgcgaaactgtcgagtaaaaatcattcgtttaagctctcgctgcgtagtcacgcgtgcaaggctcagtcggacgaatcagggcactcaccccggcttccgtcccaaaaacactccatccgaggaatcggcttcccaagcaatcccaacccctcgaagcctgctggaggtgtgctgtaacatagactagccgtctcgctcccacctgttcgagctgggtccccctccactcaccttcggccgggttccggaaggacccgcctccccaatttcgcaccctggctgctgcaccgatgaagatgcggcagatcgtgccggaagacggggatgaagaccccaccctgcaggttgaggtccgtcagaatagcaagcttgtggtcgatgaagacgcgttggcgtccctggccgcccagctgacggaggaggaggcccagaggtgcgacgcctccatgatgcgccggtacatccgtgcctgtgggggcgatcagaagcaggtgcatgttcttcgggtggtggggaggggggggg

SEQ ID NO: 33241 - DNA, 152 bp, Chlorella protothecoides
gagcagcttgggatcctcgcacaccaactccctcagccctgcatttttgttgtttgggggggggagggggtgcatgggtgatgtttatggggccggcatgtgcctgaagcctcagagcaggaggtgctggttgcaaggggagacccatgacc

SEQ ID NO: 33242 - DNA, 103 bp, Chlorella protothecoides
gtgggcgtcgggcgccgccggcgcggtggtgggcgggctggcgtgggtgggcgccaaggtggcgggcggcgcgctgtgggcgctgggcgcagacaagccgctg

SEQ ID NO: 33243 - DNA, 3853 bp, Chlorella protothecoides
  modified_base (442)..(451): a, c, t, g, unknown or other
  modified_base (1704)..(1713): a, c, t, g, unknown or other
  modified_base (2102)..(2111): a, c, t, g, unknown or other
  modified_base (2515)..(2524): a, c, t, g, unknown or other
  modified_base (2999)..(3008): a, c, t, g, unknown or other
ccgaggcggggccgggcgccgcgccggtccctgcacgagagcctggctccgcaccggttccctcggcggcgccgggtccggcacgcacggcagcgtccgcgccgccgccgccggagggcctcggcaaggccgccgctggccggatgctgccggccatggccaagctcaacctgggcaggctgatcgagggcgagggctccccggccagccaggcctcggggcgatcccccctcctcgccggcgcaggggtgtgtgggattcgcttgggaaagggggaatgggggcgggggctgagactctccgagcagtgtgcgctgctgggggcgctgcgtggtgatggcatggactgggcccaggaagtgaagagggatgcgagggcttctggacctcaccacagctctcagtcacacaccccacacaacccccctccccatgcagtccnnnnnnnnnncggcccaggaagtgaagagggacgcgagggcttctggacctcaccacaaacctcagtcacaccccccacacaacccccctccccatgcagtcccgcgtcagcaggatccccgggctgacgccgccgcccgcgacggcgcgccccgcccgctcctccccctccagcacctccagcatcccccggtgagggcgccgactgggaacccaagtcgccacaatccgcggcctctctgcactgaaatgtcaccctttccgccttcatcggcccctcaatgcagtcccatgtcggcacgaggccagtctggtgagtcgcgcagggcctccctcacgggggacggcggccccgggcccctgcccagcagtcggttgagctctggccgaagcgtggccccccgggtggacacggggcgcggcgccggagtcagagcggccccaggtgctcccctcgccagtcgcacgtccagtggcggcagcgtgatggccccgctttcctcccggacctccagcagccgacgctgggcttgagggtttcgaggccaaaggacgcacgaggcgtctgacgcacgctgtggcggcagatgtggcctcggtggaaagcctgccggggccatgagcgctcgagaagcctgtgtcgccctccccactggagcctgaaagaaccggtcctcgaccccacacccgacccctcccgacgcacgtcacctctttctgcattgttgtcgattgcacccagtagcagggtgcatgcacatgccgtgcatgggcagccgggcaggatgaaatgctggggtaccggtgaggagccatcagcatgcccatcccaggttcctcaggactccccctgaaagtctagatggagatggtctcggtcttgacttggatgctcaccagctctgtctcgaacaccaaagtggcgccccctggcgttgcaaaaggggagtggtgggcagcacagcacgcggatgactggttgtgagccggtcatacaagaagagcggcaggtgacgtcccctgagagcagacctgcgagcacccgcctccttgtccccaccactcaccgggaatgaccccgccggcacctcgggcaccgtagccgagctcagggggaatgaccagcttacgcttctcgccaatgcacatgcctgtcgatgcgaaggagtggattcatggaggcaataacggtgaagcagagccgcgtgaaacgacgtccgccccttgagcgccattgactgaccgctgcacagcacgagctgnnnnnnnnnnaagcacctgcctccttgtccccaccactcacccggaattaccccgccggcacctcgggcaccgtagccgagctcgggggggatgaccagcttgcgcttctcgccaatgcacatgcctggcgacgcgaaggagtgggttcatggagacaataacggtgaagcagagccacgtgaaacgacgtccgccccttgagcggcattgactgaccgctgcacagcacgagctgcccaatgctccctcctcaccttccacaccctggtcccagcccttgatcacttggccgacaccctggtaatgagggcatcagagcacgggtttcagctcctgttttccttgagcatgccgctccatctgtagaaaggagacagaatgccaaatacagtcacaannnnnnnnnncgagcatgccgctccatctgtaggaaggagacagaatgccaaatacagtcacaagggcccatcctcaccagcttgaaggagatgggctggccccgcttgtagctggagtcgaactccgtgccgtcggcttgcagggggccctgcgcccagcttacagcgagcggtgaataaaggtccaccaggagtactcgaagaaattccgtcaaggcattcccatgaggagacccaatgccttacccggtagtgcaccgacacggcatctcccttggcagccttgacagtgcaagacggcggggtgtgcctgcgattggagtgtgaatggcacgataggagtaataggactgatgcaggcgcaaaaacatgccctcaggcgaatcccggcttacagggtggtgatctgcagnnnnnnnnnngaggtacaccatgaatactcgaagaaattctgtcaaggcattcccatcaggagacccaatggcttacccggtagtgcaccgacacgccatctcccttggcagccttgacagcgcaagacggcggggtgtgcctgtgattggagtgtgaatggtacgataggagaaataggactgatgcaggcgcaaaacttgccctcaggctaatcccggcttacagggtggtgatctgcaggtccgaggccttggctgtcatggccactgccagggccagcatggtcgtgcacaccatgagccttcccatcatgacgataatttgactaagactttcgattggcaggcgctgtggcgaaaaaagggcattgtttttgctcgaatcggagggtgctgaggtgtccctttcctgccttccattgaagactgcaccgagtcctgctactctcatggtggaatggcgcccacccagagcacccctccnnnnnnnnnntcctgccttccattgacgactgcacggagtcctgccactctccttatggaatggcgcccacccagagcacccctcccacgacgactcaagcagcccgagactcctctcaataattaaaagaatagctttgcgacagcgtcgtttatagagctccggcaggagggtctgtggggaggatccctctccgcatctcccgatccgataaaacttgtcggagtagagggggccaggaggctcgcgtggatgtcgacccactagctaagtatagtgaacagcgcatgcccgccggcctcatggcgtcgggcctcccgtactgctcccccggtgaggatgtggtgtcggagttcctagggcttggcagcgcgccagggtcatgaatgtaggggtgggatgaacaccccggccctgctcgcggcgtgggaacagacggtgtcttgaccccggcagtgtcttcatactctcaccccacccccacctggaccggtacagatgccggcctggcccctgagtgctgcctggacgcctgcgagcccggcctcgcctggccgacgccgtgcccaccgcccgccagcaagggcccccaccccccctggtccagcctgcccacggacgtgatgggcgcggtgtgcgcggggctggccccgcgcgacctgtgctgtgcgcggctggcctgccgcgcctggtccgcgtcgctgtcccgcaccgtggcctcgctggcgccgcgcacgccgcggctccaggcgctggccgcccgcttccccgcgctgcaggagctggacctgtccccctgccgcgcggcgctggccgacgccgcgctgcgcgcgctgcgcgacatgcgctgcctg

SEQ ID NO: 33244 - DNA, 66 bp, Chlorella protothecoides
tgcagatcagcttccatgaggtgcttgtagagtgcttcatgctccgcacgcactcccttctccgca

SEQ ID NO: 33245 - DNA, 124 bp, Chlorella protothecoides
ctgggagaggtacaccaggcgggatgtgcctgagggcccatccagagcctggacgtccccctcggccacgccgtaagcctggtcatcggccaggtcgggcaggtcccagctcccgatgctcgcc

SEQ ID NO: 33246 - DNA, 80 bp, Chlorella protothecoides
gcgcgctgtgcgtcgcttgcatgcaaatgtcccagtgcatcttacacgagcagcgatggggcgcgcgcgctctgcacggt

SEQ ID NO: 33247 - DNA, 102 bp, Chlorella protothecoides
aagggagtgggatgccccttccgatgaagaggcacctgcacagccggcatgcgttgggcctcttatgcagcactctgcctcaccttgaaaggacctatctcg

SEQ ID NO: 33248 - DNA, 150 bp, Chlorella protothecoides
cgtggcccgggccgggcgcggcgaggggtgtggcggggtgtgcgcccggggccgcaccgagtgcggccgagccggagcgagcagccgaggcgcccctgagtgcgcagagggacgcggattggcagcaggagcggggatccgcgtccgatg

SEQ ID NO: 33249 - DNA, 85 bp, Chlorella protothecoides
catgtgttacaactatacctcgtccagtgtacagtgctcaggtattcatttgaaccttgaaatagctcaagaagcacagcattcg

SEQ ID NO: 33250 - DNA, 7053 bp, Chlorella protothecoides
  modified_base (121)..(198): a, c, t, g, unknown or other
ggcgcgcgcgtgaccaggcagtgcgcctggccgccgccaacgcggcgctggcggccgaggcagcggccgcccgggacgcggggcgggcgcagcggctgggcccgctgggggcgggccgcgnnnnnnnnnnnnnnnnnnnnnnnnnnnnnnnnnnnnnnnnnnnnnnnnnnnnnnnnnnnnnnnnnnnnnnnnnnnnnntgcacctgggggtgtcccttggcggagggaggtgggttttgaggatgtgagatgggcaagctgcacagtctgtcccatctgaggccgagggggagtgacctgcgccctggatccagtttgcgcctgagcgcttgccattgatatcaagacgtagccaccagcacgcaggggtaaggggaaagattatggttaacaacccaggtgatcagacacccaatttctcagtctcaacccccgggcaggagggtgaggggctgcgggcgcaggtggcggccgcgcgcgatgcgcaggcggccgccgaggcggccagcgaggcgctccgcgcggagctggcggcgctgacacgccacgtggaggcgcgcctgcgagttctctcctggcaatttgccgggcgcatggtggggtcgggttcggggcccgcgcctgctccaaagctgcccgccggacagccagacgcgtccctcttggcaaaggtaccagggaagaatggaagagaaggagtgtatcgctgcataggggcacattcttgcttgcttgtccctgggtataacaagcgatgcctagaacagtccctgtgtcagcacgacacaacccctggctcatcactggagtcctttgcccctccatttgtgcgcccacgcaggtcgagcagctggaaaggaccgccgtggctgccgcgctgcaggaccatgcagccaagctgcgcggcaggggtggcccgagtaattgagataggccgccaggcgcgagggatgctcaatgctgcagcacgctatgcccaccatgtgcatcagtctgatcctgtcctcgcaacctcccatgcccttcctcccaagctgcacgagctccctctgacagcatgatgatatcctcacgacagctgcctggcaatccagagcagtagcctgcactttcaacggcctacggcggtggcactcgccgctcagcactgcagctgtcatactcgagcgctcctccctctctttgcagcagcgccgacacagattcgatgtgggccggccccacgccacagcacccgcccacgacgcctgctcccgcccggacccaggacgcagcatgcgcagcatatgcgcctggcagcaggtcgcccacctcgtcatagtccccgacatcattgatgtcggccttcccccgaccctccagccactcgccggtggtctggcggaagccgttggcgtagccgccaacccgcacgccggccggggccagccgtcgcaggcagggcaccgctgcgcccaccgtgcccgggctgctgcagttaatcaggatggcctggaggcaagggatgtccttcaccctgtcccaggcggcctgtggggaaaagggctgggattgtcaaaaagccttacaacaagcacctacggggaagccttgccctccgccctggccaggcgatgaggcagccaaactccccagccagcgccgcacctgcaggctctcccccgagcgcaggcgtggctccccatcgctggcgtcctgcagagtccagcttatccacaccggcttccccgtggccgccgcggccgaggccgccgccgcggcctcgtcggcggaggacatggtctcgcacagcaggacgtccacggctggcgccatggcatgcgccagtgtggcatactcttcaagtcgggcttgggatcggtctgccgccgggggaaggtagcttgggccaagggggggaagcgaccctggcacgcgggcgatgcggaggcagaagggaatcaatgactgctatggagaagccacggctcacctggtctccgccttgactcagcaagcttcacccgctcaaaggccagctcccacgcacactgcgccacctcgcccgtctgcgcctcgcacctgcgaccacgaccggccgcggcgctgcgtcggcggctctcctcgccagcatggcgccggccgctgccagctcagcggtcctctccgccgcaccagccctgctcagggaccaggacgtgcacccgaaggtgttgctggtgatgacgtggcacccggctgcgatgtatacctcatgcaggccaacgatcaggtcgggagcggcagcgttggccagcgcggctgcagcaaactgccgctcaaccggtagatcgggggcgaagcgggctatgtcctgagacttgagcagatgccccatgccgccatccaggaggagcaccgagtcagcggtgccggaggccattggggctacacagcctgtcgacggtacttgtggaaccgcaagatcgaagtgagtcactacaacaaaccctagtgggagagttcgatcacctggacagtgggtgcatgcggtggagcatgacgtgcacgagctcagatcaccgaaagcatttcatcgagctgtgtcactccgcgcgcgagaaacttggaacctgcgttgcggagcttcccctgagattcatgacacggcatacattgatggacgccgcatacataccatcgagtcggtgaacagactgtaaaggtcagatactatactcatcgatcgccagatcttactccgagacgtaaacgcaagcataacccctccgatcgagtgccggcattttcctgaggaccagcgacacacagatgggaacctcacaagacctcgccgagtgggcgagaaacaacaaactgagggccataggtgagattgattatctgcatggctgaaagcaggtgctgggccctcaacttcccggcctcgcatgctccatgcatcgagtcttgccctcctcatcacacaaactaggtggactgtgggccaccggtcttgtcgcttccctgggctatcaaatgacgcgccccatccccatcagcctcgccattattcacagccgtgtttatgcccaggtttgttgggggacctggttgaaccgcctgcctttgagggtgacagggttggggaatgtgtgtacagaggcctcacagatgctctggatcaaccctctctctccccgattcctcattcatcttcaggcaatcacgttggcagctctggctgctgcgggctcggctcacttctttggcttggatgaaccctcccctgatgctcagaaggacaagatctgagtctttgcaaggccagggatgttggtgtcgcactttttcacatgccagtgcactgatttggcaaccatcttcggtaaagtatacatcgagcaaatcttaaacgcacgaaggtaaagcttcgattgatgcttgggtaaaaggtgtttagacctgtccaagaaacggggaagcaatcaaagagcatcttttacagatctcatccagggctttgtgcgatgaaacacggggatgaaagtggcatccttggtccaggccagatacctctgatattatatttttcgacattattagcgggaataaggccatagagggccaccgagccgcgcaaaacccttggacatcatcagctcatgaagcgagccctatcgtacgccagtactcttttctgtgggaatggagccaagcgagctttcgcagcagccacatccatcgcatcggaaacctgtgcttttgccaacgacggcccttacggtgtggctcccatgacggcctctgtgcctgttcccgggtccaccctgtccccacttcccgtccgggtgacgatcccgcaaggacccgttcagccctcccccatcctgtacctgttcaacggattcagggtaagcctctcaccagcaggccttgcgacgtttgcacagccccgcgacgcttccattcccatccatccccgtccggtggatcgtccggatcgcatattctcacatgagtgctctccgccccatcctcacccgacctcacaaacgtgcaccctcagatgacctccagctactacaaggcctacgcccagagggcagcttcctggggttatctcgtcgtgcagtacgacacaccctttttctccctccccaccgtcgtccaggaggtttgtggcccagttttgtcggcttaggaagtccagcacctcacccaacggatggctgcatgccgctttccgatccaacaccacggtggtcacctctgtacctctaccctgcgcgcctgtagatggacgtccacccagcgctacatgcctgggtcgaggcacagggcaaggccgcctctggcttgctgagcggccgggtggcagcggggacctgcgccacagcggggcacagccgcggtggcaagctggcgacgctcctctacctccgtgggtggcagaagaggtggctgtgggtcggggtggaccttgcacctgcggtgacccttgatgggagttggggaaagtgtgccgtctgagtgggtatctttgaggtcagtccacgccagggagatgtggtggcggggaagagtgagcatgcaagaaagatgggggcgcccatcaacccacaaacatcataccttccctctgccctcatgcgcagagcaccgtgcctacatcaaggcctgcttcctgatcgaccccgtggacggctccagccagtcgcccgcctcggatcccagcgccgcggccgcgctggcggcggccggcgcggcggtgggcatgagctccgcggggaggatcgggtcctgcaacccacgcgcctcggggtcgctcgccttctgggcggccgccgggcccggcagctggaacagtgtgctgtccaacgccaaccacgcctgcttcgcccaggcaggctggctcatgaaccacgcctttgacctcctgtgcggcaggagtgggttggggcgggaagctgcccagcagctggccacggtccccatgctgacctggctctgggacagcctcagccaggtgtgggctcaggggggcagggaggaccaggcacaggcttggtttggagggcatcgctggtgtggtgggtggggtgctcctcccatgccagggctgcacggtccttccaccgccagaccgctgtcaccaccacgcagggggccggagcagcagtcatcctgcctccgacgacagagtcccccgacccaggcttcaaggagtggtacgctgctcaggtggaatctgggttggtcaaacccctggaggtgaagaccccgagcagcaagccggttgcaccaccggaggagcaggttgtgagggctccacagcgcatgccgctgcctgcttgagcgcgatggattcgtgtgcttctgcctgagaagtcattacacagttttgagccagaaccccatatctcttcgactttgcgaagtgcccctacccctgcctcccccagcttcccccacccccccaaccatagcatgcgctgcatacgtgtgcctcgccccatggccctcgaccctgcgacacacattccgggatcgggtctgcatgacacaccgttgcaacctccaagatattgctggcattccgggatcaccttgtggtggagtggggtgctccgagggccaacgtggtatgctaacaacccggacgctggtctccgggtgaggctcgtcacatgttcaagaagctgcgatcctccttcaccggtggatctaaatccagctccaaagtacgcctggatgtgaccgtcgtgtccgcggccggactgccgggccccacgtcctgtcgggtggtgtgggctcggcagagcaaggtgcaggtcacgcgacaggctagtgtcggggagacaggtgcgtggtgcgatggaagggcacggcatgcgaactttccatttgtgcaccggatcgtagggtagggtccgccctgccggcacagcaggcggggactgaggtttcatagcctggtgctcagtatgggcttcacccaccctcccccactttctgccaatcaggcaccgcgagctggaatgaggagctcagccagatcgcgaccatggagcgggacgccaagggcgcttacctccccaaggtattgcccgggcgggcagcgaggctgcacttggggcgggagcgtggggtgggtacgagtgtgggagacgcagccgacgcagtgccaagagactgggttgcttggtagctacccggagctcttcctgcatccatgagcatcaccttctttgcctctggccgaggtattgcagctgggatgccacttgtaccagcccccgctcccccttctcaggagtacgtgctgaagctgcagtgccccgaccgcagcgccgccggcaagttctccaccgtcggcaagctgaccttcgacatggcctcctgtgttggcaccggctccggcaaggccgcgcgcaaggacctgcgcatcccgctcagcggccgcgcggccgcgcggcccgtggccgtgctcacgctgctcgtctccgccaccctggtccagggcatggacggcgaggagatggaggaggaggaggaggaggacgacgaggacctggcgtccgacacctcctccgtccatggcaccacccctgctgacgcccgtgctgcgggcgcgggcaggggcgcccgggacgggagcgtggcggcgcggagtggatcgggtctcgaggcgggcggggacccctccagccccgtcaagcgcccgggcagccccctgaaggcgcggatggaggacctgaagaacagcgtcgccgcggccgccgcggcctcgcgctgtgaggccgacagggccggcgctggggtagaatgcgccgccgcggggttcggcggccttgcgctgggtgcagaggcgcggccaagcaccggcgtgggaggcccgccgggcgagtctggaggggccagtgcaggcggtccggggcccggggctcaagcgccgggcgcccaccatgccgccagcggggtgggcctcgacccctcggaggccatcatctcggagctgcggctccggctgcaggcggcggaggcccgcgcctcggcggcggaggccgcggcggccgcggcggcggcgcgccc

SEQ ID NO: 33251 - DNA, 157 bp, Chlorella protothecoides
gttggggctgcatttcgaatgggccttacatcaggacagacatgtggttgcgtcgatgcacgcagaggagaatgtaggtctgccagatgtcgcagggctgtgggtgtagcaggcaatgccgagcggtccctcacctgtggcatcccggccaaaccac

SEQ ID NO: 33252 - DNA, 61 bp, Chlorella protothecoides
aaaaacgcccttggcccagttgccattggcgttgccactggggcactgcagcgtctcccct

SEQ ID NO: 33253 - DNA, 61 bp, Chlorella protothecoides
gcggctgcagaatggacggcccgttgtctaacagcgtccccgccgaaacgaaacgcaccaa

SEQ ID NO: 33254 - DNA, 131 bp, Chlorella protothecoides
acgagcttcgcgctgcgagtctcgacgaaacgacacgtgctgtccctgtcaaaggcattccacgggagcagagcctgccgcatgttttgtccacgggcgcaatggcggagggatcgccagcccctccatcc

SEQ ID NO: 33255 - DNA, 77 bp, Chlorella protothecoides
acaacataggtgagagttgggagaggaatcctaggacatgagtgattctcacggccgctgctgcccctggattatga

SEQ ID NO: 33256 - DNA, 62 bp, Chlorella protothecoides
cgagcacatcccattcccccgcccaaaccgaacccctcccaccttggaggacatgcggccgc

SEQ ID NO: 33257 - DNA, 61 bp, Chlorella protothecoides
gacataccatggcctggcagcaggctcttcaagttgtcagccgcgcaccttcatccccccc

SEQ ID NO: 33258 - DNA, 10048 bp, Chlorella protothecoides
  modified_base (1087)..(1096): a, c, t, g, unknown or other
  modified_base (1554)..(1563): a, c, t, g, unknown or other
  modified_base (1807)..(1816): a, c, t, g, unknown or other
  modified_base (2196)..(2205): a, c, t, g, unknown or other
  modified_base (2444)..(2453): a, c, t, g, unknown or other
  modified_base (2902)..(2911): a, c, t, g, unknown or other
  modified_base (2969)..(2978): a, c, t, g, unknown or other
  modified_base (3106)..(3158): a, c, t, g, unknown or other
  modified_base (3876)..(3885): a, c, t, g, unknown or other
  modified_base (4091)..(4100): a, c, t, g, unknown or other
  modified_base (4524)..(4533): a, c, t, g, unknown or other
  modified_base (9894)..(9903): a, c, t, g, unknown or other
ggaggagggggactgggggaaggagggggactggggggaggaggggggccagctaatatctaccaggtgcacattgggaaaagccgtaatgtcacagcaatgtatcaagtttaccaggtcagggttagggcgggggtgcccccccctgaaatctgcacggccttcacttgaacataggacgcaaaggctgccatgccatcagccactggaacactccaagtggtcggtttaccactgtaaccattggagcctatgtaaaccacagcaccgtctgccgtgaaaaaagcatagtagaacatgtccggagggaggctgctgatagttatcgagaatgaaaaaataccattggcatgagtgacacttcccttgagtggccccagtgctggtggtggaggggagggtcccggagggggtggtgaagggttgagcagagtcagcgacaccacctctttgaggacaaaaccgtctgtgtagaggaaggcggagccataataataacctcgcagcatctccaacgagagtgactgcttcacaagtgtatcaacagaagatttggggctgaagtcctgcataaagtagagttgattaaacagatctgagtacataacgcacgcggccatggcgggagtatatccccctgtgttaacgatgcacgtggcgtcgaccaatccatctgcaggcacactgaactgaagtgttgcactcgctcgtggtggtggaggtggaggtgggctaggtggaggagggggccttggtggaggagaggggctgggtggaggagggaatcggaatggaggagggggccttgggggggtagggagtggagacttcttggcaggtggggaaggggatatctttggggaggatgcggggaacatcttggatggcgatgggggagacatctttttggggggtggtcacttcttggcgggcgggggtggtgacttcttggcgggcgggggtggagagctctttgtgggaggcagggggaaggtgagcgtccttgcgttcttgtaaagctcaagcaagctgcaattgttgacgactttgcgatctccgacgctgttgaagcagcggttgcccttgnnnnnnnnnnatggaggagggggactgggggaggacagctcgggcttgaaagtgggggtggaggcttcttggcgggtggcggaggggagttcttggcaggtgggggcgggaactttttggagggaggcaacggtaagtcaaggacccgtgcatacttgagcaactcgagcaggctgcagtcgttgattatcttgcgatcaccagtcttgtcaaagcagcaattgctcgtgcccttattgttgctttcccagttggctatgcccacattggagttgcctggaagaggcagcaccattgaacttgtaagtcagttccacccaagagtgcagcggctgtgcacataccgcatgccatttaaccccaaccccccctgctcaccgatattgtcatccccggcgttcttggtgccaaacttgttcttgcccttgttgccaggaccaatgttgccactgctgtctgccgtacaannnnnnnnnntattcatgtcctttgattcctctcccgacgctcaccgatattgtcgtccccgatgttcttggtgccaaagttgttcttgcccttgttgccggagccaatgttgccattgctgtctgccgtacaagctttctggcccgccttgaggcactccacggctacgatgatctctgtggagcgtggtgtcacaacctccaaggggttcaaacggatggttgacatggacagtcccatgatgttaagggtnnnnnnnnnnagctttctggcctgccttgaggcactccacagccactaggatctccgtagagcgtggtgtcacgatctccaagggtttcaaacggatggctgacacggacagttccatgatgttaagggtcgaggtgcggacggaccccgccttgctgaagccttcatacctgcttgcagtgggtggtagatgtgaatatgttgggctgtgcattatccatcgttcgtggaaagccacatataattgaaaatggctttcatggtccagtccagtactgtgcaagcatagtcatggactaacaacctcccattgctacccacatgcagattgcgtttgtgtcgtccactgtcatgaggttcacatgggtccccagactgcaagtagatgannnnnnnnnnaatggtccagtccggtactgtgcaagcatagtcgtggactaacaacctcccatttgctacccacatgcagatcgcgtctgcgtcgtccactgtcatgaggtacacatgggtccccagactgcaagtagatgagcatttgtggaatcatgagagcaatgcgcgggtgaaagaaaaaatgaagtagtcgatccaggtgcgattcgtatgttcatgactgagggggcgagtttgtggactcnnnnnnnnnntatgcacgggtgaaagacaaaatgaagtagtcgatccaggtgcgatttgtatgctcatgactgagggggcgagtttgtggactcccacagaaggtgggacgggcatccggacaccagggtcacgtgcggggaaggggttagacggacagggaacatcgttagagttgctcccaatcccccgcccaacaagtcattcgacttacatagaactgggaagcgcaatgaatgtggagctgcagatggtctggtttcgaaaagggaagacggtgaaaaaaaggggagtgggggcaaacagggtgcggccaacgcagatttgccatcgcaactagtgcaccctggctcaccgcgaaggcatatttggcgagtatcagcactattacactcaggactgcagggtttctagccgcagcagccatcctcgaccttgcggcaaacgcgcccttcagccnnnnnnnnnngtccttctcgtgcgctccgatctgacatatgagggacgctggcgccctgcagcttcannnnnnnnnntactgcagggtttctagccgctgcagccattttcgaccttgcggcaaacgcgcccttcagcctgcttggttcgcttgtgttttcagtgggatgccgcttttgctcgtcgtcacgcttcgattctggcnnnnnnnnnnnnnnnnnnnnnnnnnnnnnnnnnnnnnnnnnnnnnnnnnnnnntcttatttcaggcagtgttgctggttttgggagctgaacagcttcggcgggaatccggaggaagcataccggtgcggactcgcgagattgccaaaccctcatggtaatttacaccccatgtctccggcttccgccgagacatggatccactgattgaggccccatggccttacggagtcggttcgcatctcaagatatccttcttgtgaatcttgatacgttcgatactcgatagacgatgtgcgatcccatcgagtcaacaacgccattcataaccattgacctccaggagtcgctaagtcgcgtgctggcagatgatcacgggctcgatgttgatgctttggatgacacacagcgatgcatgattgcatctctgttcaccgagcgtgaggaaatggcgggtggccggcttctgggccatgaggaccgcgccgccgcattcggactcgtgaacatgggagtccccaaggctgatccttacttcccccgcacgaacaggctcttccaccccgatacttatttcctgcaatgtgggcagcgagaatcgttcatccatttccccggtctccgacctctgcgtctgcccttcaggctatggtccagagcaggctcccacacaggggatgcactggacagtcaggcaccttcccgtgtacctagaccagaccccccactgggacaaggccctcttgcttttccgatccaggacaacattgannnnnnnnnngtacttatttcctgcaatgcgggcagcgagaatcgttcatccatttccccagtctccgacctctgcgtctgcccttcaggccatggtccagagcaggcccccacacaggggatgcactggacagtcaggcaccttcccgtgtacccagaccagaccctccagtgggacaaggccatcttgcttttccgatccaggacaacattgannnnnnnnnnacggggggggtgtctcggcgctctgccgggggagtaggacgctgttctttggctgaacatcctcatggccgcgcggggatcacccaaccgcctggcctgggggcatgtaactcctcgcaccatgcctgctcccaggctgccgggctccgacaccctcacgcccaccgctcgtccatatcccacacacaacccacccctcatccgcgcagcgcgacggcgcggactccaacaagctgcccaccagccacacctgcttcaacacgctgctcctgccctcctaccgctcgcgggagaagctggccgaccgactcaagctggccatcctcaactccgagggcttcgggctggagtaggcccccgctcgctggaccccccccgctgctgcagccggaacccgccgctcacaaacccctcccgctcatgnnnnnnnnnnatcccccctgctggcccagctgagccccacccagcaggttgtggacacatatctggcgcactcactggacatgaatcgtgatttccccgggatggatgcccctgacgcctcctcctggcccgctgcatcggtcagccagggccctgcgtcagcagggcgggaagggggctgggagcaggccatctccgaactgcttgccagtcttgcttctagccagcttcagcagttgggtgcctgcctggagcagttcttccagatgttgaaggtggtgagcactgggcttgtcaagggaccggggtggaaaggagaggagggggggtgagcgcaagtctcgtggacaatggacggcacatgtatccctgcgattatcccgaggagccttcacattatactagaccccaaaccgtgcgtctgcgtctatgcaagacgcatccgcttgcgggctcacccctgcatggaccgccacattccaggtgggcgtgctgttgggcccccgcgccgcggcaggcaccgtccatgccctgctccttcgtaccgcagccctgctggggcaccgcctgcgggataccgtggacctgcccgcgctgttggcggccgcgccagaggccgcgcagtccaggctggcggcggcggcgggcgcctgcgacgcctggcggcgcggctacctggccacccgggccgagctggaggcgggcgggcagaccgggcgctgggagcacgaccgcgccgccctgttcgcaggtacagaccacgcggcgggcgcgtgccggcggctggccggggcgctggcgggggtgcacggcgtgctgggcctgctgggcgccgatctggaaagcgtggcgggggcgggcctggaccggctggctggcctgcgtgccgaggctcgggccgcgctgggcgcgctgcgggacgccgccctggcggccccgccgggggattttctggacccggggtcggcggggcgctgggaccagtgcctagcgtccttggaagctgcggggaagtcgctggccgccggcgcgcaggacctgctggacacttcgctcacccgctgccccggcgcggctgacggcgcccgcctgctgggcaagctcctgcgtgaccggcatgctggtgtagccctgctgcggcacgtgccggagaaggtcacggacctggtgcagacttttgcagcagaggtgaggaggaaccaggcggatgagagaggggggggaggggacaggttggggaaaccggtgcaaggagggggaatggaggttgggcctggccactggaaagcttggaaaggagcaagcaggcaggacccacaaatcaagtcacagcaaggaccgagagaaactccgcgccatgccagctccacgccgcacactgtagatccgggtggctgagcgggaggcggaccgctggtgcgagggtggggcagggaaccggacgccctaccccggcctctctgccttgacctccaccttgctcagggtgagcgccacaaggtcacggctggaagaagccgcgacagccatccaggcctcgggcgaggctctgactccagaggatcagggcgtgatggctgcctgtgcaggtgagtgggcacagctacttgaaatcagcacaggtctggtgtggaggtggagggcagggtcaggcacagtccctcagcctgtgcggtcccgtgcctcataatgcagcagagtatgcgtgcctgtctgcctacgcatgcgaggactgcagggcaagagaatacacgcctgcctgcccgacactccatgcccccatttgcacctgaggtctagccccagcaccccccctcccccccacaaaaaacacatgcacagccctcgtgcagcgtttggcgctggcagaggtggacatctggcgggactgggtcgagcgtgcggagcgggaggtcggcacggccatgcgccagcccctgctcgtccagccgccgcaggaggcggccagcggctggccccttgccaggatcaagctgccggagctgtccgaccatgtgcaggccgcgcagcaggcgcggtgcctcgggatcgctgtgccgccctttctgagaggggcggcgctggcactgcccctcatgcttgaggcggggcggcgcctccaggcgctcctgcagcagctcgccgaggtaggaggaagcctcggcaggcgggggcagttcggcatcgcagctgcgatgccctgctgcctgctgcatgcctctgctgctgtacactgtggttccagtgcctccgacaggccctacgcctcaagccacatctcacttccctccaactttctgtcctacacagagtcggcgcaagctacggagccccgagcggctgctgctccagccggctctggagaaagtgaggctggctctcctgccagggacgcagcacatgcactggggctccctctctcttgacgccttcatctcttccgtgcagaaggtgaggctcttgggttggagattgagcagatggggcattgagacaatccgcaagagggtatgtgccacccatgtgcctttattgccacatcactgctggggaaccacgctgcgcacccctcctgcaggccatcgcagccttcacctgcaccgccaaagcggtagcctgcgcagcaagcgagatgcggcgggcgctgcgtgccctccctagagagacagactggcccggggaagggaccgatacaggatcgagggtcatcgatcatgcagccaccaatgctggacttggcgggagcgtgcggcggggggaggaggctgccgtggcagcagcacatagcctgcaggccaccctggtccggatagaggagggcgtgctgggcactagcaccggctctgcccggagcatggccgcttactatgagcactgggagcgcaggctccaggatgcattggcagactgtgccatctcctggatagaggggctgacgagcaggctgtctgggagttgcgatgataccggacgcaccatccatgtccaggtttgggatgacgaggatgtgggttgcgaaaggtgtgctgatacacagcgtcaggggttgggttgaatggctcttaggagttgcacgcaccgcgatggcacctccatgtcgacgtgccctcggctagttcaccctcaggcccatgtggcccttgtgcacttgcagatggagcttcagccgcagcagggactgggccccctgctggcctggcagccgcgcccgtcactggtgacggagcagctgagcgctctcgtcacacgacgagcggcgctgggagcggcagtggttcgatggatcccagggacgtgcacgccctgtcacacccagcctctgtgagtccggagttgcatgaggattgcatgcagcagggaggggggtgtgacccatagtaacccacatcgccactagcaccattcgtggtgtgctcttgccatgttccctttgctttgagaatgtccaaatcctgtctcacggcagggtgacgcaccatgaggaccttatgcatgacccagggatctttgcagccacagcctcgttttctgtcctgctccaaggcatggagcgcacggctgaacagtgagtggtttatgtgatcttgaaggcaagatgttgtggaatggtcgggggttgtaagcttttgccttctttttggattggcatggaggtccatagtattcatttgcttacctctttctgactgcagcagtcgtctcaccaggcttgcgagaagccaggtgtgagcacctggcagcagcaggaccctgcgggtctcaagcatacaagtcttctcccccttcctgctctcccctgtcaggattttggagcagtggactgccatgttgacaggatcccaagcagagctgacaccatcgtccgatcagccggcattcacttttcaactggaggccaagagtggcaagaaacatccaagtcatgagattgaggctctgaccaggtgtgcagtgctagggaccaaggaacaggagggcattcttctactggtcaaaattctcacaagtaaggcctcccccaaatttgacgtgccacagatttaagatagacctggcaagaattcctcagactcaaattgctgatggcgtgcgcatggatgccacccctgtgcttgccttgctggaggcggctgcggactgggcgcttgcaatgagcgcatggtgaatacacaagcctgtataacgttctgttgctcagcacctggaagttttccttatggccaattgaaacccgtttcaacggattgtgcagtgctggaggatgttgttatgccggggaggttggtggtggcttgcttgtgaatcgcgcgcctagacgaccggatccggtgtcgtgcgggagagccttggccttcaggcctcccttagggacgaagtcctcatcatcgtaaatcgtcttcacctttcaagcatggctaacaataagtgattgctgcatggcggtaggcgcacagcctagatgcgatttcccgaagtgttcgagcttgcgagataccagctgaagggtggttccaggtagccgcatcaggcgacccgctcctcttcagcattgtccagccatggatgaagatgtgtctcttcctcgtaccaccatccagaaggcggtgaagggcgccctgccccccgggctgagggtgtcgtgggacgccatcgacgtgctgacctcctgctgcaacgagttcgtgcacctcatctccagccaggccaacgtcatcagcgagcgcaccaagcgcagcaccatcacccctgatcacgtcatccaggccttggaggagctgggcttcgagacccttgtgggccctgtccaagagggtgagggcctggggtctgttgttgagggaaaccatgccactgagggggtgttggctgcctaggatcgtgcaaccagctgatttccttgccaagctgtcaccaaccacgctctcctctgtgtccttccagtcctggtcgagttcaagggggagcagcggcagcaccagggccggatagggggccgaaaggctgccggcaaggaggcgctgagcaaggaggagatgctgttgctgcagcagcagctgtttgcacaggcccgcgagcggacgctgtcagagccctccccaatggaggcggggcccgaggggggcgggggcgaggggcccgagggtgcctcgctgtgagagctatttgtatttgtttcacatggcatggtttggtcacaagggagagagggttgtcgaaaacaggcagaactgtcaggaggggccaggacggtcagcaatgcgtgtgtgggggtgcgtcagatccatgagcgggaggggtttgtgagcggcggggtccggctgcagcagcgggggggggtccccagcgagcgggggcctactccagcccgaannnnnnnnnngcttgctgggtggggctcagctggtccagcaggggggccatggccttcaccaccgtgcatgtcgccccggaactcggtccagcgggaagcggcaggagctgcacagtgggtccattcaatgttgtcctggatcggaaaagcaaga

SEQ ID NO: 33259 - DNA, 71 bp, Chlorella protothecoides
cctgctgagtaggtatatgagcacagggaactcgatacaccttctcgtcccatgtgatgaactcgcaaggc

SEQ ID NO: 33260 - DNA, 76 bp, Chlorella protothecoides
cccacgtttgcggcaacatcactctctgctccaagattgcctccaccaccccctccctcgtccctggatgccaccc

SEQ ID NO: 33261 - DNA, 61 bp, Chlorella protothecoides
ctggagatgatcaaggtggggagagacggcctgtgtgcgtgtgcgtcccttggggtaagca

SEQ ID NO: 33262 - DNA, 470 bp, Chlorella protothecoides
gaggagggcggcggcgccgcggcgcgcctgcccgcgcccccggccacgctggcgcggctggaggaggcgctgcgccgcgcctaccgcgccgtgaccgagggcaagttcagcgacgcgctgcgcctgatcgacggcatcctgcacgccgtgcccttggtggtggtggacagccgcaagggcgtggatgaggtgcgcgagctgctgggcatcgcgcgcgactacaacatagcggtgcgctgcgagctcaagcggcgcgaggcccgcgatgacccgcgccgcgccgccgagctggccgcctacttcacgcactgcgccctccagcgcgtgcacctggcgctcagcctgcgctccgccatgtccgccttcttcaagctgaagaactacgccacctgcgccacctttgcgcgccgcctgctggacctccagcccgacgaaaaggtgggtgaggtgtttttgtgtgttgggggggg

SEQ ID NO: 33263 - DNA, 79 bp, Chlorella protothecoides
cctctgaaattgcttgtaccacctgcatgcaagagtcccgctgccgggaagtccaatgagtcttgtaaagtcggcacat

SEQ ID NO: 33264 - DNA, 450 bp, Chlorella protothecoides
  modified_base (111)..(316): a, c, t, g, unknown or other
gtggccgtgatcggaaacggcggcatagccttggagctcatgtgaggatgtggagggatggggggtgggcggtgggcaggactgaatggtgccgcctggggtcaaccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgccagggcagcgtgtcagcgccggccggggacggcgtggaggggagctgcgtggaaggtggtgcagcggggggcagcgacgcaactgcgagcagcggtgcagcccaggccaggcagcgcgaggggccgcc

SEQ ID NO: 33265 - DNA, 71 bp, Chlorella protothecoides
cgccatcgcgtgcatacccgtgatgacgacggtcacatccgcagcgcccaggttggagaggaggtcataca

SEQ ID NO: 33266 - DNA, 64 bp, Chlorella protothecoides
cagcgcccaggttggagaggaggtcatacagggtatcaggggtggaggccgagaccacgggctc

SEQ ID NO: 33267 - DNA, 71 bp, Chlorella protothecoides
tgaggtctcccatgttggagttccctgcatggttggccgtatgcatggtataatcagtggcaggggaagaa

SEQ ID NO: 33268 - DNA, 114 bp, Chlorella protothecoides
gcttgaaccagacacagcaaggctgtcctgggacccccggaatgagagccccgcgccgagccagatacaagagggggggccatcgacaggtggcatcgaccccggcgcttcacg

SEQ ID NO: 33269 - DNA, 61 bp, Chlorella protothecoides
tggcacccatagcgagaggctggtgaaagggacatgattcactcgtgtgcggctaggtatg

SEQ ID NO: 33270 - DNA, 121 bp, Chlorella protothecoides
gctttcggactctctgccttcagagtgcgtggtgcactggtcgtcagtgtcgtgggtggtagcatcctttatggatggctcgtgcttggcatgtctgcaggttccgatagtgtgtgccatc

SEQ ID NO: 33271 - DNA, 354 bp, Chlorella protothecoides
ctcacaaaggcagcagatggtcctgaagaggtaattgcacatgtgattttgatgcatgatcagagaaagacccttcaacctagtagacagacacagcgatcttgagggcgtgaagtgaatgaagctggaggggtgatgtcactcgagtatcaggggttggcatgtaggagtggacgacacacttgaataatgacccaggaggaggatcttatcggtggtaaagagaccccctggggctgtacgaacagggcaacaaaagagacagatcacttatacacggccctgcgctcatagtttggcataggttggactgccaaaagcagacgaagctatgaggtctacccggagcggggg

SEQ ID NO: 33272 - DNA, 78 bp, Chlorella protothecoides
aaaaccttgtccgcatgcagcacaccccttccgagagccatactccaggcacccagtcgcacctatcaaccagctgtg

SEQ ID NO: 33273 - DNA, 79 bp, Chlorella protothecoides
caaccccgatgctgatacagcctctgacgactctggcattgaggaggaggacatggacgagccccccaagcgacctccg

SEQ ID NO: 33274 - DNA, 61 bp, Chlorella protothecoides
atatcctccaagctggccggggaatggagcgccccaaacgtggccggcatgctcaccgccc

SEQ ID NO: 33275 - DNA, 131 bp, Chlorella protothecoides
atatgtgaggggcgtagaaattgggtggatacggtatgtgtgtgcctgtcaggcgtttgctgtttgctacctgccttgatgtcttctcgcttcttgttgcctggtgcagctggaaagtacctgggcgctca

SEQ ID NO: 33276 - DNA, 61 bp, Chlorella protothecoides
gccagagcaccacttgaaagcattgcatgcacctgccaggaatggagccagacacgcattc

SEQ ID NO: 33277 - DNA, 105 bp, Chlorella protothecoides
gcaaggagcgcctgttgtgcaaatatacttcggggtgtcggatctgaggcgtgtaaatgcagtccatagacaccgcgttgagcacccaaggaagccgaggtattg

SEQ ID NO: 33278 - DNA, 95 bp, Chlorella protothecoides
ctgcgcaaggtacggatgcgaggatggggggccggatctataaatcttgcccgtattcgcagtgcatgtcggcaccacacgggctcgcaccatct

SEQ ID NO: 33279 - DNA, 2839 bp, Chlorella protothecoides
  modified_base (94)..(103): a, c, t, g, unknown or other
  modified_base (490)..(499): a, c, t, g, unknown or other
  modified_base (1810)..(1819): a, c, t, g, unknown or other
ttgtgtgttgcatcggcggtgtctgcgtggtgcgagccgaggtgggcggacggatcgggacgtcgtgaggggtggagaccacggaggtcagccnnnnnnnnnntgtgtgtgtgtgttaaatcggcggtgtctgcgtggtgcgagcccaggtgggcggacggattgggacgccgtgaggggtggagaccacggaggtcagccaacccctcccctcaacccaccacaatccccaccctgacacgcaggccgacgggcgtggtgcggcaggccatgctgggcatgcacttcccccgcctggtccacgtgcgcagcgactggacgctgtgcaacggccggcggcgacgcggcggctggcgcctgaccacgctgaggaagcgcatcctcatgtgaatcgtgacacgtgtggcgtttgtgccggggcgaagagtgtgcgggtgcagcgctgcgagtgcgcgccctcggcccgattccctctaccacctggggggcnnnnnnnnnnggtttgtgccggggcgaagagtgtccgggtgcagcgctgcgagtgcgcacccccggcccgattccctctaccacctggggggcgtccccccctcgaggcggactgtaccattcctgaactcggttgtgaccatgtgacattgccaggcgggtggggtggaggggcccggcagggggtgcgcgggtggcgggtctggctggggacttggcccccccttgtcaccagaaggattggtcggtcctggcgccctcggcacgaccgaggcaggaaaccctcatggcaacgagggccaagcgcgtgggtgacagaatcgatgccagcacgggaatgcaggatcaggcacatctggctgcatcgaccacacggtccgcccagcgctgacacccccagcgtcgtcgcgggacgcgcgagccagctgctgctcagcggtgatccggcccgggtccgagaatatgctcgactcacatgccccgcggacctggccccccggcatccacacggcatcttcctgacccctgagcacagaaagtggacagctcgactgccctcgaccgccatcgaccagatcaataccatacccggcccggactcgtgcgaatcccggcgcccgcgcccggtgctccgacccgccccgacagatccaggatgcaggaggcactgggcgacacctttgctggtaagacaagcgctgcattctagacatgcatgctggggatgccacatccccagaccggggtgggagcctggccttgctacctggcgggcaaagcagtgggcatgaatttccacccccacccctcaacccccacagtgcccctcaagtccctgggctccggctcggacctgaccctgccctcctcctccgaggccgacaccttggagcgccatgacctggccctgctaacggggtcggcccccaccctgacccgcgatgagatattggagcggcgccggaagcattatggccccaacctggccctgttcttccccgaggacccgctgcacgtcaccagcgccgtcggctgccggctgtacaccagcgactcccgcgaggaggccgactcctacctggactgcataaacaacgtctcccacgtgggccactgccatccccaggtcggttggctgctgcggttgggagttgctggatagggggaatggggtctggggtgtcgtcatggccgccacgcctgacccagcaagcgcgcctggtccagatggtgattgcaggggtgtcgaaggagtgacggagagctaccctggcctcgcctgcccgcccaatactgggcgggcgtgtgttgatgggcctgnnnnnnnnnntgaaggagtgatggagagctaccctggcctcgcctgcctgcccatactgggcgggcgtgtgttgatgggcctgatccaggcatcttccccgcccctctccctttggtgctcccggtcccgtcgcccctccctcctcccatccactggcccacccggagtcaagcaccctcaaatcactccccccaggtgacggcggccatcgccgggcagctggcgcgggtgaacaccaacagccggtacctgagccaggagcacgtgcagtatgcggaggcgctgacggccaccttccccgccccgctggagacgctgtacctgctgtcctcggggtcggaggccaacgagctggcgctgcgtgtggcacgcacgctgcgctgcgacggcgcgccgcgcacggcgccgctgcacgtggccgtgctggaccacgcctaccacggccacaccaacgccgccatggagctgtcgccctacaagttctacggcccgggcggcgccggccgcgcgccgcatgtccacgtcctgccctgcccggacacgtaccgcggcacggggctggacggcgaggctgcggcgcgcgccgcggtggccgaggctgctgccgcgggggccaccatcggcgccttcttcgccgagtcggtcatctcctgcggcggccaggtcatgttcccggacggctacctggccggggtctaccgcgtcatgcgggagcagggcgcgctgtgcgtggcggacgaggtgcagtgcgggtttggccgcgtgggcgacgccttctgggccttccagctccagggtgtggtccccgacatcgtcaccatcggcaagcccatgggcaacggctacccggtgtcgggcgcggtcatgtcgcgcgcgctggcgggcgcctttgccgcggcgggcggagagttcttcgccacgcacggcgggtccaacgcggcggtggccgcgggcgcggccacgctgcgcgtgcttcgcgaggagggactgcaggcccgcgccgcggccgtcggcgcccacgtcgccgcg

SEQ ID NO: 33280 - DNA, 61 bp, Chlorella protothecoides
tgagatattggagcggcgccggaagcattatggccccaacctggccctgttcttccccgag

SEQ ID NO: 33281 - DNA, 61 bp, Chlorella protothecoides
cgacggcatcctgtacacccaggtgtgcccgcggtgggcggctcggagtggtgcaggaacc

SEQ ID NO: 33282 - DNA, 105 bp, Chlorella protothecoides
cgcggtagaggggaggaggatctttgcctgtaggctcggcgcacccggctgtgcctctcgccgaggcagcgagcccgcagggtggaggttctcttcactgccgag

SEQ ID NO: 33283 - DNA, 61 bp, Chlorella protothecoides
tcccatatctgtatgagataacgccatccctgacatcgacactgccaccctcgctccttac

SEQ ID NO: 33284 - DNA, 61 bp, Chlorella protothecoides
atgcatcaccctacgcgtacgactgtcgagtaccatgtcgccgggggcgacattcgcgctg

SEQ ID NO: 33285 - DNA, 68 bp, Chlorella protothecoides
gaattccggagcgcctgtgacgcaggtacggaggtggataccctgctggtggcaacactgagatcatc

SEQ ID NO: 33286 - DNA, 61 bp, Chlorella protothecoides
ctgtgtcctgatacacggccctgcatgtggaaaaggtgggttcacgatgggtgtatcgctt

SEQ ID NO: 33287 - DNA, 61 bp, Chlorella protothecoides
aaccccacccccgacgacaacaccccacccccaaaccccacccccccgcttcccaatacaa

SEQ ID NO: 33288 - DNA, 128 bp, Chlorella protothecoides
ctttccgttgatgtaaggctgcagcacttgaaaggcctgagactgatctgctgggtcccccccaggatccgggcaccgcgctccttccgagtccccgacacctggctgttcatacgcatgggcggtag

SEQ ID NO: 33289 - DNA, 74 bp, Chlorella protothecoides
cgacagggtgcagctcacccatgccctccttgatatcatctcgggcgccatgcaggcctgcccactgcctcagc

SEQ ID NO: 33290 - DNA, 126 bp, Chlorella protothecoides
gagaaggtcggcccttgcggcggcgcggctcccgcgtcatttgggatggaccgcatcgtatgaagtcccttggcacccgcacccgcatgggctgcctgctggatttccatccccggtgttcatcag

SEQ ID NO: 33291 - DNA, 61 bp, Chlorella protothecoides
ccttgtgcagaggaagacccttgcacgccggtgccctgcccttccaccaccacgccaccaa

SEQ ID NO: 33292 - DNA, 74 bp, Chlorella protothecoides
aaggctcaagctgccacccaagcgcgtgttcgtgcactcccaggacgtggactttgtggaggagcggcgcgtcg

SEQ ID NO: 33293 - DNA, 105 bp, Chlorella protothecoides
ccagctcctgcgctcgcagagcaaggggtggggcttggcagggctgtacatgcacgcagtcccaggcacgcaccgcgggcgctcccctcccgcgccgcccacctg

SEQ ID NO: 33294 - DNA, 115 bp, Chlorella protothecoides
aggtgagcaggcacagcaggctacctggggaggacagggccaacactggctgtcgtcaccaaaaggtggggccctctgaggtcaccttgcagccttgaatccccccttcctcctc

SEQ ID NO: 33295 - DNA, 114 bp, Chlorella protothecoides
gccatggtggccgtcgcgcctggagtggaggtgggagagcgggtcggtggtgaggggccgagcggtgcggcgaggccgcccaagcacacgcgtgcacccagagcgcccctgcgc

SEQ ID NO: 33296 - DNA, 73 bp, Chlorella protothecoides
gagcatgagggggtgcaagttctataggtcctgtgggaccaaacaaaggagcagcagcatacgtgcaagcacg

SEQ ID NO: 33297 - DNA, 61 bp, Chlorella protothecoides
gatgttcttccttaatgacaagcatatatccgatcaccaatgacgttactaaattttaagg

SEQ ID NO: 33298 - DNA, 61 bp, Chlorella protothecoides
tggctgtccgatccacagggagcggctggggacccaatccccaaatcgaatctggcacacg

SEQ ID NO: 33299 - DNA, 122 bp, Chlorella protothecoides
gcccatccatggacccaccctgtgcaccctccgatggccccagcgggcccgcccttgccgatgctgcccccgctggtggagttccccggcggccggttgctcaccagggaggaagccgctgc

SEQ ID NO: 33300 - DNA, 190 bp, Chlorella protothecoides
caggccatgcgcccccggaaaggttgctgaagagtggaatgaaacctaggaagatcctggcccccaggctgcatcgccccggtgcctgcaccccactccctgctcccccctcttcctccaccctctggtcatcagcaccccaccccccatccctcacccaaacactgcagaggctgtccagctggtcaag

SEQ ID NO: 33301 - DNA, 80 bp, Chlorella protothecoides
gccattgcacagaataaccggcacagggaccgggagtatggtttgggtcgaacacgagtcatgccagcggcagccaggcc

SEQ ID NO: 33302 - DNA, 113 bp, Chlorella protothecoides
tcccagcacgccaggggaattacatgggggctgacctgccggaacagggaagaggagtggcaccctggagcgggtcatgttccgcgcaaccagggcgcagtccatgcccgaga

SEQ ID NO: 33303 - DNA, 711 bp, Chlorella protothecoides
  modified_base (122)..(389): a, c, t, g, unknown or other
  modified_base (464)..(651): a, c, t, g, unknown or other
aggttgattgtgcgctgcgtagccggcagggctcgagcgcatgctcaccacaaatgagacatcccccaaccccatgtggcaaggtacttctactacatgccctcggcgcccaaacgtccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcattgttgtgtttgtgggaggagagtggttgtctggggcagggaccatgggaggagagggtgttcccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcagaaggtgcaggcgatcgctcaacagtacctggatgccatgcggtcaagggtacc

SEQ ID NO: 33304 - DNA, 77 bp, Chlorella protothecoides
aaactaggatctgtgtgctgcacagcgctctcgcacagctgcctttttgatgggatgggtgcgccgtgttgctcatt

SEQ ID NO: 33305 - DNA, 779 bp, Chlorella protothecoides
  modified_base (125)..(389): a, c, t, g, unknown or other
  modified_base (495)..(705): a, c, t, g, unknown or other
tgaggctcaaacgactcatgtctgtgtcggaatacactgatttcacgtaaggtatgaatgtagagcgtcaggctgcgctccgggcgacgcagtagcatgcggcatatctggctgtgctcgaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgttatgtgtcgccatgccctgctcttaagtgttccccagagtctctcatgcactgctcctttggttttcctcagagtcgctcataccggctgcaccgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagtgaccttgcagagagataggctgcttctgacatgaaacctcctgagaccatcctcccccttcctctgac

SEQ ID NO: 33306 - DNA, 118 bp, Chlorella protothecoides
cgactacggtggcggccggggacggggcgcagtatcctgtgcgggtgaccgaggagggttgggttgcatggcagggagcacacccgtgtcgctgctgtaccctgttggtgagcgcgtc

SEQ ID NO: 33307 - DNA, 139 bp, Chlorella protothecoides
gtgggggtgaatcacgcctggtggaaagccccggtcatctcggcgcccacacgctggaccgagaggccccaattgtgacgcctatccccagcattatcatcgattcttctcataccccatcaaatcagcgagggatcgt

SEQ ID NO: 33308 - DNA, 77 bp, Chlorella protothecoides
ttgggtgtccatgtggctgcctgagggcatgtcttgctgtggttgtactagaaccagctcattctcggccagtgggt

SEQ ID NO: 33309 - DNA, 61 bp, Chlorella protothecoides
gctgctcgttctgcgggcctgcatcctcgccagatggcaaccccacgtcattgaggagagg

SEQ ID NO: 33310 - DNA, 179 bp, Chlorella protothecoides
tgatggcaaagtccagctcgttccgaatctggggagtcattgggatggaaggacggtatgttgtatctggctgccttgaatgactcgcatgcacagatatggcagtgacggagactgcaggcagcctgcgcagtacaggacctgtggcccctgtgcttcagacaacctgggactactgg

SEQ ID NO: 33311 - DNA, 136 bp, Chlorella protothecoides
tggcaggcatgctggcaggcaggcttctatcttttgaggcagatagggctcacgagctgtcatgctaacgtcccaggcgttgatgtatataattagtccacccccttctgctccgtgccccaggatgaccgcgaga

SEQ ID NO: 33312 - DNA, 76 bp, Chlorella protothecoides
tcatcctgcgcgtgtgttttggaaagggcgaatgggtgcgcgagaaggcgggggggggggggggggggggggggag

SEQ ID NO: 33313 - DNA, 7391 bp, Chlorella protothecoides
  modified_base (131)..(142): a, c, t, g, unknown or other
  modified_base (230)..(239): a, c, t, g, unknown or other
  modified_base (871)..(880): a, c, t, g, unknown or other
  modified_base (1541)..(1550): a, c, t, g, unknown or other
  modified_base (1950)..(1959): a, c, t, g, unknown or other
  modified_base (2373)..(2382): a, c, t, g, unknown or other
  modified_base (3288)..(3297): a, c, t, g, unknown or other
  modified_base (3604)..(3613): a, c, t, g, unknown or other
  modified_base (4532)..(4541): a, c, t, g, unknown or other
  modified_base (5027)..(5137): a, c, t, g, unknown or other
  modified_base (6581)..(6590): a, c, t, g, unknown or other
  modified_base (6939)..(6948): a, c, t, g, unknown or other
ggggggggggggggggggggggggagggaggataataggggaggagggggggagatggagggcaggagggggaaagggggaagatggagggtcaagagacgagctggcgtggcgagacgtgcacctcttgnnnnnnnnnnnntacccaatctcataccacgccgggcccgcacccacacctgcacaccatccatgcactgcagtggaccagctgacaaagttcaaccggnnnnnnnnnnaaagggggaagatggagggtcaagagatgagctggcgtggcgagacgtgcacctcttgtgctgcatacaccgtctccccggcctcaaccacacacacaagcttgctcttgttgatcgctacaccgtttgatgacaccactaccctgttcattgttcacacacccaaccccataccacgccgggcccgcacccacccctgcacaccatccatgcaccgcagtggaccagctgacaaagttcaaccggcgactggccgacctgtccccagggcccaacccccacctcatcgacggcatcgtgctcaccaagttcgataccatcgacgacaaggtcggggccgctctgtccatggtctacacctcgggcgctcccatcgtcttcgtgggctgcggccagacctatgtcgacctcaagcggctgcacgttaagagcatcgtggcagcgctgctcaagtgagggactgccgtgacgtgcgtgctggcttgcaaaggccgacagcctgacccgggtcgagtcgtgatggtgctattgcaccgatccatgtggtgtgcacgtatcaggggaagcgaggtgtgcagagtcaacgaggtggctgcatcgacgcaacaactcaacaacctgatattcttgannnnnnnnnnagaggtgtgcaaagtctacgaggtggctgcatcggcgcaacaactcaacaacctgatattcttgacggcaatgtatgaagaatgtcgcaagctcggtgtgggacaccccatgtgtagtaacgagtgtgtcgctggctgtaagccgcaatgacatgggcctgatgcacagggcaggagcatcccatcaatacgcaagcgcatcacagccttgcagagcgtctatctccatgtcgtcatcgtcctctctgctggagcctgaggtctcaagcccaacagggccacctcctgtctgttgcaatggggccgctgcaagtgctgcccctccttctgcgggcacaggctccacgtaaaacaaggcatccacaccttgggcagcctcgtcctgcatgtcgtcatgacccacctgaaagacgagggatgggagagagcacaccggggatataatcgtgctgcgtgtcatggagaggcagacggagctgaaggactcgttgcaaacaccaaccgacctgctgggtagctgtgttcatgcctgtattgcttccacaggcaatctggccccctgccaccggcacgagagccgccgagttcatcttgtggagatcgctcctccttaattcgagtgcatgtgatggggcgggtcattcgttgctacggctggggnnnnnnnnnntgtcccatgtgtacaggatgtccaaactacttaccgcggagcatgcccaaactgaaacagcggtggcctttggagaggttgtccactgatataatgtccaggacccgttatattgggagttaacatggttgtagcccaccacgccgcgaggacctcatcaattggcgttccggaaggtttcgggagctgcagctgccaggtgtgggtgactgggcagcacatggagatgatatctcaagacacatccacagcggacaaagatgcccagcgggctctatctctacgttcagcttccataaagtgggacagcacacatgcattgcgtctctgatgtgtctgttatattatcaaagcctcccttgtcattgcgacttgcacactgtggctttgtacccacgtnnnnnnnnnnctatatcatcaaagcctcccttgacattgtgacttgcacactgtggctttgtacccacgtgcgcacgagaaggacaaatctacattgaatgacaatgcattcagacaatgggtggcttctgctatctttttatttgaagagtatttggtattgtcacgagcaacagttactgtttaatgttgttaagcaggagagggcagctggcatgaagtcagggatcccagcccccgcacacaataggtgcatgatacactcccgcatactgcgaatcgtgttgcccctatccattctttgatcctgaatgagcttcacatctaccagcatgccactccatgtccggccaataagtttgcatcctggctcacctccatgccgtctggtatcgcggggatcagcatggcacccctgcagccnnnnnnnnnnaactgcgaatcgtgttacccctattcattctttgatcctgaatgagcttcacatttaccagcatgccactccatgtccggccaacaagtttgcatcctggcccaaccccatgccgtttgacaacgcggggatcagcatggcacccctgcagcccaccgtcaagaccggcagcagcaagaccttcaccggtacgtggtccaggaatggcgctgccgcgacgtgcagcattcgcggtgccacactccgtcaactttactctccggcttggccctccccccttgcaggtttgcttcggccggaagaagacgatcgaggagatcaacgcctctgaacccacgggcgttgatcctggcggcgacattggtcgcctggcacccaaggacgagcacggtagcgagaagagcaactccacaactgagaaggctggtgaggtgggggccctgcacggcatagtacacgagacacagttggcaagggttctttcccgtggccaagagagcagacctgcacgtgaaacccacaatggcaatgcccaaagtgcttcgatgccttggctactgtgggcgaaggtgacagctgagatcttgcacttgttgcccccctcccaccccatgcccaccctatttccccgccaggaccctcagccggtgtgcctcaccaggagggctacactgagcggacacagcgggctgtcgaggagaatgaggtggatgcccaggagcttggcttctccgccgcgcgctccgacgccaaattcacaaccgccgcgagtcccggcgaccaccacagcggcgcgaccgacggcgacaagcccgtgggaggggatggcgcacagattgcgggggatgtggagtgagctttgcgagggtgatgcacaagcgtgccctggcctgctcaatctgcctnnnnnnnnnnaggggatgtggagtgagctttgggagggcgatgcgcaagcgtgccctggcctgctcaatctgcctgccagtatactggcaatcgccggcatggcttgctcatctgcactctgtcgtcccccccatctggccactgctgacgctgagaagtcgccatttaagctgccatacatttgcacacggtgcgcatacatgtggaggactgcacgccttggtgaggcatcctgggatcctgaagtgctggaggttcattgcgttacaacgggacctaagcgtccggccggagattggagcatgctcaggctgtnnnnnnnnnnatgaggcatcctgggatcatgaagttctggaggttcgttgcgttacaacgggacttaagcgttcggccggagattggagcatgctcaggctgtcgcggcctgctccagcccggccgcaagatcgcgcagcggcggcagcgcgccctttcgctcaaacttggcttccaggcggggcggtggccgcgccggtcgtggcagcaagcgccccttcttcgcaaaccactcgggctgggtgagggccctgagtcccagcgcattgtagtacaccgtggtcacgctccctcccgccgcctcgatcgcctgcctcgcgatggccgaggcttggctcacctggggcatgggcgaggtagggggtcaaaggtttggttgacccatcacctcgaacatagtgtgcctcaaacattcatgcctacccatccactgggcatgagacgaccattcacacaaggctagagcctacatgtccgcacatttcatcattcccaccagtccctgcttgcctcgatgtggaccgggatgttccaggacttggccccgcgagccagcagcttcacgccatcctgcagctggtgccccacagcgttggaagcgcgcagctcccgcatcgtgatgacgcggctggcgtccaggcgcccctcctcgatccactggcgcagggtggtcaggttgagggggttgtatgtgcgcttgaaggggttgtggaagccgcgcttggggatgcgtaggcgctgaggcgtctgcccgccctcgaagccgggcttcacgccaccccctgtgggaacaagagggagggaaggctggagtccaatggtgcagatgtctggtcaagctgttgggttgcttgcggtcgcacattcatacgcacggcagtgatgttggggctcagagatttcagactttgtggttcgtcttcttggtnnnnnnnnnnggtccaatggtgcagatgcctggtcaagctgttggattgcttacgggcgcacattcatacgcgcggcagtgatgttggggctcagaaatttcagactttgtggttcgtcttcttggtgagcggtgccaacccgatagtgacaattgcacatgcagccctgcccccctggctgtccagaaaattgttgcctgattgctgcagcgctgcgcacctgaccgggagttttggcccttgtgccctttgccagatgtcttgcccaaaccagacccaatgccacgccccagtctcttgatctgcacgggtagcacaaggtgagcaagggtactccagatataataagcacttccaataattatcaacatcccctccgcgtaccgaatgcgttgcgcccgggttatcagctattgtgttcagagctacgtagccttcaggcacaggggtggagtaccaccgcatgctgcatgctccagcaggccacagggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgcgcaagctcaagagcgagcgaagccgtgccatggctcacaccccttcacagcgcggtcgcgggcatacaaagaccacgtcagtaatcgcggaagtagtaaagtggatgcttgggggaaccgtgcgttcggaatgaagctcatgtaccatgaccgtgctgcggctgctgcgcgtgaatttcctagcccggcaccctgctagcgtgtgaagccaggttcgcctttccgagagtgaggaaataaactcaattacaatataactgagttctgccgtccagggaggagtgaatctgtggacatctggcagatcccccaatcatggtagacttactggaccagatcagctgggggaccctcgaatgcctgaacgagaagccagaccatccgatcggcaatgccttgaaacaggtgcggaagatgcccacaagttctgtttttgaatgtgccgggagatgcattgcccgggaaagctcctgccggtcctgaacagtgtcaccccacttcacctgtgcagggctttagggaggatgggggactgtacctggagagcgacaccgacgagcagctactcatccacattcccttctccagcgctgtgaaaatcaacagcgtcatcatccagtctaagaataaaccggagcaggtagggggtggggctgccacgatagcagtggggtcacttgcgggccagtctgtaggaatgcaccttgcacgtcctcttcatctagagtgtggctggcaccacctcatcgtcattcctggtgactcacaggaacactgcatacatcaccccatccctgtgcatgtgcaactttccattccaggcaccacgctctgtcaagctctttgtcaaccggccgacgataggattctctgaggccgcagacacggctggccaggcagactttgagctcacccctgcccaagccgctggagaacccatccccctcaagtgcgtatgcatcccgggagatggcaagcaccgcagacgcgtgtgaattgtctgctcatgccgggccctccttcccagcgccaacacctacccccgcacatcctgaccgccgattcctgtgcttgcgcaggcttgtgaagttccaacgtgtgtcggtcttgaccatctttgtggcggacaacgtcggcgacacggagagtaccgtcatcgagaagcttgccatcctaggcagcgcaggtgacagcttcaacgtcgcagaaatcaaggacgtctccaaggagcaggggtgacgaagaggctgacggttgcagcgcctgaaccacggtggcctgatgtgaaagagcccagctctgtggctcggtgcctgtctcacagcaggctgttgggccactggattaccctccagtgtccaccgccacccgcacaccttggcaagctccctcgtctcccttgccatggtaagcatgtaacacacacaacaggtgcacnnnnnnnnnntcacccgcgcaccttggcaagctccctcgtctcccatggcatagtaagcatgtaacacacacaacaggtgcactgcaggccatcagcatcatgcagtattgactggaaggggggagcagagtcgggcttcggggtgatctcttggtgaaggactcctccaactacgaaaacttgaactatggagatctcggggcgagccgagtacaagctaagatcggcggtccactcactcagtcggtggaggttgggggcctggtgtggggatggggtgtgtgtgagcgcatgcctgggccacgcatgcagggctctgcttttggaaggtttcacctgagatgttgcaaggcagcannnnnnnnnnttgtgtgagcgcatgcctgggccacacatgcggggcgctgcttttgggaggtttcacctgagatgttgcaaggcagcatgtgcagcgtgtcaccctgccacccccgctcaacagcctgagcatgccgcagcgctttcccagcccccggctcaccctgcagctgggccagaacttggcgcaggagactctgcacggtggggttgtcggtccggccctggaaggaggtgcccatgtcggccagcagccgctggatgcccgccaaggcctctgccggcacgccctccatcccgggggctgcgggttcggccgcggcaccgactgccgcggcagcgggagcggggggtgcgggggcggcacgcagctcgccctcctccccctcgtcctgggcgggcggcgcggcggtgtcccgagcccctgccgggggcggcggcggcggcggcgga

SEQ ID NO: 33314 - DNA, 112 bp, Chlorella protothecoides
ctcatgctcatgcagcagctccttgacagcgtagatgaaggccaggacggggcccttgttgtcgctcacgccccgaccatacaggtggccatcgatggaggagagctcaaag

SEQ ID NO: 33315 - DNA, 7547 bp, Chlorella protothecoides
  modified_base (1382)..(1453): a, c, t, g, unknown or other
  modified_base (2745)..(2754): a, c, t, g, unknown or other
  modified_base (3593)..(3602): a, c, t, g, unknown or other
  modified_base (4157)..(4166): a, c, t, g, unknown or other
  modified_base (4407)..(4416): a, c, t, g, unknown or other
  modified_base (5051)..(5060): a, c, t, g, unknown or other
acagcggccgccgcgccgacggcgcgcgcctcgcgctggtgatcgagggtgggggcatgcgcggctgcgtctccggcggcgcgctccaggcgctcaacgagctgggcctggccccgctcttcgacgtggtctacggctccagcgccggcgccatcaacgccacctacttcctctccggccagcgcgacggcgtgaccatctaccacgaccacatcgcgcacgaggggtttgtctcgctcaagcgcctctggcgcggccaggccgccgcgcccgtgctcaacctgccctacctcatcgaccacgttatggagggcgtgctgccgctggactgggacgcggtgctggcctcgcgcctgcccctcaaggtcgtggcctccagcctggacagcctgaagcccatcgtcctggacggcttcgattccaaggaggacctgaagacctgcctcaaggccagcgccaacatcccggagatcgcgggcgggcccatcacccacaggtggggtgggtgggtgggcgtttcagtcgttctttggggggcggagggagcatgaacgacacggacgcatgtatgccgagcccgcctgggcggacccggctggttcctgctggagcacatctcggctcgcacgcaccctggttctcctccaaccccccacctcaccccaccccatgcacacaggggccaccgcctggtggacgcggcggtgttcgaggccattcccttccgcagcgccatcgccgacggctgcacgcacgcgctggtgctgtgcacgcgccccagaccccggccgcgcgccggacccatggacggcgcgctggagggcgcgctggaggcggcggtcaagcgcgccgtgctctccccggactacatggtccccgcctggaaggccgagtacgcggccatcctggccgacggctgcaccgccgacgagcagctggcgggagcgctggacggcgacgacgcggccggggggccaccggccggtagaccctggttcgcgggcgcgcacgtctaccccgtctacccgggccccgccgccgccttctccccgctctgcaccgacgccgacacgctgcgcgccggtgtggccgaggggcgtgccgccgtgctgcgcacgctggcgccgctgctgggcgacgcgctgggcctgtgcggcgagggggacgacgccgcggccctcctggccaacaacatcgcggcggggggcgtgcgggggctggacgccctcgcgaccctgtgaccatcgtgcgaacggaggagaggacagtgcccctcgccatctggagacgagaggaggtgcactcgtctctggtggacaggggggctgctgcggccaggtgaccgccggagctgagagcgctccatggcagttacccccccnnnnnnnnnnnnnnnnnnnnnnnnnnnnnnnnnnnnnnnnnnnnnnnnnnnnnnnnnnnnnnnnnnnnnnnntgtcctccccacaacccccccttgccaccaccagctcacccatcaccaataagttgcacgctctgcaaccctgacgccctacacctccttggacatgacagacacacctgcactcagtgtgattccatcccctcccccccatgcaaatacccgtcctgccccaaccctaccccggggcaagggcgccgtgcctcgaccccctttttgagacgagcgtgcattgtacaaggtgtaaggatcattgcatccagagggtgtgagagaccgaggaggggggtgtgtgtgcaaaaaagtgccggcaaagtgaggttgtgcggtttggcgtgcggagcggtgccgggtgggaccatgagtagacagcagcagcaaaatgacatgcgtattcaacaatgggcagcgcatcactccagccttctcgtggggctccctggctggcaagtatgcactgcaggctgctatttgtgggattcctaaaaccctgaggcccagctcatgttcccggccgcggggggaagtctattcgctggattatttggaggaagacccaggtccacgccggcaacgtgagcaccgccgcaatgtagcaccagaagaggagcttgctcacctcggcctcgccatgcttgtacagcaccgtcatcgtctgccatggcgccaggaaggggcgcagtgagggggccagggtagtgcggggggggggcatccacaaacttcactgggatgagtactcgttgtcttgctctctgctcgccccggacaatcgccaggggccccagacgcggggattgcagaaccccccacccctccacgtgcctcagcaaccgacgcagccatgctcaggcgcccccccccacacacatccctgccccaaccgctccctaaacaaacagggacatgcgtcagatgcccgggcacctggatgttgatggcggtcgggctgcagtttggcaggaggaggcacagcacaaacagggggtccacgggctggatgagcttgagtttgagggccagcatgatgaggcccgtcatgatcgccgggcagaacacaagccggctggcgatggtggctgcgactgacgccgtagacagcgtgttgctggcgctgcgtgagctcctgcagcgtggacggttgggcgggctgggtttggtgattggcgtgtggacgcatccacacgtgcgtgcggaatccaggtgagcggggtctgtttgcggttggcgatcagggcatgatcatgactcgcaaggatcctgcagcctttcgacagccaggctctgcagcaggcgggagcagnnnnnnnnnnatggtgattggcgcgtggacgcatccacacgtgtgtgcggaatccaggtgagcggggtctgttggcggttggcgatcagggcatgaccacgacccgcaaggatcctgcagcctctccacagccaggctctgcagcaggcgggagcaggggccaggcgctctggcgaggtccagtgaccactcgagtccccctcgccaccccagggcatcacctgtacagcaccgcccccaggaggacgatggtgcaggggatgagcccgttgcccagggtctctatcgtgtcccccaggaaggtgaggggcgcatcgtggccatacagggcgttccgcgcgggcgcgatgcagcccacgaccacgccggccagcgccgcctgcgtgggcagcgggaagaaggaggcccagggcacggccgccagccgccgcgcgctgtgtctgagccgcccgcgaaaggaattcgcagcgcgctgccccgcgcctggctcgtggcgctcgggtaccggcgcggccgcgcccggcagcagtcgcgccccctcgcccgcgccctcccgccctgcggcgaggccggcggccgagtccatgcgcggcgaggacatgagcggaagctccacgctgagcagggagccgctgcggagatccagcgtggcgtccgagtcctcgcgccgcgcaagctcccagatcggctgagggtgctcggcggccagcatgtgcccctcctcctccgaccccgcgccgcgctttcctggtgcctgctgacactggtgcgacgcggggtcgtcggcggcggcgccgcgggttggggccccggcgcctgctgcagcgtccgaccctggccccagcctgnnnnnnnnnncgcctgctgacactggcgcggcgcggggtcggcggcggcggcgccgcgggctggggccccggcgcccgctgcagcgtccgaccctggccccagcctgaagtcgcccgcccggccgcccaccacctccaccgccagctccggctcgggcttaagcagctggatggccacggtgaactgcagcaccgtggcacccaggatggcaaaggcggtgtaggacatgcccaggacctcgcagggcgcgcccaggcggcggaagaagatggtgtgcgggtcgtggcacagcgctgccacgaagaccaggggcaggttgcccacgttgccaaaggccacgcagcacatggcgtgtggggtgtaggcacggggcatgccggtgaggcgggccgccgcccagcccagggccaggcccacagggagactgagagggagggtgggtgagggtcagggtggagtgagggagccggctcagataaacacactctacagtgagggtgggtttacatgcacgagtgctgggttgcacgcgctcaaaggctgactcgtgactggcagtcatannnnnnnnnnggggagactgaaaggaagggtgggtgagggtgagggtggagtgtgggagccggctcagataaacacactcgacagtgggggtgggttcacatgcacaagtgctgggttgcacatgttcaaaggctgactcgtgactggcagtcatattggtgccagcccaacccccatccacaaacccagtgcccccacacgccagctcacctgaccacaatgttggctacgaggggccagaggtagagcnnnnnnnnnncagcccccacacgcccgctcacctgaccacgatgttggctacgaggggccagaggtagagcaccgagtccagggtcacggactgtgccagcttgccgaaggtcaggcaggggatgaagatgaagaggcaggcccgggctagggcggtgcagctggaggcgtcaaacagcttctgtgttttggcaatgggagggcgggggaagggaactggggcatggcgacatggcatgcaggcaaccattacaggggggtggtgccggggcatgggcgcaccttgtgcaccatgaggccgccaatgcccccgatgaggcacatctctacgacgggcagcgccgaggacactaggagctggccggcggaaccgccggatggctccatcctgcaacaccaatggtcttcaccagttgggcgtcccacactcgccctgcgccgggctgtgcttcggcgtcttgaacccgtggaccagcaaaagtctccgcgcgctggaccggagcgccgttgaagaaagggagggagcttgcgcgcctgcattcaagcgggacccgacagtcgaagtgagatgggtctcccgggaaatcatgcattaatgcagcgatctttatcggatcaggaccaaagtatctggatgctgcattnnnnnnnnnnatgagatgggtctcctgggaattcatgcactaatgcagcgatctctatcgtatcaggaccaaagtatctggatgctgcattgcgcaccgtgaaggagtccccgcagcagctcgatggagtgggagacggagggtgacggggaggacctgggcgggcagggggtggatcgggccttcaccctgctccatcctgcaccgcccagccccaagaaggccaagggcgggaagccaggcgtccatgctctagacccacacgcgcatgtcgcccgggacctgctgctggcaggcttcccaccatgcttcaagggagaggaggtgcagcagcggctgcggagagcagccgcctccgaggcctgtgtgtcccgcctgaagacctccataagcgtgagtcgtgggtcagagacccacttgaaggcgcatgaggtgccgcattcgctgtgaagatcagcggcttgatcttgctctgacgggacacactcgtggaggcgctcctgctcaccacgccgatcgcattcatccaccacctgccgccaggaggcggtggctgccaccgacgcggcggtgttcacagacctcctggattttgtgcgaagctcccatgcatccagccggggcctgctggcctcgcaggggcgctggggcggggcggggaagcgcgctctgcccgccggcctcgtgctggcgggaggggtgaacgcctccgaccacgcccagacgttcccggccctggcctctcacctcaggaaccaggtggagttgggcctgaggaggttggcgcttgatgagcagtcgggtgtcaggtgggctcgctgtggagcctccgtccctgctgcgcaggccgcagaaaggcagggcgcatgcccgtcggccacggagccttgtcgtgccaggcagaccgccgtccaccgccgccctcgcaggggtgctacgtgagcctgctgcaccccaactcgctggggaagacgccgagcgcggccctgcagcaggtcatcaaggactttgcgggactggacagccccggggccgacacacaggttgggtccccggagggtctcctgcatgtgatcccgaagacaaccccgctgcgaggccctggcgggtgcccgccgagtcagccttcccccagcaagcccaccccctcaccccaaaccgcctcgctgcccaggcgctggccgcatggtaccaggacgagacggggggaggtgtgctggggagcatggactgcgaggcgcctgcgccggccgctgctccgcgtgccgccaggtccagtcagcgtggcggcggcgggggccggagcgcggcgcaggaggtcgcgctgcaggcccccctggtcctcgtcgtggagggcacggacatggcggaccccggcgccttcagggacctcatccttgcgctgagcgaggtgggccatgcggtgttggtggtggggcgcaccgggctttggccgtgggtgtgtggctgtgctggggttgctcaaggcacttatccggatgcagggttggccgcgccatacacaccgcttgctgctggggtgctgcagcaagtttgcgcctcttgcgctgccaacatcatcgaccctgcaggctgtgagaggacacactgccccccccatcccctgacccatgcccacaccacaagcccactcgtgcccccctgacagggctgctgggaggtccccctgaccctggtgctgggtctcaccacctccgccgccgccctgcacgccgtgctctcctccgacgttttggagcggtgcctggcgtgctccttcttcaatctggtgtgtgcatggggtgccgtggctggggcccttgaacaacgaagtgcatgtcggtggtttcggaggtggagccctcctcaaccccatcgcagcccgatgccgaaccagcaggatgtcctgcagcagagccccgccccaaggctccattctggtaatctgtcctgcccccagcccaccctgcgacacgtgccctcccacaaaccacccctcctcctctcccccccccaacccaaacccaaacaggcctctgcgatggaccgactgaaccgcctggtgagcgatgcactgctgggcggcaatggccgctggccggggctgctcttctcccacgccgtagttgcgcgcgcctgggacgcctgcctgctgcaccacttcagcacgggcgtgatcggccaggccctgcgcctcgccgctctgtcccacttccaggcggcggcggcggggcggggcctcgccggggtggccgggctgctggactgggtgcccggccagagggatgggcctggggtccctgccggcacggccgaggtcgtcaggtgctgggcgcgctgggcggtgggcctgcactgggcggcgctcgccgcgcgggccctgggccagaccagggcgtgcccgtactggcggctgtaccgcgacgcgctcgaccccggatgggcccgcgccgcggcggggcaggccacgctgcgcgcgctggaggcggggctggcg

SEQ ID NO: 33316 - DNA, 120 bp, Chlorella protothecoides
tgcttgcctgtttgtcagcgagtgtacagcaacttgatgacaaatcaggggcgcgagtgagatgatgtgcatggattgcagacgccagatgggtcgatgccgccagaggggtcctgtctc

SEQ ID NO: 33317 - DNA, 108 bp, Chlorella protothecoides
tcacacctgctgtctcgtggacggacgcggtggtggtcgatgcccgcccgacctgcagctgcgctgtgatcagattacgccctcgaggcggactgcgcgatcggcccc

SEQ ID NO: 33318 - DNA, 222 bp, Chlorella protothecoides
ccgcccccgccgcccaggcgcccagcccactgtccacaccacctgcagctgctcctcggagtcgagggggtcgtccgtcagcccgtcttgcacgacagtcctcaccgactccagcctgcacgagcaaggacagggggccaggaggtggtacgaatgggtgtgtgtgtgagaatggatacaagcgcagctacttgtgagacaccaaaccaggacgcttggcga

SEQ ID NO: 33319 - DNA, 426 bp, Chlorella protothecoides
ctgcaggaaggcggggtcggcggggcagggagcgcccgccgtcggcgccggcccgcctgcagctggcgcggccgccggaccactcgcggcctgtgcgagggagagcaagtgatgggtgtggcggggcgcactcggatcggcaccctcacgagccagtcatgggatggcgtgccgagtcagagtgcccccatcacaggcgacacccattaaggtccccccagcctcccttcgacggctcccgggtccgcgcactccctccccacaccttggcgggagaagaagggatcgctccgcgcgcccgcctgacggccccgtgcgcccaggtctggaccttgtctacgaccgtgcagaccgcgatgcgtgcccgtgccagggcggcggcgagctcggccttgacgcgcgcaacaccccgcgacagggagtcgg

SEQ ID NO: 33320 - DNA, 61 bp, Chlorella protothecoides
gggagccgcgcccctgtgccgctcgccagcacccgcctccagtccgacatgaggctccatg

SEQ ID NO: 33321 - DNA, 129 bp, Chlorella protothecoides
gaacgcgcgttgcattggacagcaggacgacgcaacacagcggcatcgatacccattctgttttttaaggtcgtggccgaggagcattgcgcctgctcaactacgtgtggcacattcgtggaaggacat

SEQ ID NO: 33322 - DNA, 61 bp, Chlorella protothecoides
gggtggggtccggtgcattgggtgggggggtgcattgcaccgagtctccctcaggcccgac

SEQ ID NO: 33323 - DNA, 200 bp, Chlorella protothecoides
cagcgagcgactgcttgaacaggtgcacaatctgtgacctccagtgcggctgttggaaagagattgcgctctgaaggtggggtcctctgcgcactgaacacagagctgcggcatcatcgattacccctggttcccaggaagaagagacagccacaaggaggccaaacccgacattttttgcccttcatcaggcctcctat

SEQ ID NO: 33324 - DNA, 80 bp, Chlorella protothecoides
ccagggcggagaaggaaagcggggcgctgtcgggtcgagggggagtggatcgtgtggagctttggggaaggcggggaggg

SEQ ID NO: 33325 - DNA, 124 bp, Chlorella protothecoides
agcgcctcgggatgacctccagatgcccactgcacccatgatttccatcggcaaaggggcacaccacaaccagcgaaacccagtcgccagtcaccacaccgtgccaggcttcctccggtgagac

SEQ ID NO: 33326 - DNA, 124 bp, Chlorella protothecoides
ggcccatggtgcagctgtagccaacctgcacaggggcaaacatgggattaccaatcggggccgctcgcgaggagtcgaacttcgaactttccgtggcgccacctacagctcgccccgcacctcc

SEQ ID NO: 33327 - DNA, 79 bp, Chlorella protothecoides
gccgcggcctggcgacgagcctgtggggggggagatgaaagggttttaaattcacaaaagggacctgtaaggtcacacc

SEQ ID NO: 33328 - DNA, 93 bp, Chlorella protothecoides
agaaggggaggggcctgccagccccaggggtgatgcgtgtgtggagccatgtggaggcccccgttcccgcggggagagcgacgtttcaatctc

SEQ ID NO: 33329 - DNA, 61 bp, Chlorella protothecoides
caccgttgcggacccgcacgtactggtgggggtgcagggtggcgtgacaggcgcaacacag

SEQ ID NO: 33330 - DNA, 77 bp, Chlorella protothecoides
tgctctgctctgaactgccccgtttcctccctccttcaaaaccctcgtgcagagaggggatgtgtcgtcggtgcggg

SEQ ID NO: 33331 - DNA, 61 bp, Chlorella protothecoides
cagtccctcaccaagccccgggccatccccctcgccagctgaattaccagctccaagtggg

SEQ ID NO: 33332 - DNA, 145 bp, Chlorella protothecoides
gagcgtgatatctcgtcattacaaatccgggattatgcgggggtgctgttgttgaaaagtccctccggagagatgttgttgttttggtcggaagcagtgcaaacgacactcctgatatctacaagggtcctatagtcgattggca

SEQ ID NO: 33333 - DNA, 77 bp, Chlorella protothecoides
cctgggcatgcaaatcgggtcctggtccacctcgggcacccaccagcgtatgtcttcatgcatggcagcgccggtcc

SEQ ID NO: 33334 - DNA, 202 bp, Chlorella protothecoides
cgggctgccctggacgccgcctgggagtgagggacctgcccctggaaagatggcaaaggggggttgctgtgccacgacctgcctggtgctgcgtgatcaccgctgctgaccgcgcggaagtcaggcagcctgttgacagcgcggacatggagacagagtcggagtgatacggggacaggcatgaggcaaacggctcagcagc

SEQ ID NO: 33335 - DNA, 135 bp, Chlorella protothecoides
gctggcagctcccgctgccgtctctgcgtgtcccatcgtggacttgagggcctggagggtggctggtgctgagtctgtgggaggatggtggacgaggtgagcgtagctgatgtttcttgatgcgtggaccactgc

SEQ ID NO: 33336 - DNA, 61 bp, Chlorella protothecoides
aaaaggccaacacgagtctcatcccccctcttcatgcacgtgcagagagcggcgtcacgcg

SEQ ID NO: 33337 - DNA, 61 bp, Chlorella protothecoides
actggcgaagccagagtgccatgcttgcgttgcagattctgctgtcctgggcaccccggcc

SEQ ID NO: 33338 - DNA, 81 bp, Chlorella protothecoides
caaagcaaggcacccaattcataccctcaaggaaaccccctctcagcgtgttctgctcccaacgcacaagcctgtggcaat

SEQ ID NO: 33339 - DNA, 77 bp, Chlorella protothecoides
gggtgcaggacaggggctgatggatgacttcgcaattggtcaccagtgttgcctcagggaggagtcggtcgtgcgtg

SEQ ID NO: 33340 - DNA, 64 bp, Chlorella protothecoides
ggggggggggggggggggggggggggtatgtctctggaacaggggcttctgcaacttctagtgc

SEQ ID NO: 33341 - DNA, 70 bp, Chlorella protothecoides
accccaggccctggacctggccaggccgccccacctcttcggctggtccatggggggcatgatcaccctg

SEQ ID NO: 33342 - DNA, 682 bp, Chlorella protothecoides
acccgggcctcatccccatcgcgcgtgaggccttcgacgcgcacatgccggggcccaaccagctgcacgtggcccgccaggacgtggtggccgaccccgccgccctcctggccgtgccctcggggccccgcacgctggccacgctgcgcaacaacgtcgaggtcagcattcgctacctggccgcctggctgggcggcaacggctgcgtccccatccacgacctgatggaggacgccgcgaccgcggagatcagccgcgcccaggtctggcagtggctgcggtggggggccacgctggagaacggcgcgccgctgaccgccgccgacgtgcgcgaggcggtggacgaggagtttgccgcgctggaggcgcggctggggcgccacgccgtggccgcgggggagtacctggacgccgccttcctcaccaagatgatgacctgcggtcgcgagctgcacgacttcctgaccctgccggcccaggacatcctgctggccatgggcaactagagcggtggagccgtggagcgagggagtcgccgtggagctggatggagggggtgccttcctttgggcagctgcagcccctgccatggcaagggttggacaggaggacgacgctgcgggaggatggggtcccagcattgtagctgtcggcaccatcgacacagttggcagcccccccc

SEQ ID NO: 33343 - DNA, 92 bp, Chlorella protothecoides
cttgcatgcaatcctattcctgctctcatgaatgccatgcatcccaccctgggcgggtgaaagtaattttcagttcggaatcggcgcatgcc

SEQ ID NO: 33344 - DNA, 61 bp, Chlorella protothecoides
acggcccaccgggacaggcgcagacactgggaagtggcgtcactgtggcccgaatgcccaa

SEQ ID NO: 33345 - DNA, 67 bp, Chlorella protothecoides
gccatcctctcagaggctaggcccttttccagcaaaactccgatcacgatccacaatctccgatcat

SEQ ID NO: 33346 - DNA, 73 bp, Chlorella protothecoides
cgcgcaaagggcgacggggggttggcggcgccgacgccgggcggggctgtggacgccctggctcctctgtcta

SEQ ID NO: 33347 - DNA, 61 bp, Chlorella protothecoides
tgctctatcccataagtggacattggatggtgatctcgggggagcgcgccctcgtgatctg

SEQ ID NO: 33348 - DNA, 78 bp, Chlorella protothecoides
caggtggacagaggggctctggggggtgaagggcatggtccagagggggggaggggaggggtgcgggccagccggcgg

SEQ ID NO: 33349 - DNA, 61 bp, Chlorella protothecoides
ctttgccctcaacctcgccgtcttcctgctcatcggcaagacctccgcgctgaccatgaac

SEQ ID NO: 33350 - DNA, 69 bp, Chlorella protothecoides
tagattacattctgatgaaggtattgctgtgtagagaaacacgacccctcattatgtcgagccggcagt

SEQ ID NO: 33351 - DNA, 61 bp, Chlorella protothecoides
aaggggaacggcatgtgtatgtgtgggggggtattgaaggggaacggcatgtgtatgtgtg

SEQ ID NO: 33352 - DNA, 99 bp, Chlorella protothecoides
gtgtcacccgctgcgaccgccgtgccgcctgctccgaccgccgtgtcgccggttgctccaggtgtcgtgtccgttgccaaggctgatccgacgcccgcc

SEQ ID NO: 33353 - DNA, 153 bp, Chlorella protothecoides
ttttagccctggaggatccaaaggcaagtgagagctttccctcgctgtgcgcttgagacgatcaccaccagaggtggaatctgtgcttatccaacggcgcaaatgacagtgctcagtgctgggagtcccctgctcatgctgaagggttttact

SEQ ID NO: 33354 - DNA, 5341 bp, Chlorella protothecoides
  modified_base (421)..(430): a, c, t, g, unknown or other
  modified_base (1769)..(1778): a, c, t, g, unknown or other
  modified_base (4492)..(4501): a, c, t, g, unknown or other
  modified_base (4719)..(4728): a, c, t, g, unknown or other
  modified_base (4917)..(4926): a, c, t, g, unknown or other
cggcgcgacgacggcccccgcgcccgccgcttcctggagcatccccgggcgccccatccggcgcctgcgccgctgggtacgtggccggggccggggcgcaagccaggccgccgcggcgaccgacacgctgcgctgcgccgtgcgagtcagcgccgagctggaggtccctgcgccgctgcaggcggtgccggaccgcctgctggcgctggccgggcggctggccatccaggccgtcctccaggccctgctcccaaacttcctggcgctcatggagcgcgactacgccagctggcgggcagcggcggaggggggcggcgcgccgcgccgcacccaggacgccgtcggcgcgctgttctgagcgctgtatcggggtggcacatggggagccgcgaggctggtgctgccctgctgggggcatgtnnnnnnnnnngggcgcgccgcgccgcacccaggacgccatcggcgcgctgttctgagcgctgtatcagggtgccacatggggagccgtgaggctggtgctgccctgctgggggcatgtgattgccactcgcacggtccccctcctgtgcaggcagggcaggctgttcttggatccctttcattctacgcaggccttgcatgcatgcgctcctgcactcgatcccgcactgcaggcagctcccaacttgtccaattttgatcatagccccatgtgcagcccgccctttccttgcccggctcagcgttcctttggggttccctcaggaagcccctttttccttccatcgcccttgtctgggtggttgccacccctccttgaccctatgtcaccttgcccgtgtcctgtgtaacatttaccccctttcccccctgggaaggccccacagcctgtgtcagcagtggggctcaagggatgcgacgggtcaactggcgtcgaagggagtgccctcattgtgaggcatggtgccccggagccttgggtggtgcaccatcgatcctcacgacccttcaccgcgcatcgcagtcatcctgctgtgctgcaccacgcgcctccctccgtttgccctcgcgaccgccgcgtccggtcggccggcaaccgtgcccgccgccgcgccgcgtaggcccgcccgccggcgccggcgctgggtgctccaccgccacgacgcgcccccctttcctccgataccggatgccggcccaggtgacgtgggaggtgcagaaggtgagcgccatgcacaccggcacggccgcattgttgagcagcacgcccgcggccacgtggccccaggagaagaccggaaacagccccccaggggccaggcgcgggttgagcgcctcgcacagcgacagggtccgagccgtcatggcccccaggcctagcccggcatacgcccaggaaaccgccagcgccagcgcggccagcgtgggcagcacgggggcggcgatcggtaatggggtgccggtcgcgaggcgctgcacgcccagcgcaccaaagcaggccgcacgcgcggccaacagcgccgccggcgccaccagggcccaagaccagtagcagtgggcggcagccagcgcggcattggtgtggcgattggcgggcgaggcataggtgtccaggacgaccagctggcgacggaggtagtaccaccacgcgccggcgccgccgcagcgggtgggcatgcgctgcgggaagacggcgtagggcgggcagatgatgcccagcccacgctcgccgcagagtgaagcggtgatgaggtcatcagagtagccgccatcccgccaggcctgcaaannnnnnnnnncgcccagcccgcgctcgttgcagagtgaagcggtgatgaggtcgtcggagtagccgccatcccgccaggcctgcaaagatgtggggagtggtggccgtgggagactggggtggagggaggagaaatgcggctggtggaggctgccgccggtggaggggtggtcgggaacgtgagggagttgcaggctgactaggaaggcaagggggcgtgtacatggagccggggtccaggaggcaacctccagcacccatgtctagcctctcttacaatctacctcagggcctcatcccagcacgccttcttccttctcatatcccgcctcacctccaggaggccggctgaatcggagcgcaaggccggcgacctgaagagcatgcagccgccccagacgaagctggtcttccgggacagggagaagccgatgacgagggggaggtggtaggacagcacggcgtaggagaggagggaggggtgggcgggtgggatgtcaaaggggtaccctgtcgccatgtaggccccgggctcggaggcaaggtcgcggaccagccaggtcagcaggcggggggggagctgcacgtcgtcatccaggcagagcgtgtagtcactggtccccatgcccgcctcgatcccggccagcagactgcgtgaagtggacggcgtggtatggggtggaggggcacgtcgaggggcgagaagggccgtttgcccaggcgaggtggagtgtttgagccactggaggcgatgaggtaggaattctggtgtcagctgctgtgcggggagggggttggtccctcacaaacatccagccccatgccctgcacgccagctagcactaggacgcacttgtggatcttctggctggtcttctgcgcctgaccggagaagaggatgcgtgcagcgcggcctgtcgccttcttgtgggcagcgatgagagagtgcaggaggggcacggcggggtcttcctcgctgtcggtgacaaagaagcactcgtactctccctctgcttgcatgtgaggcgagggagggatgttcattatgagctggacaccgccaaacaccttgtcaaactcgttccctggatgcgtctgggagcaagcagagtgcctcaacccaccatactcctggctgaggatggactcgagattcagcgagctgtgttcccgacatcctcgaatgggagtgacgatggccaccgatggccatgtcttggggagatcctgcaacaagcggtgagaggggctgactggcggttgcgacgacgcctgacattacgggcgtcaacattcctgctccacctggatcaccgctgtaattggtgtcccactccgcaaatgcctgcgcagctcctggtatcggcgcagtgcagacagcagccagagacttccgaggataatgcaagggatacatccgtgccacaagatccagctggtcgccggcgagttcaggcgtgcatgcgtcgcctgcagaccggcagccagagcagaggtccaatcctcgcccgacatccacaccctctgcgaagcaggaagtgctcagcatgtagccatcatgggtgtatggggttcaatgggagtatcagggaactgatcgaagaggtattcgaacacgagctccgactcagtcttcgcgcccagcccacagggtgatggggcaagaggaaaatccccatgaacctcacctgtacaacaagacatttcggagataagtggaatctatacacttattttatgagacttctgattttgcaatgacatggttggcacacgctcactgttggctgaaggcattattcagtgacaagacaatgacaatgcatttgcttccatagaaggatggccagcaaaagcaaccagcgtttggcgcagcaggtggatgtctcagtgatatgtttgtgaatgggcacaacatcaaatgacgcctgcgttctgatgaaggcttgttggctaagccgagaagaggcaggggctcctgaattgtttccagacccaaattaatactttttctataaaaaccaaaaagagtgtgtcacttctggtaatgccctattcccgatgttgacctggcatctttcctaatcaggggatggtttcggacatctacccccgacatgaatatgagcacgactcgcgtagacgcggaaatcgagccatagtcctccgcagcgacctccagacatatcgaccgcgttcttttgcatagtaaaagtttgggaccgcctccatctcgagccttgtccgtaacggtctctggttgggtttgtttccgttgccagggtcggtgacggtatgtgacgggagcagttctcgaagacacccgcgcccagccctgcataccgaagcgcgcgctcggctttggccgcttccaataccctattgctacgaggaggccgatggcgggaccaatgtgggcccccttgcggcggggttgcgtcagctaaactccgcataccaccctggagggagagagggtttcgtgggcggccatcacggtgctcgctccttcctgagcagcctcggccaggtcaaggcgcgaggctcccaaacagatggggcaggccctgggcagggaagtccctgtggcggacctggacgccctccacgtcgccatcgctgagggccactgtgtgaccgtgcgccaggtgtgtgagtttgttgtgtgggaggcagggatatcgtagtggtttcctgtggtgggactggccacctgtgcacatnnnnnnnnnncgtgtttgttgtgtgggaggcagggatgtcgtagtggttccctgtggtgggactggccacctgtgcacatgtaactgtgttgcccctgccccaggtctggtgcagctgttcttgtacaggattgcaccaccccacccagccccgccgaggagcatgccgtcacgcgacgcctcggcttccctccccttttcccctggccatcaccttcgccgcccagnnnnnnnnnntgccccgccgagaagcatgccgtcacgcaacgcctcggcttccctccccctttcccctggccatcaccttcgccgcccaggccctcattggtaacttcccattgcccggacccctttccccttcacaaagtccccccccccctccaaaaaacaaaaacacgcaactctcacacactccacccccagatnnnnnnnnnncgcccggacccctttcccctgcacaaagtcctcccccccaaccaaaacgcaactctcacacactccacccccagatcctggggtccagccccagcccggcccgcctggtcaccgcgcgccaccccgactccggcggaacggccctgcacgtctcctgccgcgcctgctgcctgcgctgcctggacgcctgcctgtccccgctcctggcggcctcgctgcggcagccgtcgctgctgtcgcgagcgctggacgcgcccagcagccgcaccggcaccaccgcgctgatgacggcctgcgggcgcgggttcgaccccggcgcggtcctgctcatcgcggcgggggccgacgccgcactgtccgaccgtgtgtcgggcgtgacggccctgcactgcgcggccgccgccggcgcggccac

SEQ ID NO: 33355 - DNA, 2393 bp, Chlorella protothecoides
  modified_base (265)..(274): a, c, t, g, unknown or other
  modified_base (923)..(932): a, c, t, g, unknown or other
gaccccccccctgcccccccttcccgcccctccgacgcaccgctccccccctgcatcaccgcgctgctggacccggcctgcgatcccgccctgcccccgcccgggtcgctggcgctgacccctgcccacaaccgcgagctggacaagctggtggcgcagctggggcggggccgggccacctggcgccgcgcgctggcgttgctggactggctgcgggcaggcgggcatgccccggacgaccgcctgtgcaccacgctcatccgcnnnnnnnnnnactggcgctgctggactggctgcgggcgggcgggcatgcgccagacgaccgcctgtgcaccacgctcatccgcgtggccgcgcagcacggcgaggcgggcgaggcgctggccatctacgactggatgcggcggccacggcgcgagggcggcgccggcctggccgccacggtgtacacctacaccgccgcggcgcgcgccgcgctggccggcggcatgctgcaccgcgctctggcggtgtgggacgacgcggcggccgacccggggtgtgcaccggattgccgcctggccaccacgctgatcgaggtctgcgcccgcactggcgacgcggaccgcgcgttgggcgtctacgcgcgcatgctggccgcgccgcgcggctcgcgcctggagcccagcgtgcacgccttcaccgccaccatgcgcgcggttgcggagggcggccgtgcaggcgaggcgctggccatctgggccgatatgcagcgcctgggctgcaagcccacgggtgaggtttggattaatggtggcaatgtgtgtctgtgtgagtgtgagtgtgtgtgtgcttggggtgggtgggtgggtggggaggggtttcccataggtggctctggcgcgtctgtttgctacaacagatgtcgtggctcccacatcagnnnnnnnnnnggattaatggtggtgatgtgtgtctgtgtgagtgtgtgtgtgtgtgcgcttggggtgggtttgtgggtggggaggggctccccataggtggctctggcgcgtctgcttcctacaacagatgtcgtggctcccacatcagtcatacaagttggtttcagagggagtcgtggaggctggtgatgctggaccctggttgcgtttatcattccccccggtctcaccccccaccgccctccaatcacacaaacgaaggccacgcgtacgccgccgtcatctccgcctgcgcggcggggggcgagtgggagcgcgcggtgggcctgtttgacgagatgctggccgcccgcatccgccccgacgtcgtgtcctgcaccgccctggttgcggcgctgggcgcggcggggcagccgcgccgcgcggagggcgtggtgcgctggatggcgcgcgccgaggtgcggcccaatgtgcgcacctacaccgcgctgctggctgcccacgccggcgtcggcgactgggaccgcgcgctgggcctgctgcgcgagttgcgcgccgggcgccacggcccggggctggagcccaatgcctacacctactccgcactgctcaaggcggcgggggagcaaggggaggtgggcctggcggagaccctgttcgaggggttggagctggaggcgaggctggacgccgcgaagcaggcggcgctgggcgcgctgcgccctgatgaggggacctgggacgaggggctggaggacgagggcctgttcgaggccctggagaccgcggcggcgatggggtctacgccaacggcgaaagccagcgctgtgatcgctggcccgcttgagtccgcttccgcctggcgatcgcctggcgtgcacgatgcactcaccgttccagagtccagctcttcagacccagacctcgacgcctcgcacgcggccgcactggcggtggctgcggtggcggtggcgcggcccgcggcgtcgccgaccgcttgcgccgacccccagctggagcgcctgctgtgcacgcagctggggccggccctggggggtgttgacggcgccgcctcctccacgccccgctcggggccccgggggccaggagcgggcgcggaggaggcctcggcgcgaggggcgcggggagcgggcgatcatgcagtgcccacaacagcaaactgcaagcctttgcttgctgtctcgggggtgcccatcagcagcagcccgtttccgtcggcagcaacaccatccgacggcccgcagccgtccctgcgcctggcggcggccgctgcggccgcgtggggcgtggcttcgctggatgcgcgcggcgcggcctggggcgccggcgacgactacggctccatcgcggatggagggactccagccctcgcagggaccgccgccgcctcgggagggcgcgatgtgccctccgcgccccacggcagcccggccagcgtgctgcccgcct

SEQ ID NO: 33356 - DNA, 6785 bp, Chlorella protothecoides
  modified_base (127)..(325): a, c, t, g, unknown or other
  modified_base (566)..(575): a, c, t, g, unknown or other
  modified_base (837)..(846): a, c, t, g, unknown or other
  modified_base (936)..(945): a, c, t, g, unknown or other
  modified_base (1291)..(1300): a, c, t, g, unknown or other
  modified_base (2656)..(2665): a, c, t, g, unknown or other
  modified_base (4071)..(4080): a, c, t, g, unknown or other
  modified_base (5131)..(5140): a, c, t, g, unknown or other
  modified_base (6029)..(6038): a, c, t, g, unknown or other
  modified_base (6385)..(6394): a, c, t, g, unknown or other
ggggctccccggtgcctcgctgaggcggggcgagcccaggcggcaggcgcatgccctgctccccctcgttcgtgcatttcatctccagcctcccaagctggcaccctgtccttgctgccccgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgacatggccccatgtggggggttctcgacccctcccatcagcgccttgcgcctgatgcacgccaggcaggaagccgtctgcatcgtggtcaccctcagaccggtagacccccggcgggtgctatccgattcagcacctgcagcgacacgcagcaaatcgggggctcagccagcctggcaaacaccggtgcacagccaggtgttcctggtgcaggcatgtgcaggcggcagctggccgnnnnnnnnnnccttgtggttgtcagaaaggcatgcatgatcacagaggagggcgacggcacggcgagtttcggcgggtgggcttgccgggcgtcactgggaagcacccgcggttgcgcatgtctgtgcaacacgcagtgagtctggaccaagcgggactattgctggcttgcagtgcaggcagcccaccagtcccgacatgggcccatgtgggggggtctcggcccctcccatcagcgccctgcgcctgatgcacgccaggcaggaagccgnnnnnnnnnnacggctgcaggctgcagcccagcctcaacctccctggcccggcaagcacatccaaactatccacgcacccctttgaaggcaggcaggtcnnnnnnnnnngcggctgcaggctgcagcccagccccaacctccctggcccggcaaaatcatccaaagtctccacgcacccctttgaaggcaggcaggtccaggatgccccgcaggaacggcattctccgcaggaaggacaatacggtggggaagaaagcagagaagagccgccagaagccgtacagctccaggaggaagcctgggaggaagggggcagatgctgagacctttggggagctcccgatgacacttggatgtactgccccgtccaaaccttgctgaagcagcctcatgagctactggtatcagcaagcagctcgagcgtcaaccatgcaaagcgtctggcagacctcgnnnnnnnnnncgtatcagcaagcagctcgagcgtgcccaatcaaccatgcaaagcgtctggcagacctcgtgcctactaccaaaggcacacctggtatggaccagccgtagacgacgagggcaaatccaacgaggaagaatgcagagccctgcagaggtgcagggcagtgagacatgccctcaatgccttctggattccagacttggattgcgacccagtgatctgcatgccactccatcccaattgcccaaggagcacacctaacacccaccttgtagttcttgcggcgcatgaagaacctcagggtggcccagaatcctatcgtcagggccacaccagaaaggaagagaacctgggagggagatacacttggcatggatcgcgcaggagggaagcctcgtaaggtggactcgtccactcatatactcagtacccgccatgagatggcaggtcaaggtcctagggaaaagtccagcgtacatttccaatggccaggagacctctgtcaaagaggaagatgaccccgaggaactgcaccgctatgcctaggcctgtgagggccacgccgatctctgcaggagggaagcggaagcaatgggagcgtccttttttggtctgatgccccgccacaagccaggaactggaaatggctcccacagcattacacgcacttcgcttgtcgtccagcatctgcgccgatcaaggggcgtgtgccctattcgctcagagttgagatgctgccttataggcaaaggctgaggcgtcggcgtcctgcgctctgtgtttggtgtcctgagtggatcggcatcagaccgcgcttcgggaatgcatgcccacacagttcctatgatatcaatattgtcgtactgaggtataaatgagtcttgtacgccagtcccacttcaagctctgtctctggaggagtgcaagctgcggacctgctgcgcggaagatcgccgtgcgctttcgaatcataggagcaccgatcccggcatctgagccaagcgaaaacgtctctgaagatgctgtgcgcgggccgaggcttcatagacaatcctatctggcctgaggttgagttgtgattgtattctgtgtgttcaatcgagattactgtcgctgtcgagcatgtgaggacaagggtcgcacccctgccatggccggggaggactgggccgagggcgaggagctactgagaatattttccaggcatgcccacaccatcccaatcaatggtgagatgatgggtttggatcatgagtttgtgggagcaggtgtgcacctcccgagccggctctgtgagtcaagctgtgctccacctggtgattggtttgcccccgcccaacaggggatgatgtcgagctgctnnnnnnnnnnggagtcaagctgcgctccacctggtgattggtttgccaccgcccaacaggggatgatgtcgagctgctcgacacacccgcccacttcttcgagacccttctggtatgctgtgacgtgggtgttccagggtgatcagtctgtctctatgctgtgcaccgacaggactcgtctcgtgggacggtgaatcgtgcatcttggctgccacccgcatccgtgggcttacccaaccctgctggtgccattcgaccgcattgatgatggacctgccaactgaggtggtttgctctcttcaccttcgcctgtcaacttcggacccagatcggtataggcaccgcccagcgatctatcagccttgcggctctgtacattggcatcgaatctcgggccgaggcacgattcatcggggcactgaaggctgcggccgccgaccccgcgcgccccgagctccggctgcagatcctgctggatgcggcccgtgccacccgcccatgccgggatcaagaaggtgaggcagtgtacgagcatgctgtggcctattgtgcagcgcacaagatggatcgacacatggcagtgccttccacaaggtctcagcccctcgcattgcaggctccatctccagcacagcagaggtcctggcgcgagaactgctgctgcccttcgagggcgcccagcgggcgagcgtggccctcttccagacaccccacagccgcacctccatccggaggtggggatgacgagggggaagcgggtgcagcagggcttctcagcgccgcaccgccgatacctgggctggacggcttgacgttctctgggacaccattgactttgcgcatgcgcagacatggcacctcaccccaacatttgccactgggcccccctacctccagtaccttcccgcaccaaaacattccgcagggtgctgccaccgcgggtgcgggaggtgctgggggtgcagcacatcaaggcctttgcctttgacgacgacgtggtgctgacgggcgccaacatcagcggcgcctacctctccgatcggcaggaccggtactgggtggtccggcgctcgccgcggctggccacctttgtgcacggcctggtggccgatgtgtccagccactccttccagctggaaagcacggcgacggggcgggggcccacagatgcagaagctgccccgccccccagggccgccgcgccgcccgcccccctgggggaggaggaaggcctgtcgcgcggcgcgcggcgcctgctgcacctgcggcacaggggctccgccgccgccgctgcgacgcgtggcgggcccccggccccgggcgccggcccggggtcgtacgtgctgcgcccaccccccgtgggggtcaacccctcgcgcacgccagccgtgttccggcgctcgctgcgctacgcgnnnnnnnnnnggcccccgtgggggtcaacccctcgcacacaccggccgtgttccggcgctcgctgcgctacgcgctgctgcgccgcttcgtccccgggggcgcctggggctcgaccctggacggcgccgcgctccgggagctggacgacctggcgccggaggcgacgggcgggggggacccggccgcgccggccgcgcaggacaccacggctgacacggtgatcctaccgacggtgcaggccgggttcctgggcctgcggcaggaggaggtgtgcagcctggcgctgctgcgccgcgccgcggcggccggggggacgcgggagctgcgcctgagcacgccctacctgaacctggcgcggggcctggcggccgcgctggcggccgcaccgcgcctgccgctgcgcctgctcacctccagccccgaggccaacggcttctggggcagcgccggcctgtcgcgccacatcccactcgcctatgccgcgctggaggcgcggacctggcgcgcgctggcgccgccgcgcggccggcctggcgccgcgccgcgcgtgctgctggagtacgcccgccccggctggcaattccacgccaagggactgtggtacggccccagcgcgccctcggcggcagggcaagctgcacgggggcgcgcggcagcggagcgacccctgccgccctgcttcaccgccgtcggcagctccaactacggcgcgcgctcgcaacgccgggacctggaggcccagttcctggtcgtgacacgcaacccacgcctacgtgccgcgatggagcgcgagtgggccgggctggaggcgcatgccgtggaggtggggccggcgcagctgcagcagccggcgcgccgggcagggccggtggtggcgggcctggtcaggctgctcaagggctttctctgacctctggaggcgctgcttggaggtggaggagcagcagggcttttgtgtggagcaggcttacgactgcatgctttcgccaaggaggttattgacatgttgtgcccttgcgcccgatatgagcaatctgtgctctgtcatttcctcgacacnnnnnnnnnnaggagcaggctcacaactggatgctttcgccaaggaggatattgacatgttgtgcccttgcgcccgaaatgtgcaatctgtgctctgtcatttcctcgacacctgctgcagccctagctgcaagggtctgggcgctgtacagctatgcaggctgcatggccatgcatgcagaatgccccctgcgtatttcgatccctggctcccatgcttctaccatgattgcagggtcctttcatcaagttgcaagggagcgtgacacccgcgggaagggggtgtcctcctacacatgagcaggtggaagaatacatgggacccaaaaggggagtttggcatggcctgacctctcccaggttgcagcacaggagggtcgagccttgattggttccgagggagggtcaacggtggcgatcgatcactgcctggcatataattgtgacagtggatgagcgagcccaccagacacgccctcgcagtgttcgggggtaggaagctacgagggcctcggcggtctacgcagggctgcgcaacacgacattccgtctcgcaactcggcattccaggcggggtgccagcgccaccctcgtcctcatttcccggtcttagccttgtgcgccgccttcatctgcttgaagcgcgtgaagcagtcggccttggtccggccggggacaaggctgctgaccacctcccagcggtcggggacctctttccgcaccaccttgagtgccttgatcagcgccagctcctgcgcctcggtccactgcacgggggcagctgcctcgggggaggccgtcgcaggcttgctgccgttgactgccggaactgcaatgaggggaaagcagggttgggggactcatgttgaaagggagggggaatgaggttgggagactcnnnnnnnnnngttagggggaaggcagggttgggggacttatgttaaaagggagggggaatgaggttgggagactcatggagcagtccgtgccaccgagtgtgcctctctgccaagcgggctgtcctctgggcctaagcatcaagccaaatggtcggaatccgagcaggcgccaggcgctgccttggggatctgtcgacgaggatccatcctccgtagaacttcaccacccacatataggctgccatgcactccgatcacgcaacagacttctgccctccttccctctccaacaaaaatcctccctttccacgcaccgtcgacgtcggtgaagctggtgtgccgctccgtggcctcgnnnnnnnnnnccgcaacagacttctgccctccttccctccccaacaaaaatcctccctctccacgcaccgtcgacgtcagtgaagctggtgtgccgctccgtggcctcgctgcggatgacggtgttgccctggcgcttggccgccacctcgtaggtctggggcacagcgcgcgcagcgtgggccttcagcccgtgcttgaccatgtccaggatctcgtcggtggtgcgggtgcggacgtagccctgcaccacctcccagcgcttggccgtccccgccggccacttgtccagcgccttctgcagcagccgcacctcatcgtcgctccaggcggccagcgcgcgcgcgcgcccctccgcctcgcgccgcgtctcgatctcccgagccgcggccgccgcgcgcg

SEQ ID NO: 33357 - DNA, 61 bp, Chlorella protothecoides
acctgccagaggcagatgcagggcgagaggaccctgccgtgaccttgcagcaccatcaccc

SEQ ID NO: 33358 - DNA, 61 bp, Chlorella protothecoides
cccgccccgcccccccgacgccccgaagactagcggcaagcgcacccgcggcggggcgccc

SEQ ID NO: 33359 - DNA, 61 bp, Chlorella protothecoides
cccgctcgctaagaaagctttctcccccccacacaaacaatatacctgggatgaagaggtg

SEQ ID NO: 33360 - DNA, 61 bp, Chlorella protothecoides
tgggcattgcgatgaacgtagagccgcaaggggcctgctctcgaggaggaagggtggcgga

SEQ ID NO: 33361 - DNA, 118 bp, Chlorella protothecoides
gctgtctgcagtcgtggagagcagggagcgggtgcaggccgccggcaagcagtggggcgcacaggcggcggtgaagctgcacctgaccctgcgctcgggggccgagggcgagtccagc

SEQ ID NO: 33362 - DNA, 10618 bp, Chlorella protothecoides
  modified_base (467)..(476): a, c, t, g, unknown or other
  modified_base (1342)..(1351): a, c, t, g, unknown or other
  modified_base (2249)..(2258): a, c, t, g, unknown or other
  modified_base (2885)..(2894): a, c, t, g, unknown or other
  modified_base (3629)..(3638): a, c, t, g, unknown or other
  modified_base (5204)..(5213): a, c, t, g, unknown or other
  modified_base (6206)..(6302): a, c, t, g, unknown or other
  modified_base (9383)..(9392): a, c, t, g, unknown or other
cgagcgccgctccgcgcgccgccgccgcggccccctcgcccgccgcgagcctcgccactgcttcgcccctgggactggccgccctcgggccggccgcgctttccatcctcgcggcgcatgggcgtgttggtggtgacggcccgccgccacccgcggaaacggtagtagcggtctgtcagcatcgtgaaccagacggcattcacgccttctttctcgtcctgggccgcaatgtgcgggtacagctgggccgcctatgggcaggaggggggtgggtgggggccagtcggatgctgcacggatcaattgtgttgttggatgttccaagcaggtccgccccaggaagcccttcaagatggacgattgataggaatgcaggatggtacagagttgtcgcacccatccaggcccagccatccctggtcgtgtcaccttgaatgcgtccacgtggctttggaagtcggacaggnnnnnnnnnngcagtcggatgctgcacggatcaattccgttgttggagtgttccaagcacatccgccccaggaagcccttcaagatggacgactgataggaatgcaggatggtacagagttgtggcacccatccaggcccagccatccctggtcctgtcaccttgaaggcgtccacgtggctttggaagtcggacaggtggatctcgccatgcagcttgccaaactgggtgttgtaggagtcgtagtagcactcatccagaaacagccccagctcaggagccatgggcccgctcagccctgttggaagggtggaaagggcggcaggcggtcatgctctgcatgtgctgactggtgcagggcatggccggcgaccttgaaccctcgacacacccctggaccactggccttgcaccacccctcaccgattcgagtgtgcagcgccagggagatggcgtccgctggggccgccccccggtaaatggccatggccagtcccaccatcttcctgatctggtgcagcatgaaggactggcccaccaccaccagcctcacccacggcttcccgccgatgtcaaaggcccccaggcacctggtggaatcagggaggcggggtcgtcgacagggtcggtgattggacatgtggatgggggtgctggggaagtgctccgatcgatgttcaggcagaactcgtaccaccacttgcagctgggggtggtacccacacccattgcatactcgccaccctcttgtgaccgcccaaggcatccaccccatccagtctccaatcgctcctgctcacaagttggcctgccccatctgtcagccccccaggacaagccctcaaccgccacagcccggcccacctgaacgatagnnnnnnnnnntgatcgatgttcaggcagaactcgtaccaccgcttgcagcggggggtggtacccacaccctttgcatacttgccaccctcttgagaccgcccaaggcatccaccccattcagtctccaatcgatcctgctcaccattcggcctgccccatcagccagccccccaggacgagccccaaaccgccacagcccggcccacctgaacgacaggatataccgtctcgcatttggcgcggaggcggcgacccgcaccgtgaagttgtggaagttgtgggtcccctcaaaggcggagaggatggaggtcattcgggccgcacaggccgcatcgaaaatgaatccggtgtcctctggctgtggcactcctgtcgaagccgccagcgcgccgtctgcctccacagagggggtcactccttcccctgtccccggcggcgcgtcacccggatccccagcggcgtcgccacctgcggccggcgcgtcctcgtcatcacccagggccgtggcagcctcgccgtcctcctccgtctccaggagcggcacggcctcgccgtcctcctccccaagcaggctggagggagggactagggcggggtcaaaggcccaagccggcaggatgtactcgtaccgccgcttgtcacagtgcttcctggcatcgaagccatgcgtcgcccgcccgaaaccaaacacgcggacctgtgcggcaaaggggtgcaggcgctgtgtgggggtgtcgcggagtgaggggcccaagcaccaagcgtgtccaaggggaaggtacactcagggcggccgtctgagcacgccgcaaatgagagtccagctgcctggatcctgggtggggttcagccctcggcggccaacctgcaactcaacaacccctgttctgcatcaaacccctgccannnnnnnnnnaccagctgcctggatcctgggtgggtttcagccctcggcggccaacctgccactcaccaacccctgttctgcatcaaacccctgccagattctggctcagggacctgtttccatcccactctctccaacttcctccccccattccccactccgaaactcacacgacccacctgggcgggcagctcgacgttgatcttggcgaggatatcggggtcctccagcaccatgcgcaggctgaccacctggcccaccgcgctcacgcccttgtcggtcctcgccgcccgcatccagtggatcttggagaaccccgcctcgtcggagttggcgtgggagatgccgcccgccttgtggatggcgcggaagaggtcctcctcgatggttcggaccccggggttgcgctgcatgcccgcatagccgtggcccacgtatgccatgagcagcgccaccttcctcttcttcttggcgttgggcagggaggcggactccgcggtccccgcccctgcctcctgggacccagcaccagtcgcctccgcctccacggcgtccacagagccctcctgggcagggctcccggcctgaggcccggcagtggggtcccctggtccacccccgtccgtggctgtgacnnnnnnnnnnagcctcctgggcagggctcccggcctggggcctggcagtgggggtccctggtccacccccgtccgtggctgtgacaccctcttcgccgatgggggtcatggcggccacctgctcctcctcaggcattcagaatgtcagtattgtttggatgaacgagtagactcagagctcaggcgcacaaatggggagtcgaggggaggtcgatgagcccctgacggctgacagcgagatgttgcacggtgaaggggaagcagactataaacccggtcgactgcataagtactgtgatatggtgtcgaatttgtgccataattcggtgcacgcgggtctgtacaacatgcatgcatgtcgggagtgggccaactcgcgcccaggactcgccgttccgattccacttccatcggatttccgaaactgccctccagcatgctcaagctttacatccggcggacatgttactggtacaagcacatggtatgcgtacgggcgccaaggataatggctgacaaggtttgggtcatgacaagggtgccgcctgtgaggtggcacaaggggcccctctcaaagctcgacgacgggggttcgctggaagctgtagtacacctcatccgtgtccacatgcatcaccaggaagacctggggcaggggcaggtggagcggagtcgtgagtctggtatacaatgtaaacaagaggctgttgctgactcttgtgtaccatcagggctctgggaactnnnnnnnnnnatggagcggagtcgtgagtctggtacacaatgtaaacaagaggctgttcctgcctcttgtgtaccatcagggctctgggaacttcctcagacaccttctctccccgacccccgccccaagcgcacacctttcggaccatgatggccaggatgcagagcaccaggaggagcgccaggtaggtcaggccccggtcctcccccagaggcggcgtgcggtggtgcagcgagggcgcgtcggccatgcgcaggaaagcggggaacggtgggggagcgacgacctcgggcctggggtccggggagggggaccgggcggccgccgccgcagcgccgcttggtgggagggcctcgtggtccactgtggcacgcacctccggctctgctctgtccgcaccgacccctcgcgcatcatcctcaggctcggatgcttcgggagcagcggcggcagggctcacaacacccggtctggtgctctctgacgctgcagcttgcgccgctgcagcatcagcctgggcactggccgtcgccgccacgtcccctgcggcagcaggccccgccccatcctgcgatggcgccgccggaccggcccgctgctccgaccccacctgcgcgaggtgcagggccctggagcccgcctctgcagccagcatggaggcgtgcaggccgttcagctgctcctgtgtggtggcagaggaggacctgggcacccaggcccgggaatcctgcgccagagcgcgccgcgcctcgggcgaggcgtccaccgcgcccaccgcgccgccggcgggggtctgcatgaacgcgcgcagggccaccagcgcggcccgcacgctccaggacggctgccaggactcggggtggtgggaggagatggacaggcagatcttggtgcccacctcccagcggccagagggggtggccatcacgaaggagggtggcttgaaggggtagtccgcgggcagcaggatgcggccatggtagatgcctccggcgaaatcgctgtcccaagcgcctcggatggcgaagtgccactcgaacaggttctcctgcgagtgccgggagggggtgctcagggcggagcggggctttgcgatgcatgtgtgacgggcgcatccccacacgggctcagcgaccagcacccctccgtacacccacctcagcggccgtggccaggacatcggggttgtcatcttgctgacactctcgaagctcctgaaggatgcgcttcacggccgggttgcgcgcgttccagccctgcatgatgaagtcgctgcgaacccctgtctgagctccggaagctgaacgaggcccttgactatctcgggcttggctcctccttgctcgaatttctaacgagaaaaatataggatggtggtcgccatcgagctgagctcaccttgctcgggaagctttcccctcaccccattgaccatccggagtgagtgacgtgttatcgctgctgcggccgagattccctccacgaccaccaagggagagcaggtgtcaaagggagataaatactagttcaagcattgctctgacttcaaccagggttctccttctttgccttctnnnnnnnnnncgaccatccggagtgaatgacgtgttattgctgctgcggccgagattccctctaggaccaccaagggggagcaggtgtcaaagggaaataaatactagctcaagcattgctctgatttcaaccagggttctccttctttgccttctgcccttttcgcttgagagccttggcgctggtgagcagctgcgactttgatgccagagcaggacgggttgaagtacccagcgctcgacagccccttccttcctcctcttcgtcgtcgtccagccctgcctggtccatggcggaggcatttctttggcccatgctcgctgccgggctgccaaactggctgccaaacctgccgtgctggggcggatgagctggaaagacgccgctgcgtttcagactcttcgccagcgatgcgtctgctttggagagcatggctgcctgtcgtgttagagattgcaagggcgttcgattggtttgcgctggaagtcaccgagattgttcttgctcgtggaagggcacacgaccgatagtgcaagtccctcatctgaaggctcaccttgtagtgagggacaaaagtggccccgagtcccaggccctgcctttgtcccgactccaatgcgtcatccccgctcttggcaagaagtgcagcggcgtcactgatgcctagccaggcagccacctgggagaggaacgttcgcatgtagagattttgctatccagactgctcgctggggcaggcataatggattcaccttattccacgacaagattatattccagtaataggcctccaactcactgtgtcgagggcagagtgtgtgacgactacctccccggcatctgccgtaggggggtccgacatatgttcgacagcgctgctcgtgatatcgtttaccaatgaatagtcggtgcttaagaatatctatctttacgctccaggtgctaagcagcccatgcactcgagtgtacccagctcgtgcttgctggccagcatgctgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctcgaaaaatcacattcaaccggtccacgtctgaacttcagtcagattgacggtcttgagtgacaagttctgctccatgagggccacacaacagtgccctcattccgggggctgcagccacacctccagctggcgcagcacctctgggtccccgtaccagcgccccccgccctttctctgcggcatgtgccacaccccctccagcaccacatgctcggacccgggcagcatggcgatgcagaggggcgtgacgccgtccccttccaccgccccatccccacaccctgccatgtagctctcgaagacgaggtaccgccgcagcctgccgtcccctgggccgagcgagacacgtcctcctacgcagacgatccgcgtgcccccaaagcagtcgccggtggggtagtagtagttggtccacctcaggctgctcgtgaggtccctaggatccaggggggcggtggggccagggtccagggtctcctgaatacgacaaagggaccacgggggcaggcagcaataaggggaaggtgctgtgctcctgggtgtcatgcagcgggtgtcatcagccattgatgcaagcctgcaacaggcaaggccagcatggccgcaaaccctttgctcccatcgcggtgcagtcctgaggtccccattatacccatccaaagcatgagccctgccccacaccacagtactggcagacccccactcaccacaggtttgtagaatgggtactgctcaatgctggcatgcggcgtgccgagggtgagcagagtgtgaactttgggcgacagcccatactcatgtttctggtagggcacactgcccagggcaatccgcgcgatccagccgcccgcggagtggcccaccaaggcaactctgccatgcacagcatgcatagcatgcacctgggtggccaggcggtccaggtagaaggagaatccctgggcgcggagggggcctacccagtccaggaaacgcatgggcaggatctctgtgggaggaaaggggaaggctgggtgaaccgtcacacacctggcttgcatcagtatagcgtccactgtacagcagggctcgcgctgcggaggaagaaccctcgaagtcttgccgggatctccatacaatcacccacctgcatggaagccccgctgccgcaggtacgctgccatcggctcatactgcccgctgctggtcaagaacccaggcaatatcaaaataggccctctagaattgcctgggctgcgtgcatgacttgcgcagactgctagcttcgccggtgatcgtacccgggtgggaccggtgcacggtggcagcctgcgaatggcggtcatgcaggcagccggtcaagccttcgtcgatagtgcatggtctgagagcgctgtaatgctcctagagaatgtatcaacgcagtggccaccgagcacgtggaacatgagcatcccatcgcctcgttgccctggatgtacttgcgatttccgaaccgcgagagtcaaactccgcgcgcgcgtcgaggtgccgtggttcctcgacacatcgtggcaaccacccagaggagggtgccgttatacctatgggcagcatttcgtgaactcgtgctcctgctcacctcaaatctcgtcgcagccctgcactctctcttctcacccccggcgtccacaccccaaccgccccgacaactccccttcgtggggccccgccaaacatggcggggcagcaggatccctacttcatagtacagcgagacgtgaatgacacggtgaggtgcatgttgggtcgtctcagcatgggactggagccagcctcgctcctgccgatctggcgccttggtgggacaggagcccccttaccccctcgcagttgagcagcgtgcagactcggtacacacagctgcgctccctgcccgcggctcactccaatcgcaagcccctcctcgaggagctccaagaagactgctccagcctggagtacatggtgcgctcttaaggacgagaggaggggtctagagggatcgggtgtgggaatatagctgcatcctgtggcaaacctcgcccctcacttcttcatccacctatcacacctatcttcctttttatatcttcccccaccccctaaaaaaacgcatgatgatcaggtgagcgagatcgagcgttccctggatgcggcggaggccaacccggcccgattccggctgagccaggccgagctgtccgaccggcggcgctgggtcatctccgcccggcgccagaccagcgtgctgaacgagggcctggcggcggcgcgcacggcagccgacgccgcgccgcggctgacccccgcctccaagctggccgcggcggtgcacgaggagaatgaccgcttcatcgcctctgaggccgacaggcagcaggcgctgatgtcgcgccaggacgaggatctggacgtgctgggagggcacgtcgtgcgcatcggcgagctgggccgggagatgggccaggagctgcacatgcagggccaggtggacaggggtcccgttcgggaggggagagacgggggggagcggtgcaatgtgtggaggacgggcgagtcggttgtgcagggagtctgtgcctggatggtgccctgtggggctgaccgatgtgccctggcaaccgctgcactaccctcggccctctggtcccacgctgcggcgaccgacagctgtctccacctgccccacaccactctggccccgggaccctgagctgctcccaccaaagtcctcgcaacaccacactctccctccatcaaccacgagtgcagctgctggaagagtttgacgaggagctggagggcacctccacgcggctggccgccgcgcagaagaagatccaggcggtcctggaccgcaccgggtccaagggccagctggccatcatcggcttcctcctcgtcgtgctcgtgctcctggtggtgctcgccatcgcatgaacaacggggcccgtgccgcagggcagatttaaggggggccagcggggacgggtcacaggcgaaaggggggcgaagtccggaggcggggtggcgatgcaagtgcacacacacaggcagtggactctggacaggcgnnnnnnnnnngggcgggatggcgatgcaagtgtgcacacacaggcagtggactctggacaggcggacagagacgtccagggtgcggcagactccggcgctgcacgcactgtgcagctgccgagcctccaggctagtttcagactggggatcgatggccgttgcgagcggtgccacgcctgggctcgcagccacgggctcactgccacaggctggaggggaatggccctgcgcagggatgaaggggaggcggcggagtgggtgcaggaggggcgcggtgcatgggtgcgatggggggtggcaatcgttcccgcacgcagagcaggattcacggcggatggggcagcatgcgggcaggccacgcgcccgcaaaagggactggcatccacagcacgacgactgcgtcgggcgggcggccggcagctcggagccgctgcgccctgctccgcccccacaccactcccctcacctcccgccccggcgtagagccccggcacggcgccgtgggtcacgtggcgctcgtgccgcggagcccccggccccaccaggccctcaatctcgcccagcaggtccgcaggcagcacctccgccgggtcctgcacctcatagtctgcctggccgggcgcggccgcgtaggccgcgtagcccgctgcctgcaccgcgccaatgtcgaggtcggcgaagcgcgaggccaggcccacgtcggccccggcgccggccggcaactggctgagcggggcgtggaagcccgcaaaggggtcgaaccgcgcgggcaggggcgcggcgggcgggggttgctgcagcggcgcggcctgcggcgcaggtggcagggcagcggcttgtgagagagccgaaagagtcgggcgcggggctcgaggagaggtggccccgcgcccagcgcttggctccctcgggacgagcaggagcgcggggctccgctcctgctgctgcggctgcgccgtcgcgtgagcaggcgccttgtgagggtggctgcgaggcgaggcagccacggaagccgggacgggatggcccgggggcccgcgggtgggggcggcggggcctcgtggcatcagcgccaccgtagccttgggcgcggccacgctcgccgcgtcgcgtctgggcggcgcgtcgcgccgcttcgtcgccggcttgccgggcttggagcccggcgaggcgatcacggaggctgctctggacgccggcgctgctcgggccctgctctgcgggtcgggccgcgc

SEQ ID NO: 33363 - DNA, 61 bp, Chlorella protothecoides
aagggcctagagccctggagacccatgatgtcctgccatattgatcgcctggcatgcttcg

SEQ ID NO: 33364 - DNA, 16295 bp, Chlorella protothecoides
  modified_base (107)..(116): a, c, t, g, unknown or other
  modified_base (357)..(421): a, c, t, g, unknown or other
  modified_base (978)..(1010): a, c, t, g, unknown or other
  modified_base (2288)..(2297): a, c, t, g, unknown or other
  modified_base (2371)..(2392): a, c, t, g, unknown or other
  modified_base (2566)..(2575): a, c, t, g, unknown or other
  modified_base (2636)..(2764): a, c, t, g, unknown or other
  modified_base (3070)..(3079): a, c, t, g, unknown or other
  modified_base (6363)..(6372): a, c, t, g, unknown or other
  modified_base (8057)..(8066): a, c, t, g, unknown or other
  modified_base (9546)..(9555): a, c, t, g, unknown or other
  modified_base (11911)..(11920): a, c, t, g, unknown or other
  modified_base (12303)..(12312): a, c, t, g, unknown or other
  modified_base (12722)..(12731): a, c, t, g, unknown or other
  modified_base (13590)..(13599): a, c, t, g, unknown or other
  modified_base (13773)..(13782): a, c, t, g, unknown or other
  modified_base (15257)..(15266): a, c, t, g, unknown or other
  modified_base (15948)..(15957): a, c, t, g, unknown or other
ggcgccacccgggggcggggcctcccggtcgagcccctccccgccatcgctggcccggggcgccgcttgcggcgccgactcctgggtcagcggctccagcgccctgnnnnnnnnnntagcccctccccgccgtcgctggcctggggcgccgcttgcggcgcggactcctgggtcagcggctccagcgccctgccgatgctgaccgcgtctgagccgagacgggtgagctgctgcactgccagcgcctcctggtcgtcgtcggcgcagagctgccagggcgggccggcgtgaaggtccaggtgcaagcgctgcccctcctccagctccaccaggtactgggaagggggtggggggggnnnnnnnnnnnnnnnnnnnnnnnnnnnnnnnnnnnnnnnnnnnnnnnnnnnnnnnnnnnnnnnnnctgcaaaggcattcttcagagttatattgttgacggtgccctccggaccgaggcccgaggactgtacatgcacccagcccagtcgccccatcaccagaaccactcacggtgcgatccgcggcgcggtaggagacgaccagcccgatctgggggctggcgtcctgcctcgcgccgtgcagcttgatgtggtagcctaccaggtcttggccgcgcaggttgctgctgctccctgcgacggcggcgagggtggtggcggctatgggtgagaaatcggggggaaaccgccggcgctggactttgcacgatctggcttgtatttgttgctccaagggcggtgggggggataaacagctacgccttcccaccattcaacttgaatactcagccaggcaccagtccaagagccctctccaagcgacccccacctccacacactcctttccatgcacagaacagcggcaccacccccaatgccacctgggatccaggtcttgatgcggggcgaggccacctccatggactcttcctcctcgtcctccggcgactggctgccggcnnnnnnnnnnnnnnnnnnnnnnnnnnnnnnnnnggcgcggcgcgccgatgtgtggcgcgctgtgcacgctgcgcccctgcccccgtccggcgtgcgcgctgtcctccctccagtccaggatctcgtcggtccagcgactgtgcttgccccgcgtgctgcgggcggggcggctgggcttggagggcaggggcggcagcgaccaatgggaggaggaggggcggcgcttgcgccccggcggcggcgacccgcggtccaccacgccggcgccctcgccgccctcgccgccgcgcgcgccagcgtttcccaccgaccaggagcgggtgggggagggcggcaagcccttgcgcaggtacacctcgtagggcaggaggtggcgctcgtacaggcggcgcacgtggaagctgaggttggtcatggacttgctggggcccagctggcggcccaccgtcgcccactgcttgttcatgctcacggcgtcgtagccgccatgctggcgcaccaccaggtcccacagcaggtccaggtccagctcggatttgttgaaccggggggggtcctgtggcaaagggggaaacggtgggcgaggggtgaggacgggaggatcttgggcgtcgggacgccagattcttggggagatttcaaatccgacggtgcggcatgggcgcctgagcaccccggagcaaggcttcctgacatctcacgcgatgcgccatggaggcgacatggggcggggagcatgcccccaggatcccatgcccggcgcccggcaaagggaggagccagcacccaccccgaatggaatgcggtggcgggcatgaaactccaacaggtccagtctcagctccgaggtgcggcgtagacctgacagagtgctctcatcgggtgtggtggggagttggggccaagtggggcatgggggggaggcgtcagcctcgccacggagcgagggggctgggctgccttcttcccgtgcctgagccggccagggcgccagggccacggattctaccccctgcaccgttatttccatggcatcatccattacaaggtttggaggggtgcgtgctatcgaggactgcgaacatgcgagcttaacaattacgcgcatgcactgtgcatgttggggcccttaagcggctggaaagcgagaaagcacatgaggccgcgtgcagctcaatggccgagttgagcagcgtatgggtgcatgaggcagtagacagctctgaagattgcttatgcggaagatttgtcgatgcagaagtgtgtggacgacgtgtccccttgacatagatgtggtgggtaaaggaacannnnnnnnnntaatggccaagttgagctgcgtatgggtgcataaggcagtagtcagctctgaagattgcttatgcggaagattnnnnnnnnnnnnnnnnnnnnnntagattacctgcagaactgtgcacatccccgcctggctggatgttggggttgggatgcaccatgcacttgcgtttcacatctccctgccgggatgcatgccgcttgtgctcctatttaatcgtgcaagccgatttatcgccggttgtgaatacagctgccgatgctggagcgcnnnnnnnnnncagattacctgcagaactgtgcacatcactgcctggctggatgttggggttgggatgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgactcgtggaagtctggccaatttcacgagccatgttcgatcgtgttggaacccggaaggtgagggggtggagagtccttgtggctttcgaaggtatggatgagtaatttcccctgttgacgtctcctgaagacggaagtctcgagtacgtaccctcccctgacccctgtctcctatcctgatcacggtgctgaatctatgcatgttgacagccaatgcatttatggggacagcagggggcagggtcagatgtgcaagtacactctcgcacatacagttccccctccacccccccttcgccgcnnnnnnnnnngcgtctcctgaatacggatgtctcgagtacgtaccctaccctgaaccctgtctcctatcctgagcacggtgctggatctatgcatgttgacagccagtgcatttatggggacagcagggggcaggggcagatgtgcacgtacactctcgcacagacagttccccctccacccccccttcgccgcgcgggcgactgcgcgctcagttgttgtatccggaggtggtgatgctgtccgcggagccaaaggacgcgtcccacacggtgtgcgtccaccccggccggtccacacgctcgtaggtgtgggagccgaagaagtcgcgctgcgcctggaccaggttggcgggcaggcggccgcggcggtaggagtcaaagtagcccagggagccggtgatgccggggatgccaatgccggcgcccacggccacggccaccacgcggcgccaggcgtcctgcttccgcgccagctcggcggcaaagtcggggtccaccaggaggttgggcaggtcggggttgcgctggtaggccaacttgatccggtccaggaacgcggcgcggatgatgcagccgccctggggcgggtgggtgggttgttgtcaagggtgaccgggggtgggggtttgtgcagaggccagggggttgcatgtcagcagagtcacggagtcggaagatgggaggcccaggccgcgtcaggagcgacaccgttgcccaccagaaacacaagaaagaaacacaccccaaccccaccgggtaccttccagatgcggcccaggtctgccagctcgatgccccagcccttctccatgctcttggcgcggatgatgttgtagccctgtgcgtaggagcagatcttggcggcgtacagtgcctcgcgcacatcggccaccagcgccgccttgtccacgccgggcgcggcggccggggccgccacgcccagtcccgcatacagcgcctccgccgccacgcgctcgtccttgagccccgacaggaagcgcgcgtccagcgcggcggccatggtgggcgcggccacgctcagctccgcggcctgctggatggtccacttccccgtccccttcatccccgtcttgtccaggatcttgtccagcaggaagccctcgccctcggtgtcgcgcacggagaagatgaggctggtgatcatgaccaggaaggactccagctcgccgccgttccactccacaaaggtggccgccagctcctcgttgctcagcccacccacggtgcgcagcacgtcgtacgcctccgcgatcagctgcatgtcgccgtactcgatgccgttgtgcaccatcttcacgtagttcccagcgcccccgggcccgatgtaggtcacgcaggggccgtcgtcggtctgcgccgccacgcgctccaccacgggtcggaggtgggagtaggcgccctcgtcgccgccaggcatcatggcggggccgttgcgcgcgccctcctcgccaccggacacccccatgccaatgtggtggatgcccagggccgccagctccgcctggcgccgctccgtgttctcgtaccactcgttcccgccgtcgatgatgatgtcgccgggctccaggaactgcgtcagctgcttgatggtcgcgtccacgggggcgcccgccttcaccagaatgatcacgcgcctgcttgttggtgttggaggggggaggaaaggcggggtgagtaaccggctgggtggaggtcggccatgtgctgtttgtaatagaagtaggaggaggggggcgaagcacggggaaggcgcgcggcagcgcccctggcgagagggacccagcagtgggtgacaaaccctaggcacaaccgcccacgacagaaaagggtacgcagcatgggaccggacatcatgcagctgaaagagtgtctgaatcccagacaggagaatttgcgtgccacaagcccaaccccccccccctctccctacctggggcgcttgagggacgccacaaagtccttgagctccttgtacccatgcaggcgctcgcccacgccctccttcccggcccgggacacggcggcgtccgtcttgtccccagatcggttgtacacggagatgtggaagcccttctccgccacattcagggccagattctgcgggggagacgactcgcgtcagcattcacgtcatttgacaacgacagcagcgcgatcggggggccgaggcgcgaccctcggggcaggcatggaagcaatatcccatactagaatggggcagagcgagcagggacagggcggcccgccccactccgggttcacctggcccatgaccgcgaggccgatgagcccgacctccgactgggcggtaggggaagccatgctgttggggataaaaggtgagaaaatgggtcgatgaagattctcacaatgggtttatgccggaggtgaccctggatcacgcaaacttactacctcccacacctggaatcagcagtctgggctgagcgtggcgctaccgctgcggtacgcccacagcgccgtgccggagcacaggggacgagcttgcgagacgccgacgacagcccacgcttggggctggtctggtggcggggtacaaatgcaggctttggagcggacagaactcgcgtgcagggtcctgctgagggatgcacggccgaggccagatggggagccatgggtctgtccgcaaggggccgtcacccttgcgctgcaagcaacaggaggcaatccaatcgtcctgtgatgtgcagggcgaaaggatggtttggggtttacagggcaggtcactcgatgaagccagattgaaaactattggacccacgtttccaacgtggcgcacagcgcgccctcaccatctcagcgggcaacatgctgcaaccgcgcccccatgccatgcattgttacctggtagatagtatgcacaacttccgcctgctccgtccattgagggccctgcagctcatgcgactgtccagatcacgacggcgcaatttctgtccctttcctgactaacctggacggcagagcccgaccgacccgcctgcatgccatatttttcgagtccatgacgtgcaatattatcaaagagatacttgatggctttaaatggaagtgtatatgcctgcacttcacgattaggggcctcaggactttttaggttttttgtgggcggccttgggccgatcaggcgcggcttgttctgtggacccatcctccttctttgccttcttcggcctggttcgcacccccctggccggcttggcagtggctttctgcgagcttcctccctccatcgcagcgtcaccgtnnnnnnnnnncatcaaagagatacttgatggcttttaaatgcaagtgtatatgccagcactccacgatgaggggcctcaggactatttaggtttttggtgggcggccttgggccgatcaggcgcggcttgttccgtggacccatcctcgttctttgccttcttcggcctggtccgcacctccctggccggcttggcggtggcttcctgcaagcttcctccctccatcgcagcgtcaccgtcagcggccacgtcgccttcctccagcgcaaccgcctgctccgggtcggagcgcttccgccgccgctccttcctcagcgccagcatccagtctgggacgggggagcccgacgcccgtacaacgttggcgatgccccgcaggtacttgacgtcctcttccgtgaagaaggtgatcgccgaccctgccaggggttgcaggagattggtggtgctggcggcgatcgtacggcttggcgggaggttgagtacacaccctcacgcacctggtctgccacaccaggcaagcccatcctctccagagccagtcattcctgtcttccagaaacaaagccacataaaccctcgcacctgctcgcccggcgcgcccggtcctcccaacccggtgcacgtagtcggtggtggagcgggggcagtcgtagttgaccacggtgttgacccccgggaagtccatgccgcgccccagcaggtcggtggcgatcagcacccaggtgctgcccctgcggaagctggcgatggcggcgccccgcgcggcatcgctctggtccgaatggatgcagtccacgtgcacgccgtcgaagcgcagctccctgggaagaaaggaaggaacattttggaggagatgaagcagttgctggacgggtatgcgtacgacgagcgccctcttgcgagctgaaggaacctccagagccccagtgccatgcacgcacatggggctcgcctggcgcaagatcccggttccttggtagccccatctaacccccccccaccaccatgatgtatacaagcaacccccctgacctgtgcacctccttggcgcgctcccggctggccacgaagaccaggatgggaggcttgacaccccccgccagcagctggcgcagcgccagcgccttgcccgcttcccggcccacgaactgcagggtctgggtcaccgtggccgaggcgttgccccgctcccccaccgtgatgcgcagggggtcgcgcagcacgctccgcgccatgctttccaccttggagggaggggagggttgggtgtgtgtcgaggctcggggggtccgatggggtcggggggaggggcgagcggcgccggcccccgctccaaggggggatcctctggccgcccgacattcccccctttccccccacgccccaagcaccccggcagcccccgcaccgtctcgggcagggtggcgctgaagagcgcgcgcacgaggtcggggtgtttggccgcggcgagcaccgcatccacctgcggcgtgaagcccatgtcgaagagcttgtccgcctcatccagcaccagggtccgcacctgactcaggtccagccggcggggctgtgtggtatcgggggggtcgcgagatgctggaactcgtgtgccggacaactcgccgggggggtgttgatggggttgacgctccgcgccgccccgcggctcctcgcccctcggcggcgcctgnnnnnnnnnnctcggggggtccgcgagatgctggaactcgtgtgccggacgactcgccgggggggtgttgatgggggggatgctccgcgccgctccgcggctcctcgcccctcggcggcgcctgcccctcggcctcccggccgccagccccctggccctggccgccggcgagcgcggcaaggcgcagcgggttcgccagcagcacgtccacacgcgcaaagtcggtgcccgcggcggtggccttggagagcagcgcggcgcgcaggcccaggcccggcagcagcagggccagcacgcgcgccgactgcgcggtcagctcacgagtggggctgaggaccacggcgcggggccccggcgcggtccccgggcccgcgccggcggggcccagctcgcggcgcatcgcgcgcgcgtgcagcagcaggggcaggaggaaggccagggtcttgccggagccagtgggcgccacggccagcacctcgcgccgggcgagcagggcagggatggcctggcgctggatgggggtgggctccaggaaacccgcgccggccaggttgcgcaggaggcgggagggccgcgggtcgccccccccctccccctcacccgccagctgggcaaaggtgcgcagggggggtgggggcaggctgccggacacgcggatgcggtgcagcttgcggatgacgttggcctcctcgttcgggtcacgcgtgctgacgtggggcaggctgtccaggaaggccggggtggaggcttccgagggggggcctgcaccctcggcgcccccccgggagagacccggccgggctgtggcatccaatgtggcttcatcgtcgcctggggatgcaggtgtgaaggttggaggacgactgtgggcgcgacagcgtgtcaacatcgacatccggccagccgacctgtgcggggtgaatccctcacgagtcgcatcgatgttcctgcttcagccatgtagaaacacaccttcacgatcaattgaagtcttactagtacccttgagccccgagctgccctcgaaaagggcaatgtccttgccgaagcgtctcttgtcaaagttgatgccgaggcccagtgtctggaaaacgtcggccgtatccatggcaggctcaaatatgtgccatacagagtgcaagatacattgcgttgctttggattgcagccgtgattgtcgcggcctggtatgtgcatggctttcatgtatgcaggcgcgcgcgcctgacacagcgcgcaccgcaggcgttcacttctgcaattctcaatgagcccatcaagcacgggatcctgcatacgcaagaagaactcgggtgactgttggaaatcgcgatcacaggtataattgctttgtaatagactgtttgagggctcaccacgccaatcaacctgcaaattggcagctgaaatattgatccactgtggtgcaccacgattccgacgaatggggtattgcttatggatatgcagggccgcaggaatgagggtcnnnnnnnnnntaccggatcctgcatatgcaagaaggactcgggtgattgttggaaatcgcgatcacaggtatgattgttttgtaatagactgtttgagggctcaccatgccaatcaacctgcaaaggggcagctgaagtgttgatccactgtggtgcacagcgattccgacgaatggggtattgcttgtggatatgcagggccgcaggaatgagggtcagtctcggagagaaagcatatcctcccccgttgcaagcccgaccgcagtgtggagtcagactggctccataacagaatggtagcggacagggattctaaaccccggcagtgatgaatttgtcctgaagatggaaaattccaatgtccatcatagctcccggtgcattgtcgccctttgtgatgtgaagctagaatgacaaggatccagcggtcatcatgccactagatggatgctccccatgcacaactctgcgcgcgactcacaccagacgacccacttcaagtcgaccacacatctgcaagcaggtccatctagaaatcgagcatacatcattggattacctttgctcgtccagagagacatcgggaggccgtactgggctaccacggcactatgccgagctgtgccgtggtggggtgctgccctaccctgctcgtcagcccggcattcagatcacgaccacccgttagacacatcctctggcaggatcaagcacatggtcgccacgatgcacgaccatgtcgtcccagcgtcgcagcgtatggcctgttcggctccctcttcgacaggtctgcaccccccctcgccactagcagactactcctcggagtccctcgatgaggtggtgctgcggaagttcacccagtccgatggcacggtgtacaacgtggtgttcaggaagggcggtcccgtggacctggacgacctagaacagctctgcgccaaggtgggtggtggtgtgggatgcaagggttggatgaaggggcagggggttgtggtcaggccccaccacccctcgctgccaccatccaaattcctggccgcagcactcgggccccagcctcaccccaccaccctcctcccccgttccccacacccaggtcggctggccgccccgcccctccgccaaggtgcggatagccctggccaacagcttcatggtggggacgctcacgctggaggccccagacccggggtcccctgccgcgccgcccccccgcctcgtgggcctggcccgcgccacgtcagacggcgtgttcaatgccacgctgtgggacgtggcggtggacccggacctccagaacctgggcctgggcaaggcgctggtggagaccatggtgcgggccctgctgcgcctggacatcaccaacgtcaccctcttcgcggacgcgcacaccatctccttctactccgccctgggcttccagccagacccgcagggcatcaagggcatgttctggttcgtgcaggggcgggaggtggatggggggggaggctgaagcaggatggggtcggtgcacccccgaacagacatgctgtggtcctgggctggatcaaaaggggtgaatcgcccaacactgacaggtatccccgctactgacagcgcacggggggcgcttgcggatgacggcgtggtgacgagggacagggaagggtgctgcggaatggagactgggcaatggacagctgcaaaacccaccaaagccgctgcaagcccatgtgctcggcgcggagcacgcatacctctgtgcatcctgagccctgcagacgcgtcgtggcgcgctctcccggcagtctcccctcgagtgatcctcctttgtaattctggtgaatgggcagatgctgtggaggccgtgctcacggattgcagcgtgcatcattcagcacatacccttgtctgcatgatattcctcccacacactatattacaacgatgctgtgacatggctggtgttgtatcattgccaatttcagctccatgagctggtcctatatcttgcaaggggagtgagggcactgcctggaatcattcgttttgaactgacttgggtgcacctggtacactgaaggatctaagaccacggcatagtatgctacaggcattggagggtagcaccacctcgtctactcgggtacttcattacaacaactcaacataatgacatgtacaataagggagtatgcaaccaggatgcatgcgctgcaacattctcgtgcaggggccattgaatggccactgtgtatgccttgcaaaaggacgcagtgcctcatgccgatagctgcagccgtgtgaggaggtcttggccccacacaccagcgagaatctttccattaaaccccgtttgaccatgcctggggcccaggtnnnnnnnnnngtagctgcagccgtgtgtggaggtcttggtcccacacaccggcgggaatctttccattagaccccgtttgaccatgcctggggcccaggtgaggcctggtggctcacgtctgacatgggcagcgtccggatgcggtcctccacttcgtccatggtcactgcaggattggtgggcgtgtcgtcaggggcagtggcaggtgacgctggagtcctcgctttctcagcaccgaaaacacgttctcagaatcaagggccttggaaagttgggttcacatagtctaacagagactagtgaaagccacttcaacgcattctctccctatcaacccaaacgccccgcccattcccgaaaagcaactcactctggccagccttgacgctgcnnnnnnnnnntaggtgatgttggagtcctcgctttctcagcatcgaaaacacgttctcagaataaagggccttggaaagttgggttcacatagtctaacagagactagcaaaagccacttcaacgcactctctccctatcaacccaaccgccccgcccattccggaaaaggcaactcactctggccagccttgacgctgcgatggcagcccagcagcactccaaacatggctaggtagcccccaactgacaggaaggccagtacagtggcagcggtaaactccctggtgttgctgtcagtccagagcagggctgcgcagaagggttggtgacgtgatgaggcatgtacttccaactctgtgctgtcggtattcgtgcaacacatcgcgatgcccagagctatcaattcttgcaatccctnnnnnnnnnngaggggtggtgacgggatgaggcatgtacttccaactctctgctgtcggtattcgtgcaacacatcgcggtgcccagagctatcaattcttgcaatcccttggccacaatgcagaaagctaatattcctaccccgcaacctccacgtacactgttcaaaggcagcagtccagtgcttgacactggtcagtgtcgttcccgtcagcaataggaagatggcggcccatctgagggaaatgattggagctggcttgaagcgttgatggaagggtattgctgcgcgcaacacatgcccatcaggcaacaaggggaggggcggaggcatgaagaggaatgcttcacttcctaaagatgggcaggtgtccagccttgctcctcacaagactccctcacagcaacttatacagtcatagtgtacccaatgcagctgctactcacaggtagctcgcagtcaggaagcctgtgtgcatggacgggggtatcatgttggcatacgggcgagcgatgcttgaggacctgctggcgtcagcacattagggtgaggctaggctatgctacaccttctacactatgtccttgaatgtgacagcccccgattgcaggacaacaaagtcctactgctgagcaagtctgcaggaaacccagtgcagggtatccttccccaatccagcgagcccaacacttgcagagcagctgcctcaccgtatgagagtccagtcccagacagggcgtaggtcttttttgcgaggatcagcatggctgagaggtccaggacagcgaccagcacgggtgccatgaagcaagccgccagggcgccattcagctgcgcacccaggtcccctgcctcttcattccattgnnnnnnnnnnacgttggtcaggttgacaaaggtgatcagccccacgatcatgaagagtacggagatgacctgcacgggcgagagtgctggttgagccctaggcgtggttagctctgaagggcgggcagggcggcccaactggacccgtttcggtggaggttcctcccatactcgcgcgagaagnnnnnnnnnnaggcagggctgccaaactggacccgtttcgatggaggttcctcccatactcgcgcgagaagcggggaggaggcctgtgctctccagccccgtgggatgagccagaccccgcccatgcatgggatctgagcccatgtaccgtggagataaaccagaagatccaaagggccgtgcgcccgcccaggcgagccatgcttgaaaccttcttggagaaactcctgcacccagcttccggtggtcaagactgcggccagccacgcctgctgtggtcgcgaggatgtttgtaatgtcttagtacactcaatgggggctcgtcgtatgcacagaatgcagatctgggccttaagcttgcacccccatttgtgattccccccgcgcgcgctaagtcaaggccggacacggaccatcacacggaatcgatacaggcgttcctgcaacatccccgcgagcactcgaggactataaatgcgttttcgggtgtagcaccaggcattccccatgtcggtacgggtcgggcacttggtggccgtgctgtgcctggcgctggccatcacctgcatcagccaggaggtcgcgagctccgatctgctcaacgatcatgacctcgatgatagctacgagtgctcagtgatcaagtcggaggtatctcagctggagggggagctcagggccgcccgatcgacggtggcagtactggaggagcgcctggtgtcgcaaaccgagagggatggcgccgaagtgggtgcaaagagggggtcgaggtgactgtgttgtattcgtattccatgtgatgcgtgatttaacaatgtatgcctctggttgagcagccagtggcacgtgtgtggtatgagctgacaacttccatgtgttgggaagggagtccctctgagtgcagcgcgggcatctcccacaagcgtcacctcccatcccccaccacacacccagctgaagaagctgcgccagaagctggtctcagcggccaagagcttgcaggccagcgttgccaaggccgaggcgcaggccggggcgctggtggcctgcgaggcggcctccctccggtgcacaaccgacgccgccgcggcgcgcgagtcactggaagcccggaccgagaagctgcaccgtgcggcgtcggcgtgccgggtgcgcctgaccgacgccactgccgcccaggtggaggcccagagggctctggaaagggcggagaagcggctggaggaggccgggcgggaggtggagggcttccgagccaggtgtgtgccgggtgctggggagggtggcacgggatagagtggtgacgcagtgagaccggagcatgcttgttatggctttgaggggtttcatgaattgtgcagtgggcgcttcgtgatctattcgtccagtcatggcatggaggcctcttggggccctgttgctggattggtcaagatgggagacatacatggtcgtccccttccccgcagaagaacttgggtgctnnnnnnnnnntgggtgctggggagaatggcacggggatagagcggtgacgcagtgagactggagcatgcttgttatggctttgaggggtttcattaattgtgcagtgggcgcttcctgatccgctcgtccagtcatggcatggaggcttcttggggccctgttgctggattggtcaaggtgggagagatgcatggtcctccccttccccgcagaagaacttgggtgctatgccaacggcagacctgacacacatccccctgttcctcaaacatcagcggtgcctccctctcatccttcctttcctccccactcgccacgcacaggctggccatgcacgagcaggacggcagcagcctgctggccctccagcgatcactggacgcagcgctggcggcgcaggcagaggcggagcgcacggcggcggccgcgcaggccgccacggccgccctgctttccacctttgcggcgagggaggagtacgagtccctgcagctgcagcatcgcacgggtgagaagcgggtgtaggcatgggcgctttgcggcgcatgccctggttggccagaccctcggcatggagggccggtgtgcttgccagcggctcacctggcgccgcgccgcgcatccagccccatctcccacccaccgacctacacaccgacttcttcatgcagagctcctgccgcactggctnnnnnnnnnntgtgcatccagcccttctcccacccaccgacctacacaccgacgtcttcatgcagagctcctgccgcactggctccaggtctgggtggaccgagggtccggcgccctgctgcggcacgcccgggagtggcacacggtgggctcccaggtgctcgatcgagaggtgctgcccacggtgcagacggcgcgacgagccctcgtcaagctttgggcgctgcgcgtgctgccgtcgttcgcgcgcgccgacgcggcggtcgccgagcgcctgggcgccggctggccggacgtgaggcggcgcgcggcgcggcgactcgatgaatcacaggccgcgctttccag

SEQ ID NO: 33365 - DNA, 155 bp, Chlorella protothecoides
aaacaaaggccacattggagccgtgatgggaaaccgggcggccccagggcagacaatcaccaaacttgtcgcgattcctgatactatcttttcccaatgcttttgcaaatccttgtgaccaccttggtagcacatgttctgttacaccctcatgc

SEQ ID NO: 33366 - DNA, 85 bp, Chlorella protothecoides
ggtcaagtccctggtcgagaacctgggattgccattcaggagctccgtcagcttctccatcacccaggaagacagacgggggcac

SEQ ID NO: 33367 - DNA, 70 bp, Chlorella protothecoides
aaaggcacccgattgcaccccgacatcctcatcatcgccgagacctgcaaacccacgacaggacgcagcg

SEQ ID NO: 33368 - DNA, 61 bp, Chlorella protothecoides
ggtcatgctgggagccctgctccaggtgctggtcaagggggccaagttctcgctgttcaag

SEQ ID NO: 33369 - DNA, 110 bp, Chlorella protothecoides
tgaccgtccaacccatgcctacaggcccagcactcaagaacattgaaaaagccatcatatatgatcaacccaaacccgattaccttccaaagtcacgctcatgctgtccc

SEQ ID NO: 33370 - DNA, 89 bp, Chlorella protothecoides
ctctgcagctcctccgcctgcttggggaggaagcgagggtggcggaggcctgacattctcttacatgctacggccccacccgggcgtcg

SEQ ID NO: 33371 - DNA, 114 bp, Chlorella protothecoides
tagcttcccagagtcaagcacagcttcttgaacagccttccgttgatacagtgaattagccaaagctgcaaagggggacagaacacatgcggaggattggtttgggaatgctac

SEQ ID NO: 33372 - DNA, 88 bp, Chlorella protothecoides
aagctcatgtacgccgccgcctggctgttcagggccaccggggacgccgcgtatgccaccgacgcctacgccttctggcagtctgccg

SEQ ID NO: 33373 - DNA, 94 bp, Chlorella protothecoides
caacccctccaccaccgccatgtgctgatacccgcctcgccgcccacgctcggacccaacccccaaacctcctcccctcacctcatgcttgccc

SEQ ID NO: 33374 - DNA, 61 bp, Chlorella protothecoides
ggatccttggcgaccccctccccagctcaccccccccgccgggagatcctgcgtgccgata

SEQ ID NO: 33375 - DNA, 117 bp, Chlorella protothecoides
tgagcaggttctgggtaccacatgctgtgatatcccttgcatgttcgggctgcaaactccctcaagtgacttcacccctcaaaaccatctgcacaccatgcagcgcccgagccatca

SEQ ID NO: 33376 - DNA, 77 bp, Chlorella protothecoides
acgccatcaccgactcgggggcaggtgacggaacgcagggcggcgaagagggcgacggaggtgccaaggccgcggac

SEQ ID NO: 33377 - DNA, 67 bp, Chlorella protothecoides
cgttctcaatgctgctggaatgatgtattttttttgggggggggggtcggccatttatggtccacag

SEQ ID NO: 33378 - DNA, 70 bp, Chlorella protothecoides
cccgccgttgcaagtactagaaggatggtatacctgccttgagcctgaggatggctgcctcctaggccgt

SEQ ID NO: 33379 - DNA, 139 bp, Chlorella protothecoides
caggcatccagcaacacagccgatccttgaccgagcacgccagggaccaggaagatgaccgacaaagagttcctgttcaggtggagtccaggcaaagcagcccaggcacacacccatacccaacacacacacacacaca

SEQ ID NO: 33380 - DNA, 74 bp, Chlorella protothecoides
attcccgtgcggtcctgggcgccacaccgggttccatgccggcggtggagccggcatgcgacatgcagcagttc

SEQ ID NO: 33381 - DNA, 117 bp, Chlorella protothecoides
ggtgtaggtctcacctgaggccctcgtcaccgagcgctacacctccggcccctggcccctgcccccaagcacgccagctgaccagggcccaccaccacctcacccccctcctcctgc

SEQ ID NO: 33382 - DNA, 75 bp, Chlorella protothecoides
tgacattgtcgggagcacacacttggcggaccatcgcaccggtagtaatagccatcttcatgtcagggtgcaaaa

SEQ ID NO: 33383 - DNA, 61 bp, Chlorella protothecoides
tggtcccactccatccccgggggatgtcagcactcggatctccatctccgtcatcttttcg

SEQ ID NO: 33384 - DNA, 67 bp, Chlorella protothecoides
aggcgacgacaaagtcatctgtaaacttccgcatggcgtcgctgatgccgcgcatgaaggtggcggg

SEQ ID NO: 33385 - DNA, 61 bp, Chlorella protothecoides
acggcaagaagaagggatgtcagctgctcaaccgccacttgagtcctggacttttagaggc

SEQ ID NO: 33386 - DNA, 115 bp, Chlorella protothecoides
ggtgtcggcgcgccaggccggcccgtcctatctcgtcagctacaccgtgtcccccgtcgatcttgcgccccgcgccgtgatgtctgtcgtgaccccgggcagccacaagcgccgc

SEQ ID NO: 33387 - DNA, 74 bp, Chlorella protothecoides
cgacccgcgacaggagcacctctgtgctggttgtcttgtgggttgggcacctgtgggaagggagtgggggaggg

SEQ ID NO: 33388 - DNA, 79 bp, Chlorella protothecoides
gtacggcgggcgggcgatgcagtgcatgcattggaggccatggaagtcagctgcctgggtccctgcccgaggtgcccca

SEQ ID NO: 33389 - DNA, 126 bp, Chlorella protothecoides
tccagccctaggccctgtggtaataggagacgtgcggcaattcttattatatgtgcgtatgtctgtgcatgtggtgctattcatgggccacgcttcaaagagcagggaatgttggtagcctacgat

SEQ ID NO: 33390 - DNA, 69 bp, Chlorella protothecoides
aaggtcgcgcggtgcgcatggtacagcagggaggatgatgctgcacaaagtcacggcagtgcagcctgg

SEQ ID NO: 33391 - DNA, 61 bp, Chlorella protothecoides
ggttaccttgacatgccgctctttcttctttttctctttcttctccctcttgtcgtcacgg

SEQ ID NO: 33392 - DNA, 140 bp, Chlorella protothecoides
gagggtcatcttctgagcctttgaacccctgtcatgcggacagactgtgattgcaaccccctgagggagcggagggggttgggaggtcgtgctgggcttgcatgtgaaggaaattggcgacgtgaggggatgtggttctg

SEQ ID NO: 33393 - DNA, 117 bp, Chlorella protothecoides
ccttttctcggccctggagcgcgtgttgggaaggaggagagacgggtgagcgtgtgattcttggggccaggtttgtgggtatagggatccttggcgtctttgcctcggtctggaggg

SEQ ID NO: 33394 - DNA, 77 bp, Chlorella protothecoides
tggggaggtgcatcggatactgcacagaatcttgctggattaggagggtcagggcgctgctggctgctattctatgc

SEQ ID NO: 33395 - DNA, 61 bp, Chlorella protothecoides
ggcactaccatactggatggagtccagcgagaaggtccaggcacgatggaagctagcaaga

SEQ ID NO: 33396 - DNA, 77 bp, Chlorella protothecoides
taccatgtgtggtcatcttggtgattgttcagttcaactgcagcgtagttggcggcctggggagccactgtggtatg

SEQ ID NO: 33397 - DNA, 144 bp, Chlorella protothecoides
tgcgagcggggtgggcccccgggtcccctgtttaggctcggaaactgaatgctcctcgaaaggactgtgtctaattcacaagacctaattggtttagtatagaccctcggagctcgctccttcatcgtctggagtattggctaa

SEQ ID NO: 33398 - DNA, 61 bp, Chlorella protothecoides
gggcgtggccgacgtgcgtgcggtgcacggtttcccggtctacacgctgggcggggccagc

SEQ ID NO: 33399 - DNA, 61 bp, Chlorella protothecoides
tcctgatgctgaccaagtgctttattgagattgcacctcgtcccacagcttttggtggacc

SEQ ID NO: 33400 - DNA, 79 bp, Chlorella protothecoides
ggagaggagcttgccgttctgcaccagtactgaccagcttgacatggaatatgcacccccaagtgtccatcttggacat

SEQ ID NO: 33401 - DNA, 101 bp, Chlorella protothecoides
ggtgggggccactcaggcggtctgcagtgccatagtataaagcagcgtcaggaatgcagactaccaggccatcggacaggggcatgctggcaagggcaggg

SEQ ID NO: 33402 - DNA, 77 bp, Chlorella protothecoides
gcgcgaggtgggtttgccgtggccattgccagtgaggggacctgtgcatgtgtgctgagcatcgctttctggacgag

SEQ ID NO: 33403 - DNA, 106 bp, Chlorella protothecoides
gggttgcgcccgtgcctcagtggggtggggttacgccccggaccctcgctgcgggggcaggcacgggaccgtgacgtcggcgcacgggcgggggcgcaggggccga

SEQ ID NO: 33404 - DNA, 61 bp, Chlorella protothecoides
ggccaaggatggcaattgattgggggggggtgctggggatcagagcgcagaggtgtcgcat

SEQ ID NO: 33405 - DNA, 75 bp, Chlorella protothecoides
tgaagtcaggcctggggtggggcaggaggtgcatgcttgggtatgcagcagatgttgatcgcttagaggcagccc

SEQ ID NO: 33406 - DNA, 81 bp, Chlorella protothecoides
gtggcgagggggctcatcaaggcgactgggtgtcacgctggtggagcaggttggaaacgcacacaccaggattggacaagc

SEQ ID NO: 33407 - DNA, 76 bp, Chlorella protothecoides
tctggatttcgaccctccctcaccggtgagtctgtgcggagtggggggatgtgtgtaccgtggccgggtgatgggg

SEQ ID NO: 33408 - DNA, 89 bp, Chlorella protothecoides
gccgtgggcacgtggtgaggaggaaggggggaatgggaagcgccgcgggcgtgtgctgccgcgtgctctgtgtttgggtacgctggagc

SEQ ID NO: 33409 - DNA, 74 bp, Chlorella protothecoides
tgcaggctgcctgggataaggtgaccctttgggataggatcaatagatcggggattggagggatacggagtctg

SEQ ID NO: 33410 - DNA, 73 bp, Chlorella protothecoides
ggtgaagggattgatggagtatatcatgccgatgggagcatcgcacccaaaggccctgtgtgaatgggggggg

SEQ ID NO: 33411 - DNA, 64 bp, Chlorella protothecoides
gggggggggtgtaaggggggaagggtcggtgtgtttatgggggtaagaagatgcatgcaaggga

SEQ ID NO: 33412 - DNA, 61 bp, Chlorella protothecoides
tcacaggtgagaggagagcagtggcggggggtggggtccacaggaagccctgatctttttc

SEQ ID NO: 33413 - DNA, 62 bp, Chlorella protothecoides
gtggtgtcacgatatccaacgtgctcacgcaaatggcactcactgagagacccatgatgtcg

SEQ ID NO: 33414 - DNA, 61 bp, Chlorella protothecoides
gctagaataagggaatggaggacacttgacaatgccgagcaggcctgggcgtggactgaga

SEQ ID NO: 33415 - DNA, 186 bp, Chlorella protothecoides
gcacgccctcctctcatccctgcccaggttgggcgactggggaaacgcggttgaaaatgagggccccaagggcagcactctgcggatcggctcctttcagcactcctgccgcccacactctgtctcgtggaggaacccgcccgcttcattgtcacctcctcaccacccaaccaccacaggctgcag

SEQ ID NO: 33416 - DNA, 86 bp, Chlorella protothecoides
gttcgtaggtgcgagtctcctaccgctgcaggagcgtggagtgggtaaagggaaggtgctgtcgacggaaggagctgaggtgaaga

SEQ ID NO: 33417 - DNA, 80 bp, Chlorella protothecoides
gtcagggcccgtgtgaccagacacctatagtgcgtgaggggggcggagtggaaggggggggggggggggggggggggcgg

SEQ ID NO: 33418 - DNA, 61 bp, Chlorella protothecoides
tttcccctgggcccggcgggccaccaggtccgagagcacccgcaggactgccgtgctctgc

SEQ ID NO: 33419 - DNA, 119 bp, Chlorella protothecoides
gcgaggtgtgggggtgtacacctcccctgggccggtgacctacagtatgcatgtcgagcaaagggtggaaggcgagcagagggcgcacacaggatgcacccagaggcgggcatgcacag

SEQ ID NO: 33420 - DNA, 96 bp, Chlorella protothecoides
ggacccgccgcgaccccggcaggccccccatcctgcccccggccggctcctcgcccacggctgggcagcgggcgcaggggcccctggccagcacgc

SEQ ID NO: 33421 - DNA, 61 bp, Chlorella protothecoides
agtgcgagggtgcatagcgcggctcgacagacccccgccacgccagcaatgcccacgttct

SEQ ID NO: 33422 - DNA, 153 bp, Chlorella protothecoides
ggcatgcacagagggaggggatggtgcaaggcacaaggggcagggtgccagcccaacagtaccctgccgcacagtgccacaccaatccctgccctgcgctggctctgtagcaccaaactcctgccgacctgaatctcatgcgcagggcaggca

SEQ ID NO: 33423 - DNA, 61 bp, Chlorella protothecoides
gctttgggctgcgacgaacggcacctctggagcgaggaaattgggcttgggaggcaggtgg

SEQ ID NO: 33424 - DNA, 103 bp, Chlorella protothecoides
aggagctgtgcttcgtttggcacctggagcaccacctggtaacaggagacaggggaaacgggccgagggcggtcagatgactccaggtcgaagggctcgacat

SEQ ID NO: 33425 - DNA, 118 bp, Chlorella protothecoides
cagcttgtggaaggtctgggattctctggtcggatgcccggccatctgtcacctatatgtggctgagccaggaccccacacacaaccttccaatcccaattatacgagcatttcctcc

SEQ ID NO: 33426 - DNA, 64 bp, Chlorella protothecoides
gcagtacgcggcccccggggccgccgcgtcaccagccgccgcgctggtgccgggcgagatcgcg

SEQ ID NO: 33427 - DNA, 117 bp, Chlorella protothecoides
attcaccatggcgtcagatgggatgcggccacccgttggtagggacgaaatcaagcatcatgtgcagaccccccctataattcccctaaatacacattcatccttgggcaaaacacc

SEQ ID NO: 33428 - DNA, 76 bp, Chlorella protothecoides
agccgttcctctgctggaccaagggccagaagagatccagcctgtggtggtggttcctggcagcccatgagtgcag

SEQ ID NO: 33429 - DNA, 61 bp, Chlorella protothecoides
ctgtggcgacaacgccgggggtcacgaggaagcggtagatgagcagcaacgccacggcacg

SEQ ID NO: 33430 - DNA, 75 bp, Chlorella protothecoides
tccttgcgcttggccagcgccgcccgccgaaccttttcaaggcctcgccgcctattgggaatgccctcgtccttt

SEQ ID NO: 33431 - DNA, 78 bp, Chlorella protothecoides
ttcaacggctgctcacgctccgcctcactcctgactgtgcgcccccagaccgcgtgaacgccgagaacggctgggggg

SEQ ID NO: 33432 - DNA, 143 bp, Chlorella protothecoides
atatcggcgcccccacagctggacgatcgatgggctctgcacctggtgcgctgagccatgggactgtaggggtggggccgtcaagtcttagtctgtactgggcgcgtgtttgtgctaggagacgatatgcactgggacaaaca

SEQ ID NO: 33433 - DNA, 126 bp, Chlorella protothecoides
ggcacggggccctggcaaacggtgtggtgtgttgcagctggggccagggaatgagtggggggaaatgcccggggaagccaaggccactgatgtgccggtcgcgtgtccagctgtgacgggctccag

SEQ ID NO: 33434 - DNA, 113 bp, Chlorella protothecoides
gctctctggactgtcggcgtggcgtgcgacagagaacgcaggcgactcacgcagctggggcgcgtggccgcccgccgctccgcctgcggcggccctggcggcggaccggggtc

SEQ ID NO: 33435 - DNA, 83 bp, Chlorella protothecoides
cagccctcgaagcagcgaaagttgaacaggagggtgaagaatgcccacccgacgtgtacaaatcagtccgtcttcttctcctc

SEQ ID NO: 33436 - DNA, 75 bp, Chlorella protothecoides
aggatggaggtcacgcgcgcctccgtctcgaacgccgcgtgcgaaccgcgcagcgcgttgcgcaggccgtagatg

SEQ ID NO: 33437 - DNA, 61 bp, Chlorella protothecoides
gcccccccacaccttgggactaggttggcgatggtgaacagggcgaacgctgtggcgggca

SEQ ID NO: 33438 - DNA, 139 bp, Chlorella protothecoides
aacaggcgccaggccggcggctgcccgggcaaaggggggtccggggcacccgagagacggccagagggcgagggctgacccacaggcggggactggccggcgccggccagctgggtatcgcaggcgatgcttgcgcact

SEQ ID NO: 33439 - DNA, 61 bp, Chlorella protothecoides
tggacattgtcttcccattctctgcctccaatttcaggcaacaccgcacctccggtgtcac

SEQ ID NO: 33440 - DNA, 234 bp, Chlorella protothecoides
gcagcgcacctctgttacgggcccaggcaccctggcaggcagcgggacggaggcgatgccgaggtacgatggccgcgcggcagcctcctgtcaggggggaaggggatggaatggaatcgagggaacggcataggagggtgtggcagtccacatgctccccgcatgagatcgagagtcatgaccccagagcctctgcaaggacgacccccgccccttgccatccacggccacaag

SEQ ID NO: 33441 - DNA, 73 bp, Chlorella protothecoides
cacgcatgtatttgagggaggcagagagggagattgtgaggcgggcaaccaatggtccactcctcctgccctg

SEQ ID NO: 33442 - DNA, 100 bp, Chlorella protothecoides
gacaaggggttttgccatgggatcgggggggtgggaagtgggcccaggactgtgccagtaaaagcaaggtcagcaccacccacctcgattcctgcgctgt

SEQ ID NO: 33443 - DNA, 72 bp, Chlorella protothecoides
gtgttgcagggcgtgcgcactcgactcagcacacgcctcgccggctgcgtgagatgtgttgaaaatgctctc

SEQ ID NO: 33444 - DNA, 4004 bp, Chlorella protothecoides
  modified_base (301)..(310): a, c, t, g, unknown or other
  modified_base (1289)..(1298): a, c, t, g, unknown or other
  modified_base (1551)..(1564): a, c, t, g, unknown or other
  modified_base (2369)..(2378): a, c, t, g, unknown or other
  modified_base (2818)..(2827): a, c, t, g, unknown or other
  modified_base (3052)..(3061): a, c, t, g, unknown or other
  modified_base (3234)..(3243): a, c, t, g, unknown or other
gcggtggcgcacatccgggcgccctgggagtgagggtgccctggcggtgggtggggccgggtagacgactcagcctcgggatgtaccgtctcgagagcatgtagaatgcacgcatcaaaccctggcgtccctgtactgattcagcaccccctgaatgaaccatctgcaaagtagccatgtttcaggatgttgggaatgccatcctccattcgcttggaacgtgctatccgcctccctcccaaatgacctgaaccatattcatcccacttgatcctctctgtgcctgtcgggtcacccactnnnnnnnnnngacatgctatcagcctccctcccaaattaccggaaccatattcatcccactcaatcctctctgtgcctgtcgggtcacccactgtaatgaaatgaatactcaatgctgccagctgagcgaaccgtcctctgtcctggaagggcctttacacggtgaacaagggtgcctgctcagcaccccacacagcaaaggcccggccctctcatcccagccgcgtcactccttgctggtgatgacaaagaggcccagagccgcgatgagcagcactttgacaatggggtagtcattcatgatgatggtcacctggcctatgtagggcaggtagccaatcacacggcccatgatgtggtgcctgcccagccaccgcacgccccggggatacagcgaccgatcgtcgccccagttgttgtcaccctggggattgattgttgggatttggggggaattggggcgacgaaatggagggggacatcgcgaggctgcatggcattcgaaaaggatgagcgtggcatagcagcccaaatgagggagtggccctggtactcaaggagcaccccgcttcatgcctccagccctcgtgacaccagcatggcagagcatctcagattcaccgtgccgacccacaccttggtgaggatgtcgacggcgctgatgttgttgtgccgctcgtgcaccttgatgatgcggtggacgatggggatttcgcggtccccggcgttgaacacgatgatgtttccggtttcgatggggcccttgggctggtccaggaacaggatgtcgcccctgtagaatcccggctccatgctcccgctcagcaccaccacaatctgctcgaggaggtgccgggagggtggtggggggtggaccgccggggaacggagcggtggagagggcaccttggggatcatcctgagtgcacccccctccacatgtggctatgcctggcaggtgcccagcctcacccctgccctttgggccnnnnnnnnnngggtgccgggagggtgctggggagtggaccgccagggaacggagcggtggagagggcaccgtggggatcatcctaagagcacccccctccaaatgtggctatgcctggcatgtgcccagcctcacccctgccctctgggcctcaccggagactcgctgccagtgacaaggacaaggaacttccagatcatgagggcagatgtgatgatgaggcctgcaggatgggggtgggtgggagcagcctggaggagttnnnnnnnnnnnnnncttgtagcaggagctgcctcttctgcatcttcttcacctcggccacagccgatcgtattagttgcatcacggagcggtggttgggtgaccactcccaccagcgcctgcccttgcccacagaagccttgttaccctgccagcagcacagatgctgaaaaaactacgtatcgtatggcacctgtatataaacttcaatcgctgggagcgccagtctcttcatattaacgagtcctcgattttgatgcgcgagcgcgtgtgatggtgagctggcagcgatcgatgtccatgccctccgacatcacctatatgaatgcccctccatggcagcgcatcgtaccacccactcctcgccatgggcatcccaggattcaattcctgggtcaggaaggagtaccctgaggctttcgtccctttcgagcggggcaggagggtggaccacctgtacgtggacctggcctccaccctccacacggtgctccgcaagtcccgcacccctgcacagctgcatcgccgcctgcacaaccgcctcgacaactatctagccagattgcgtccatgcaagagggtggtgctggccctggatgggcccgggccccttgcaaagctcctggagcagaggtcagatcgctgggatggggtggcctgggatcaggactgtggcgtgctggtgaggccctgaacgattggcttgttgggaatgccaggcatttgaggtgaccactcatgaaattggtaaggatcagcccagcgctcacgctgtcccagccctcctggcccctcccccatcccgcacaggcggcgcagnnnnnnnnnnagccaggcatttgaggtgaacactcctgaagttggtaaggatcagcccagcgctcatgctgtcccagccctcctgccccctcccccatcccgcacaggcggcgcaggtccaagatgaaggtcgcgcccgaggtgcctgaggccggtgaacctggcagcgaggcctccctgtcccccctggccctcaccgcgggcacgcccttcatgctcagcgtgcacgcctccctcctgatctacattgcgcggcggctggccaacccacgcaatcggggcctcgtcttcgagttctccgactccacagtccaggtgagggatttgaatggttgatacccgggacatgttgcatgcttgcaggatcagaggagagctcctgttttaagcaatggatgctccacagtaggtttggagcgggggggtattctgctcctgtgctctgggcannnnnnnnnnctacccgggacatgttgcatgcttgcaagatcagagaagagctcctgtttaaggactggatgctccacagtaggtttaaagcaggggggtattctgctcctgtgctctgggcaggatgtcttctcacaggctggcgatgcatctgattcttgatcatctcaccatgctgtttcgatcggatactgcgtgtctgtcttgcctgctctgcgatggcgaggggcccgnnnnnnnnnnagatgtctcctcacaggctggcgatgcatctgaatcttgatcatctcaccatgctgttttgattggatactgcgtgtctgccttgcctgctctgcgatggcgaggggcccgccatccatccctctcgcaagtaccccctcctccagccccccccccccccccccccccccccnnnnnnnnnncccatccctctcgcaagccccccctcctccacacttccccccaccttgccattcagggcgagggcgagctgaagttgctggccaagctgcaggaccagggtggcgggcgcggcgcccccaccccgggcgacacccacgtgatcctgggcggggacagcgacctgtacctgatcgcgctggtggcgccgcgcccgtccgtcttcatcgcagccgacgccgacatcccgcacctgggggcgccggcggaccagctcaccgtcttctcccgcgccgcgctggccaacgtctgggggccccacgccgatgtggcgcggctgggcctggacctgtgcctgctggcagtgctgacctccggcaatgactacctgcccgccatccaggcgagcctgggttgggtagggggaaaccaggagcgggttcgactctggaccgaccaagggtcccgccccgcagcccggtccgctgtcacgcccacatgcctgcgcatcggtgcaccacccctccatcgacacatccacaacccacctcaagacagggcctggtgctgaaagggggcgaccggcccggactctgggacctgctgctggacctgcgacgccggcgctcggccgtcggcccctgccacctcgcgcggcgcggccgctccggcgcgctgaggctggaccgcgcgaccctggccgccctgctctggcgctcctaccagcagcgcgtcctggccggcgggccgacgcggagcgcggcgcgcgcggcgcgcccggcgg

SEQ ID NO: 33445 - DNA, 61 bp, Chlorella protothecoides
cgagggcccctccttcacggtcaaggggtctgccgtggagtggcagaactggagcttccag

SEQ ID NO: 33446 - DNA, 61 bp, Chlorella protothecoides
agatgaagagacattcgacagtctagggaaaccaatgcacaagccataggacacttctgct

SEQ ID NO: 33447 - DNA, 73 bp, Chlorella protothecoides
gacattgcgctgatcagccgaccgtcgcagaaatctgtgcgctcgcaaatcactactcctcctctccttacaa

SEQ ID NO: 33448 - DNA, 78 bp, Chlorella protothecoides
ccgcacaacgtctgtcggcagcagccgatcaaacaggccttgtctccccacgcccgcgccccattcccacaggcctca

SEQ ID NO: 33449 - DNA, 64 bp, Chlorella protothecoides
ccatttgccggcgcatgacatgccagtgcccccccacacaccttggacagggaggctgggccga

SEQ ID NO: 33450 - DNA, 62 bp, Chlorella protothecoides
attgcactgggaagcgcgacgaaagtggagtcgcatgtggcctgcggggggcgggaatgctg

SEQ ID NO: 33451 - DNA, 69 bp, Chlorella protothecoides
cactccagcaccggggtgagccggcgtgtgctagtgcttgggaagtgatcatgattgctggtggccagc

SEQ ID NO: 33452 - DNA, 77 bp, Chlorella protothecoides
ccgcccttggcatcgcctgccgcctccatttccttaaaaatcctcgtttgctatcgcattgtctcacccagggcggc

SEQ ID NO: 33453 - DNA, 87 bp, Chlorella protothecoides
gcatcgttggaccacaggattgatcactcagtcgtggggcccttggacaaaatgttgggagcctctcgcagaatacagcgcgccctg

SEQ ID NO: 33454 - DNA, 106 bp, Chlorella protothecoides
ggtgatcgggggacccaggcagctggggcagtgggaggccgctgcagcactgcccatgacctggcaacagggcgacgtctgggcggcctccctcgcatggtgcgcc

SEQ ID NO: 33455 - DNA, 64 bp, Chlorella protothecoides
ttgccgcggcagtgttgcacccaagcaccccatttgccccccgcttccaagcccctttgcgctg

SEQ ID NO: 33456 - DNA, 61 bp, Chlorella protothecoides
cctagccactagacgaaagtgactgttttttaatgtcacttccgggaattgaacccgggtt

SEQ ID NO: 33457 - DNA, 80 bp, Chlorella protothecoides
gggcgtgggaaggcagtgggatcgccgttgaagcatgaaggtgggcacccggcgccccggccctccaccctgtcgagcgc

SEQ ID NO: 33458 - DNA, 143 bp, Chlorella protothecoides
gtcgcgcgtggcagcctgcgcgtgcatcagcgcctcgcccctgcacggcatgggagggggagagagagttgtgtctgcgatggtgtctgtttgtatggggaagggcacccaataaccaccactttccccgtacctggcggtgg

SEQ ID NO: 33459 - DNA, 61 bp, Chlorella protothecoides
gcagaccgccgacgtggtgcaggagctgcgcctgctggaggtggaccctgggtccagcgtg

SEQ ID NO: 33460 - DNA, 114 bp, Chlorella protothecoides
ctgcagacgcaactcactcctgtcggtggccgcgctgggacgagacagggatgatgagaaaccaagtgggtggagatggactgcgcggtagtatgagcatggccatcaccctca

SEQ ID NO: 33461 - DNA, 91 bp, Chlorella protothecoides
tgtcacgagagtctcagcctggatcatgggagactgttctctcccttcccacctacaggacctggccagctggcttcaggtcaatgctgct

SEQ ID NO: 33462 - DNA, 77 bp, Chlorella protothecoides
atcgaactcagggtgctcctgcgtgagattgtggtgcagggcgaggttgcgtggcctggtctctgcagacaatgcat

SEQ ID NO: 33463 - DNA, 61 bp, Chlorella protothecoides
ctacaaacctcccaagctgagcgagtgcgcccccctcttccagtcggtaagggtgaggttg

SEQ ID NO: 33464 - DNA, 142 bp, Chlorella protothecoides
cgtcactcaccagggcaggcgcctgagctcccaatcccacgcgcattgctctcgagcccagtcagaggcgtccaaatggtcaataaggctgaactggtcaaagtgtggcgttgtcagatgtgtgtgctctgcatcgccgggg

SEQ ID NO: 33465 - DNA, 85 bp, Chlorella protothecoides
ggacttgtgtacaaatgtggtgacgatgcccagcagccagggcgggagtacgtagtagcaacagaggaacagtggagttgaaaaa

SEQ ID NO: 33466 - DNA, 136 bp, Chlorella protothecoides
tcccatctttcctccataccacaagagtggtacaaacataccaccgccggtcattggtgtcctcggcgagggcatgaccatgcagccaagtgccaaaaatgcaagctaacagccacacgctctaccggctgagcta

SEQ ID NO: 33467 - DNA, 61 bp, Chlorella protothecoides
ggaatgtccacagtcaagctggcctccatcgagcagctcctgcgcgcaggcgttgcgcttc

SEQ ID NO: 33468 - DNA, 61 bp, Chlorella protothecoides
cttccatcccacttctggtttgcttaaacccccccccccctcccccccacaacacacacac

SEQ ID NO: 33469 - DNA, 202 bp, Chlorella protothecoides
ccagttgtccccggcactgggcacccaggcgtcgcagagtcggcaccgcaggcccctgaggtcaggggtcgggtggggtttgacatgggagatgaagcaacgaggaagggtacctggaagtatccccctgaatagcgagatgaaccagccataatgcccagcagtgccccacactcccactcacgcccagtctcaagcactc

SEQ ID NO: 33470 - DNA, 70 bp, Chlorella protothecoides
ggatgggtggggctgcctggatgttgtatggaatgaaaagggggcaagggcttgcatgccatgcagcgac

SEQ ID NO: 33471 - DNA, 109 bp, Chlorella protothecoides
ccgcagcggcggcaggtcgccccgcaccgctgccgccgcggcggcgcgggcggcggcacaccctgcggcggcgctgccagggggaaagggcgaccagcctgcgtccgcg

SEQ ID NO: 33472 - DNA, 520 bp, Chlorella protothecoides
gtcggccaggctgcccgtgctctgccggcgcgagggcccggcgccgcgccgcgccgcgccacgcgccggcagcgtcaggtccgcgatggagaggagggaggccaggtcgcgcgcgtgcgcagcaccgtggaagccgtaggccgcgtcgccggcgtaggcgcccagcacgtccgcgcccccgcgtgcaaaggccaccgcggtgaccgagccgccggcgggggagcgctgcgccgagcgggccgagcccagcaggcccgccttgaggtgggagggcacgtaggccgcgacccagggggccgccgtcgcggcggggggtcgggccatgcgcatgtcgtacagccggatggccgggtcggagcctgcgaccgccgggcgaggatggacgagggtgtggttttcatgggtgggccggctgggcggacggctggccatgcaggtgtctgcaccaagtttccaaggaatctgagagccccggctggagccccagccgccagccaagtccggcccatgttccccccca

SEQ ID NO: 33473 - DNA, 68 bp, Chlorella protothecoides
acgcctctgcaggcgggacccccctccagaagatgccaagatacaccagtacatcggcatcgacccgg

SEQ ID NO: 33474 - DNA, 61 bp, Chlorella protothecoides
attgaggacttacacaacgcggtaatggtcgttcatgcgttttgggatgctgaaatgttcc

SEQ ID NO: 33475 - DNA, 78 bp, Chlorella protothecoides
acctggaacggcttccgggaccttcccaagaaaaagaagaaggagaagaagaagaagaaggagatgaagaagaaggcg

SEQ ID NO: 33476 - DNA, 76 bp, Chlorella protothecoides
ccacctggcgaaaaatatctcgtcgagtggttgcagcgccgcatcagcgtccgcccggccagcctgcttccaccgc

SEQ ID NO: 33477 - DNA, 61 bp, Chlorella protothecoides
ttggccgccagggatccctgggaggggtggagcgaacgagtttgtgtgagggccgcatgca

SEQ ID NO: 33478 - DNA, 93 bp, Chlorella protothecoides
cgcagcgataccagcctcttgcatgcccgatcatttgagcccctgcgcccgatccatactgctcctgagggcgccttcccgcccatacagatg

SEQ ID NO: 33479 - DNA, 61 bp, Chlorella protothecoides
acgcctgtggagcacaggttacacggcaggtggtgagaattggcgccagtactggctctct

SEQ ID NO: 33480 - DNA, 80 bp, Chlorella protothecoides
agatgatacagtggcaggacatgcaccgccattgaggcactgggtggctgtgagcgtgcccactcgcccgggaatgagct

SEQ ID NO: 33481 - DNA, 112 bp, Chlorella protothecoides
aacagtgagccgctgggcggggctcggtggcggcatgcgagggggtgccccatgggtcatgatgtgggggtcttttccgacaccctgtgcgcgcagttggagcgagttgcgc

SEQ ID NO: 33482 - DNA, 74 bp, Chlorella protothecoides
ggtgaggagcggtcctgctgcaggcatgtgcacatccctcgtttctcaagcggcacgcctcacctggaagaggt

SEQ ID NO: 33483 - DNA, 68 bp, Chlorella protothecoides
acttcatcgtgccctcccggtgcgagaaggaggtggaggggtgaagaaggggcgggattggtgccgca

SEQ ID NO: 33484 - DNA, 168 bp, Chlorella protothecoides
gtgacaggccaagtacctcctgggttggtgcatggttgggttgcgctatcagttcacaagataccatgatgatcctgtgctccttgacccgttcccatccatggcagccatgacctcgcaggtctgaccaagttctgtgactttataacacagcagcagctgcagacg

SEQ ID NO: 33485 - DNA, 64 bp, Chlorella protothecoides
tgtggcaccaccaacagctcaacctccatcaccccccccttccccaccaagccaagtccttccc

SEQ ID NO: 33486 - DNA, 67 bp, Chlorella protothecoides
gaagaaatctccaggcggccgtcgggacattgtggttccaacacctggatgccgccgcctgcagcgc

SEQ ID NO: 33487 - DNA, 74 bp, Chlorella protothecoides
gctcgccatcggctgagtccgcgccgccctcctccccgctctcctcgctggaggcatcggaggccgcgccctcg

SEQ ID NO: 33488 - DNA, 73 bp, Chlorella protothecoides
caaataatggacaattctcaagtgcttgtgcacactgcaaacaggcattgcatgaaggcagctcgcactgtcg

SEQ ID NO: 33489 - DNA, 121 bp, Chlorella protothecoides
agcgctcgcgcactggagtcctggccgcctccaccagggcacggcccccctgcctggaatgccctgcctggaatgccctgcctggaacgcctgagggtcgctgcaacccccccgggctcca

SEQ ID NO: 33490 - DNA, 110 bp, Chlorella protothecoides
ccaacaagctgtccaagatgtgagcactaactcgttggctggggtgtggctacctcgatggatttcagagggcaatccttactggcagactgttcgtgcctcagaggttc

SEQ ID NO: 33491 - DNA, 61 bp, Chlorella protothecoides
agccaccacagcaccgacccaaccaaccccacctgccagtggctcgctgttgtcgtcctgc

SEQ ID NO: 33492 - DNA, 61 bp, Chlorella protothecoides
ccagctggacgtcctggagatcatgtaccgctgcctcagggcaaatgccaagtgtgctgag

SEQ ID NO: 33493 - DNA, 61 bp, Chlorella protothecoides
acattcactcccaggtgggtccgcgccaggcagcacatgcggctttgatgtgtgagggtag

SEQ ID NO: 33494 - DNA, 62 bp, Chlorella protothecoides
gtttgcccccgctactcgaaccctcggaggcaccttcaccacggccgacatattggttgccg

SEQ ID NO: 33495 - DNA, 61 bp, Chlorella protothecoides
ggggtccgcctccgggtcctggcgcagggcacaggtcaggagggccaccagggccacatcg

SEQ ID NO: 33496 - DNA, 175 bp, Chlorella protothecoides
gcctgtgcgcatggacccctggacccggaattctcatccccaaaaccttggggacacaccttgccacactgcaagatgtcttgttagcttgacgatcgtacatgttatactatgcagcagtgcatcgggctactgtacagggcacgcgcgggcctcgcatcgacgacgaggatct

SEQ ID NO: 33497 - DNA, 492 bp, Chlorella protothecoides
  modified_base (118)..(352): a, c, t, g, unknown or other
agagtctgtaaatctgctggcacatgggcaggcctcctcctcgtttccttgcttatgaagattccctccccgccctgaatcctcacaccacccctcttcccccgaaacacgtagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgaaggggtagggtttgggagcgaaatgttgtgcatggagtacaagagatattgagctgtcggacggggggttcagccacccttcaagtacaggcgctaagacactggcaacatgcctggggtgctgagtgctggaca

SEQ ID NO: 33498 - DNA, 77 bp, Chlorella protothecoides
gtacagccatgcagcatgacctcctctggccggccgtgctgatcatcatgcgagtcgaagatatgtcgctaccgggc

SEQ ID NO: 33499 - DNA, 1360 bp, Chlorella protothecoides
  modified_base (918)..(927): a, c, t, g, unknown or other
ccccgccgccggcgcgcggcgacctgcggcggttggtcaccgacggcggggagggcggcggcgcggcgcgcgacctgcctgcccagcgccacgtggctccgggcagcctggagctgctgtcctaccccgtccccgcctggtcgtccgccggggggggcccagggaacgacagcgtgaccgcgtcacgcagcagggcctatggcgtgcgcctgcgggtggccggctccggctggaccccgccgctggcgctggaggccggcgccgctggtgccagtccaggcggcgacgactcccccctggacggcctggagccggtgctggtccaggcgcgagtgcgtgagtttggcgtgacgcacgaggtggtggcgcggctggaggtggcgccccatgccggctcccagatcctgcgcctggagccccacgtcgtggtcagcaaccgcacgccgctggacgtgtcactgctgcactgcgcgggcctggtggagcgcgtggctgagcgcggcggcgcagaggtctcggccgtgatcctcccgcgcggcgcctccagcttctcggcggcccccaccacgcgctcgggtcagggcgcggcgctgcgtgcgggcccaggcccgcgcctggtcaggccctccgccggactgttcgtcggcgacggcggcgacaggggtgcaggcggcgtgcagaccagcgccggcccggaccctctcgccgcccccgcgccgccgcggctgatggcgacgggcgcgctggtgagcatgcacgccgcggcgccggcgctggtgttgcccgcgggggcctgcgcggtgccgctgcacctgcccctggcctcgcgccggcacgaggtgtgcctgcgcctgggcggaggtgtgacccgcgacggccccgcgctttggagccggccgctgacgctgcgctacccgnnnnnnnnnnggttgggccccgcgacggccccgcgctgtggagccggccgctgacgctgcgctacccggcggaggagacgctgcacgtgctggcaccctgcgcggcagccggcgacggcgacgcgcgcgtggcgttgctgcgcctcagcatatcgcgccgcgcgccgggcgccctcctggtggtgctggagtcggcgggcggcgacccgccctacagcgtcgagaaccggagccgtgtggcgctgcagtaccgccaggcgcacgtcccgggcgcgcccttccacgagctggcccccttctcggccacgggctgggcctgggagcacacgctggcgggggcggcgtaccgcctggagctgcaggagggcgcgggcgaggcgcgggcctacgcgctggacgccggcgcgggcgtggcgggcgagggcggcggcgcggcggccctg

SEQ ID NO: 33500 - DNA, 232 bp, Chlorella protothecoides
aggaagagcagggcgaccttgggtatgcccagcgcctgtgaccgggaatggcatgggtgggggtactggtcttgggagaagaggatctgggccaggatactgttattggccggaagcaaagggacgggctggtttttgtcagccagcgtcgaggccgctgcatggggattgcaggcagtctcaaggagcaaggcagtcttcaattgtacggacgcgcagagtgacaccatgc

SEQ ID NO: 33501 - DNA, 156 bp, Chlorella protothecoides
cgtataggatgccgccgacatgtgggagtaaataccacgcatgcgcagaatctgggaaagcgggtttaatttccatgacattcgcgatcaccagagtggttttgagctgtaaagagcaacgatctggatcgcaatgcacggaccaccgcgcgcgcg

SEQ ID NO: 33502 - DNA, 61 bp, Chlorella protothecoides
ggacatcttatgttgaaccgcctgcggcggggtgcaggcaacaccgcctcccatacctgat

SEQ ID NO: 33503 - DNA, 111 bp, Chlorella protothecoides
tgcttggtacaataggtcaccttcttgatgcatcccgaacgtggctggtgccaggtatctactcaaaccccctctcatcccaaaatctatacattcagaggcacgctggaa

SEQ ID NO: 33504 - DNA, 101 bp, Chlorella protothecoides
gggcagcatccctgtctgagatggtgcagttctgcgcctggcaccgattaggagcgacactcagagagtggaattgatccgaatgatgcctcctctgtgaa

SEQ ID NO: 33505 - DNA, 70 bp, Chlorella protothecoides
atgcatgcattgcagctaccaaacaagcctcaaacagcatgcatgcatgcatgcatgtgtgcactggaca

SEQ ID NO: 33506 - DNA, 899 bp, Chlorella protothecoides
  modified_base (108)..(181): a, c, t, g, unknown or other
acgccgcacttcggcaggagggcgtggcggtgggcgcgcgccgtgcgcggcgcctgtccctggagcgcgccgcgacgctggagggctgggcggcgggggccggcccgnnnnnnnnnnnnnnnnnnnnnnnnnnnnnnnnnnnnnnnnnnnnnnnnnnnnnnnnnnnnnnnnnnnnnnnnnncggtcggcctgtccagcatggatgcgccgtccgtgggtgccgcagcctcgccgtccgtgggtgtcgcggccttgccatccttggccgcgggcctgcctccgctgtccgtgcctaaagctgcttcccctggggacgaggggcacgacagggtgggcccgttgtccgcgcacgtctccccgcgccccgccgcccgcccacccatgcagcaggcgcagcaggcgcagccgcagcaggtgcagcaggcgcagccgcagccgccgcaggagcccgctggccccgccgggcccgcagactcgcgcggtcgcgcgccgctggggctcaacctcccgccccagcaccgcttccgggagcgttcggaggacgtgtttgccagccgcttcagctccatgccgggcattcgccccaagcgcacagcttcggtggagcagcgcatcggccgcatctcctcctcctctgacacgcgcgagacgcccatggggctcgactcccgagaccccgcccgccagtggcacctgttcaccagtgagtttggggacggcgtgtgcatgtttgtgtgtgtgtgttgaggtggggaggggaaactggcggcatgcgcgcgcagtccctgccgcccctcgctcacttggcacccactcttcatccaccatgaagcaccctgcccgccatggcctccctccctcccgcacctgtcaccctcccccccccccccccccccccc

SEQ ID NO: 33507 - DNA, 146 bp, Chlorella protothecoides
gagccacaaatcgtgtcggaggccagtctggagggtcataacacacccgtaccgaccttgtctccatggctttcgagctggaccttcccagcagcagcagtccccagcaggctggattactaaactccatgcacggcgctgcgcgc

SEQ ID NO: 33508 - DNA, 61 bp, Chlorella protothecoides
ggtcagccattcgctcttcacgctcagcctacccaggtgcatgccggagatggccacctgc

SEQ ID NO: 33509 - DNA, 532 bp, Chlorella protothecoides
taaccctaaccctaaccctaaccctaagccctcacccacagcctccacaatggccacatcccacaagcatctggacagtggcagggaggggagggggaggggaggttgggatgggggttggaggttgggaaggggggatggactctgcactctggtcagggccaagccccctccctcccccccttgctttgcacccaaggcgtgacacctggacccaacatcacaatggtatctgccctggtccagctcaagggctcaccccccaccccagcccaacttcttgcccactcacctgtggtcaggggggtctgccactgccaccaccagccgcaccacatacgttcccctcggtcctggggcacagaagatgggcaagcaggcggtcttcctctgtatcatgggcaagagcttgggcttgccctccctccggatccagctcccctcccgggacttcttgacgctccatgggtgtatgatactcagccgcctacattgggcggggggtgggaggggaggggaggggtgttggggg

SEQ ID NO: 33510 - DNA, 90 bp, Chlorella protothecoides
cacaggtctgcgaggcatgggccccgaccctcgcccccaccgcatgcaccgttggcccgtgcacctgcttgcctgagcagggaatgctga

SEQ ID NO: 33511 - DNA, 84 bp, Chlorella protothecoides
ctgtgcgaggggcgggcgccggtggatggcggcggccgcggcccacgagccggagcccgcccgggctccggctccggtgcgctg

SEQ ID NO: 33512 - DNA, 169 bp, Chlorella protothecoides
acaggttccctgggaagatctgcaatacctctttggcgagatcatctatggtggacatattgtggagggctgggataggtgagagggaagggtgtgcatcttccaggaatgcagcagtgccctgagcaaaacatctcatgcagagtgcagcagacacagaaagggagga

SEQ ID NO: 33513 - DNA, 78 bp, Chlorella protothecoides
ctgacgagccggggcgcggcccggggtcaacaaccctgcagcgcgcaccctgacccctgttaacgggtgcccccggcc

SEQ ID NO: 33514 - DNA, 61 bp, Chlorella protothecoides
gccctctcagagctcttcgtatgccaggccaccctgcacagccgtcgatgaccatgcaagc

SEQ ID NO: 33515 - DNA, 8286 bp, Chlorella protothecoides
  modified_base (1170)..(1179): a, c, t, g, unknown or other
  modified_base (1797)..(1839): a, c, t, g, unknown or other
  modified_base (4967)..(4976): a, c, t, g, unknown or other
  modified_base (5207)..(5216): a, c, t, g, unknown or other
  modified_base (6483)..(6492): a, c, t, g, unknown or other
  modified_base (7238)..(7286): a, c, t, g, unknown or other
  modified_base (7788)..(7797): a, c, t, g, unknown or other
ctggcggcggccgcccgcggcgcgctgccctcgccctggggcgcgctcaccgccctcatgctcgccagcttcctgcgcagcgtggtggagcagtttgcgcagtcctacgtcgcggagcgggaccgtgccgcgctccaggcgctggtggatcgcatggtgagggagcaggggggcgacgaccaggcggcagaccaggagtagggttctcgaggggcctcggccgcagaggtcgtggcaaggcgggatcgccaggtccacagacggagcgcaccccactctgcagcgcggccgcgtccttgggcaccgcgcgatgcctgccactccctgcaaggctgctgcgtgaaatctggaccgcggcagggcttttgtggtgcgcctgcttccactttggggacccccacccatccatgggcatccctctttggcgccatttgcctaagaattcctgccgaccctttctcccctctcttgctgggcgcagcaaacaatgacacacgtgtttgccaccaccttcttggttgctcgctgtgaccctggggcatgccgtgcgagcgcacatggattcacagtccacagggggtctcgaaggaggtcacacaggcggtcggtgtgtcacatacagcccagggaaaggctcgtgcccgccgccgaatgtgcgagtgcaggcattcaccacgaatcactcctcggctgcatcctcggcgcgcagcgtgagcggcaggatgaggacgccgttccgtgctttcccgtcgcgcccccaccgccccatgcgcggctcttggcccatgccggcggccacaaagcgcccgctccgcgcgacggccaggccgttgacaaagccacgcgcggggagcccgcccagctggctgaggcccttggtccccttggtgcccttgtccaggctccacaggcgaaccaggccgtccccggctccagttgcctgaggggggaaggagaacaaggggggaaattcgtacgagtcttgagagccatgacacggggcaatcaggtgccgatcacagagggatcactcgcatgggtcagggtccgaaaggccagcaagtgtctatcacacatcatcggcagaccgcatgcagcgtcatccacccctccacaaccacacagggctcctgattccccgcactcggtacccaccacaaggtccgaagnnnnnnnnnntaaccacacagggctcctgattcctcgcactcggtacccaccacaaggtccgaagcggggcagacggcgacggacaggacccccgccgccgcattccccccgatgctgcccaggggactggcgtctgcctccgcgctgtgcgcggcacggatgctctgcagcggtttcttgcgcgccgcgctccagaggcccagcgcgccgtctgccgcgccggtcacccattcgccgcccttggtgaaggcgcagctctcgatcacagggtggtagccgcggaagataagctgcgtctcctccgggatcttccacaggcggcaggtgcggtcgccgccgacggagagcacgcgctccgtgcgcagcgcgtccagggccagcacctgagccattggttgggagggcaggggggggggtgggtgtcaggtacggacttaggtgccctgcaggtcccatgcatcaacttcatcctgcaattgccataacctgcatctcctggccccaaatattgctcaattgaccctcaaccccaaagtttgggtgcacaggcttaccaatgcaggccatccaacgtaggaagcacccctgctgcgccttccccccccctccccctccccccctgcctcnnnnnnnnnnnnnnnnnnnnnnnnnnnnnnnnnnnnnnnnnnncctgacctctgcctggtggccgaagagggagtcgacataggccatgtcgtccaggctccacagcttcacggatcggtccagcgacccggagaagagctcatgcgtgcccaggcggaaggcgagcgcggtgaccgcgtccttgtgcccggggaaggacttgatgggtgccaggccggcgcgggtgtcccagacgtgcaccacacgggagccgccgcccgccgcaacgtacacgccgtctgaggaaaccgcgcacgcgagcagcgcagcgcggctggtctggcgggcgccgggcacgacccagtgggcggcgggggcaccgctggggccagccgccgcgccggaggacatgcgctccctgtttgtggggaggagatggggggggggaagaaggatgaggcaagggcttcgatgctgtagtttgccatggcatgcaggctggcatcgggcactggcatgcatgccggcccttatcatagatcgtggagatcataccagtgaaggccggattgctccgagtccaaatttcaagggaatgaacgatatcccaaaccccagctggtgcaacatctatcgctcctcctccgccccacctgttcccggactcgatgtcgtggcggaggatggtgccgtccttggacaccgagtagagcgtgcggtcgtcggcggtgagcgccagcgcggtcacgctctgggagtggcccctatgcagcttctgcccggggatggagcgagggacgccctcgggcagcaccacacgcgccgccagggcgcgctgcgcccaccccatggcctcggcggcgtcctggcgcagccggcggtccacggccgcgtccagcccgtcctcgtcgctcgcgccgtcctcggccccgtcgcggcccgcagcctccaccgccctgatgccggccaggtactccttggctgttggagggaggtcattggagggctgtcagagggccggaccatccaggcaagggttccatgaccctgcccagctcacaccacaccggtgccccacctagtcgaagccgcttctgctccgctgtctcctcctcatcgctgcttggttctccctcgtccgcctcttccccggcctggttgtctccggcatcctcgaaaaagtccactgcatcctcgtcctcgaagaactcgtcacgcttcttgcgcttggggggctggccccgagagccacgctgcccgccaggacgcgccatgctcgatatcttttatcaaacgagagtcaaaagtagcatattgcgccggtccagggtccagcagggctggcaatgagcctccccttcggggggggtgctcgccccctctggtgctccgctggcactccgcgcccaccacccccctcccgccaacactgcggcgcacaggccggggcctctcaaagatcgcacaccactcctcccggcccaccctgtatttccagacgcgccaaaatgacgcagttcctcctcttcgaggcggcctcgggctatgccctcttcgaggtgacggccctggacgaaatcggcacctcggtggacgccgtgcaagcctccgtcacagacctgtctcgcttcggcaaggccgtgaagctgacggctttcaggccattctcatctgccgccaatgcgctggagcaaataaatgccgtgtccgagtctcaggtgggtcctgcccctcacccgcctgggtagcgggatggtgcacggtgtggtgtttggtggcgactggaatatcttatagccgtctttggttaatgagaaggataatgttgggtagaatatgatacggtgcgctagggcccctcccaccctgtcgaacatgcatgcatgttgatgtcgcgatgagcgccggggccatgggtcatggcatgctctacattctgcccctgcctagtacctctggccaccatcctcaccccatgcactcctgtccccttgaaacattaacaatttcattccacatatatccaaacctctgataccaatctccatgatctaccctgaaaatacattaggtgacggaggacctgaagaatttcctgacctccagcctgcccaaggtgaagaaggcgtcgtctgccaagttcaagctgggcgtgtcggagcccaagctgggcagcgccatccaggaggagacgtccgtcccctgcgagtgcaacgagtttgtaggcgagctgatccgcggcgtgcgcgcccacttcaccaccttcatccgggggctggaggagggcgacagcgcgcgcgcgcagctgggcctggcccactcctactcccgcgccaaggtcaagttcaacgtgcacaagtcggacaacatgattatccaggccatcgcgctgctggacacgctggacaaggacgtgaacacctttgtcatgcgcgtgcgggagtggtactcctggcacttcccggagctggtcaagattgtgagcgacaactaccagtacgcgcagctggccctgctgatcaaggacaaggccacgctgggggaggacaagctgggcgcgctgcaggagatcatcggcgacgaggacaaggcgcgggaggtggtggaggcggcgcgcatgtccatgggccaggacatctcgcccatcgacctggtgaacatcgggacctttgccgcgcgcgtgatctcgctggccgagtaccggcagaagctggccacctacctggccgacaagatgcacgccgtggcgcccaacctggccgcgctgatcggggacctcgtgggcgcgcgcctgatcagccacgctgggtcgctgaccaacctggccaagtacccggcctccaccgtgcagatcctgggggcggagaaggccctgttcaggtgaaaaagggtttgggaaggtaggggggacagtgtcgcggaatggctcctgtacatgctcacgggcccaccagggggttttagcgctcacccaaaggtcacgcgcagacattcacgctgacctcaaccccccagtgctgatgcttgcatccccaatccccaccacaaccacagggcgctgaagactaagggcaacacgcccaaatacggcctgatctttcactccagcttcatcggccgtgccaagcagaggaacaagggcaggatcaggtgggcgttcggggggggggggggggggggggtgttggggnnnnnnnnnnggttgttgcagattgaccggtcttgggcgcctggggtgcccgtggaggaagggtttttgaaactgtgttgcacatgcagacacgtataaagcagtggtcctctagtcgtgattgaagttatgtacatgaatgtgggaagctggcaagtcaagcacctgcgcagaccaacctctcatcatgcctccacacgctccgcctttccattttaaccacagtcggtacctggccaannnnnnnnnntaagtcaagcacctgcgcagagcaacctctcatcatgcctccacccgctccgccttcccattttaaccacagtcggtacctggccaacaagtgctccattgcctcgcgcatcgactgcttcctggaccagtcgaccgacgcgtttggggccaagatgaaggagcaggtggaggagaggctgcgtttctacgaagagggtgtggccccccgcaagaacctggcctgcatgaaggaggtgatcagtgggctggccggcggcgaggaggagatcgtgctggatgcgccggtgacggagaagaagaaggccaagaaggccaaggcgccagccgaggaggaggaggggtccaagaagaagaagaagaggagcgccgaggaggaggccccggtcacggaagagaagaccaagaagaagaagaagaaggccagcgcatgatgcagcgctcgcacccccccacttcttgctcctccgctcccccgtcgtcttgctgtaccctcttctgctgctccaaccagtcttcccatttgacactgacagtccctgcctctgcctggcatggcatggctggcgtgctgctccaacgccccaggcaccccatgtaaggatgctgtatagcagagattggtgtgaaggccgctccccagccatttgcctgcagagaatcgtgcgccctgacccagatcgttccggtaatttggcgagggcgccagagcgcgagacaacccgtgcgcgaatttggagagtattgatcttcgcgatcagtggagaagctcttcatcccttcatcaataaccaaaagccttgcatctcattgttgcattgcctccgcgtcccgggagggtcctccacccgtttgagggtcggctgtcatgaacagactgaacaagttcttggcatccccggcccaggacagggcgggaccccgggtcgatgcattgatccaccgggcaactgagagctccttccctggagatcgaaaagaggcggtggcggagctcaaggacctcatctcccaggacgccgctgcccgcacagcactgggctccttcggattcccccccttgctgacactgacgggggaggacctggagctggaccgctccatcacagagtgcctggccatcgctgtgtttgctgaggatggggaggtgagggccgacttgtgctcggcgagggaatgtcggccagcaggacgaggatggcacctttgctggggcacattccactgggtgtagactgaaccaccgtactccccctacacacatggcnnnnnnnnnnttcggcgagggagtgacggccagcaggacgaggatggcatctttgctggggcacattccactgggtgtggaccgaaccaccgtactccccctacacacatggcctcttgccccaaatgcgcagagtggagccgtggatgggcagcagctggcccggaccccgggggcactccctttcttcctccgcaacctgctgccggagacggacttttacatcaagtaccacagcctgcaggcgctgaggggtctggtggccgcgtgcccctccctcgtccaagaggtacccgatgccgggtggttaccgctgcggggttgtactgaccagtgaagactgggctgtccctctgtagcggatgggtgatctgccccatcctggcagcggccggccaccttgcgctgcatgcacgccgtggcgtgcagcgtgtgtgaatccaggattccacaccctcctcacaatttgtacctcccccctctcacccctcaggccgtccagggcgagccgctggcggtgggtgcgttgctggatgtgctgagcgggggccatgaagtgctgaggaacgaggtcttgctcctcctttcctgcctgctcccgggcgccccggagctggccaagcttgtcgtgttcgagggcgggttcgaccgcctcctcgacatcgccaggtgggcctgggccgtggggatgcatggctgtgccaccacaggggtctggcgcccggccacccagacacccaaccccgcccccccccnnnnnnnnnnnnnnnnnnnnnnnnnnnnnnnnnnnnnnnnnnnnnnnnntccccagggaggagggcctgggcgcgccgggcgcccccgccagcctggtggccgccgactgcctggacctgggcgccgcgctggtgcgcgacaaccccgccacgctgcgcatgctgtgggagacggggcacctctcccccctgctgggcctgctcccaggcgacgccgccgaccccatcctcccggccctcctgcgcctggtggcggccgccgccgggcccagccaggccgtttcccgccaaggctcggggctgggggggggcgcggagacgcggcagcatgtcctggccgcggcgctggccgcgggctggctgcccaggctcctggccctcggcctgggcagctgcctggggacagcgccggcgcatgaccagcagcaggctgaggtggggcctgaggtgtggtttttcctgtgtctgcagggccaaggtgttctctgcatggaaactcataacgaagaacccaggatgccctgctggcattcgatgggtgtatagggagnnnnnnnnnnagccggcgcatgaccagcagcaggccgaggtggggcctgaggtttggtttctcgtgtgtctctgcatagaaactcataatcaagatcccaggatgtcctgctggcattcgatgggtgtatagggagcagcctgccctcccgatcgatcgatgacccagccttgcctccatcccctgcccacaacgcaccctcccacaggccctcctcacgctgtcgtgcctgctgcacgacgcgccggccacgcgcgatgctttcctggcgacgacccagcccgcagtcgccagcgctctgcgcctcccccccgccaccaccgcccccggcctgctgctgacggccgctctcagcggcaaactgggcccccgcgcagcggccggggcggaccgcgtgctggaggcctgcgcgctggaccccgccgcgacgctggccctgcccgcggacggcgaggggctgcggctgggcgagtgcctgcgcctggccccgcgcgactgc

SEQ ID NO: 33516 - DNA, 61 bp, Chlorella protothecoides
aaaatgagctcggggtggcctggggcagagcgagggaatcgggtgggtgtgaggcgagaca

SEQ ID NO: 33517 - DNA, 97 bp, Chlorella protothecoides
cgcgttgcgcaccgtggacagccggtgagcgatgaccagcaccgtgcggccgcgcatcgtcgcgtccagcgcctcctgcaccagcgcctgtgcagca

SEQ ID NO: 33518 - DNA, 64 bp, Chlorella protothecoides
gacaaccaggaagcttgattggtcgtttcgctgaacgattcgaggatgtatgctcagcttcacc

SEQ ID NO: 33519 - DNA, 72 bp, Chlorella protothecoides
tcttgtaagctgctgggccaggttttgcaagtgggatgcaataaaagagattagacacgccgggcgcatggc

SEQ ID NO: 33520 - DNA, 88 bp, Chlorella protothecoides
aaagttgttcttgcccttgttgccggagccgatgttgccactgctgtctgccgtgcacgccttctggcccgccttgaggcactccacg

SEQ ID NO: 33521 - DNA, 65 bp, Chlorella protothecoides
cagggtacctttggtgggagggggttcttctcgaggaggcgctgcccacgaggatcaccgggcgt

SEQ ID NO: 33522 - DNA, 61 bp, Chlorella protothecoides
ctccgagccggtgaagaatgccaacaagaataacgcggtgcacgccatcgtgttcgaggcg

SEQ ID NO: 33523 - DNA, 80 bp, Chlorella protothecoides
cacctcaggattacagcggcaccgcagtcaatgccctgaacttcctggcggtgcttgccggcaaccgctccggcatcgag

SEQ ID NO: 33524 - DNA, 82 bp, Chlorella protothecoides
ctccccaccatcaaccttcaccactcgacacctctctcctggcatgatgacaacgtgaagggacagctcgtgctgtctcgaa

SEQ ID NO: 33525 - DNA, 116 bp, Chlorella protothecoides
ggcgccgggtgcgtagctcgactcctcagcagcgcccaggtcgggagcggcggccgctcgggcctcgtcgccggcgggcgagagggcgggctgctccggagatggctcagcgattc

SEQ ID NO: 33526 - DNA, 61 bp, Chlorella protothecoides
tcctctgcacatctctcaccccccttcatgctcgccccaccacgctcagactcgggaggtg

SEQ ID NO: 33527 - DNA, 69 bp, Chlorella protothecoides
acgctgctgcgccccggcgcttcgggggggccgggcgcggcgctggtccaggcgcgcgccgccgcgctg

SEQ ID NO: 33528 - DNA, 61 bp, Chlorella protothecoides
cgaggagggtactgggtgcattggttgtggagtctcacttcctgccttatagtgtcattgg

SEQ ID NO: 33529 - DNA, 61 bp, Chlorella protothecoides
gaatgagggtggctgcaatgcatcaaagtccgatcctctcagcctgacccatcggccatgc

SEQ ID NO: 33530 - DNA, 61 bp, Chlorella protothecoides
cccccatccatacacaccgtcttgtggccgttggcatacgccaggtcaccaatgtggtaga

SEQ ID NO: 33531 - DNA, 76 bp, Chlorella protothecoides
aagaagggttagagtgagggtggcgtagggtgcagccatgcccttcccatctccaagcatccccccacacagtgcg

SEQ ID NO: 33532 - DNA, 66 bp, Chlorella protothecoides
tactgtcctcagagcccctcatggcgcatggcgacaagggtccgcagacagagcgcgaggacccaa

SEQ ID NO: 33533 - DNA, 73 bp, Chlorella protothecoides
ttcaaagccaagtgatctcgggcttcgcactactcacttcatcctcacttccctagagaatcaattcaccact

SEQ ID NO: 33534 - DNA, 72 bp, Chlorella protothecoides
atgcatgtataaccatcgactcgacgacgcaaaccccacgatcaagactcctcgccaacccaagcaagcgac

SEQ ID NO: 33535 - DNA, 65 bp, Chlorella protothecoides
cccaaacccactgcccacctgtcacctcgttcccaagctcccccttcccaatccgccgcagctcc

SEQ ID NO: 33536 - DNA, 10287 bp, Chlorella protothecoides
  modified_base (475)..(484): a, c, t, g, unknown or other
  modified_base (777)..(786): a, c, t, g, unknown or other
  modified_base (1121)..(1130): a, c, t, g, unknown or other
  modified_base (1334)..(1343): a, c, t, g, unknown or other
  modified_base (1584)..(1593): a, c, t, g, unknown or other
  modified_base (1777)..(1786): a, c, t, g, unknown or other
  modified_base (2181)..(2190): a, c, t, g, unknown or other
  modified_base (2559)..(2568): a, c, t, g, unknown or other
  modified_base (2999)..(3008): a, c, t, g, unknown or other
  modified_base (3356)..(3365): a, c, t, g, unknown or other
  modified_base (3562)..(3571): a, c, t, g, unknown or other
  modified_base (3873)..(3882): a, c, t, g, unknown or other
  modified_base (4146)..(4155): a, c, t, g, unknown or other
  modified_base (4515)..(4524): a, c, t, g, unknown or other
  modified_base (5971)..(5980): a, c, t, g, unknown or other
  modified_base (6351)..(6360): a, c, t, g, unknown or other
  modified_base (6980)..(6989): a, c, t, g, unknown or other
  modified_base (7319)..(7328): a, c, t, g, unknown or other
  modified_base (7849)..(7858): a, c, t, g, unknown or other
  modified_base (8084)..(8093): a, c, t, g, unknown or other
  modified_base (9122)..(9131): a, c, t, g, unknown or other
gggggggggggagcttcatgccaccggaagggtcacggacggcgggacttcgcaggatggcggcctccaggcctcacactgcatggcattggcacggacgcaccgataacaactgctgcgacatgccgacgaagttgacggccattggggtcgcggcctgaaggtgcagcctgaaggggggctgcaggctgtagctctgcaggtactgcagggcctgtccagcggctgtcgaagtgctgtacatgaccaccgcaaccatttgcttgccgcccgccgctatcgcggtggccaggtggacgacggggccgactgtcgcgaaaagatcgtacagctcctggtgcgacacgctcggcgtgaggccgcgaacttctaaagcgggagcagtcattgtgcaaggtggcggttgagcgggcacaagtccaaggaggcacaaaggtaggcgatcagggtcggtcagcgtggtgagggctggtcnnnnnnnnnncaaagcgcgagcagtcattgttcaaggtggcggttgagcgggcacaagtcaaggaggcacaaaggtaggggaccagggtcggtcagcgtggtgagggctggtcgcagtgccgaaattcagcgcgagggcaggaatcaacgatgcctgcgctgtattgcagtcgagggaaggtgagttcacaagcaaagcctgccgtcggtggtgttggaacctgtttccaacggaaacctctcgacaccgcccaggtggacaccctccctccggactacacctggagcttcctcacgcacgtnnnnnnnnnnaccgccggtggtgttggaccctgttcccaacggaaacctctcggcactgcccaggtggacaccttccctctggactacacctggagcttcctcacgcacgtgggggcccgaggggcagttcgggcgacggtcttgtgacatctgttccgggagtaatcaccctcaatattgcaccttgcgcgatacaaagcaagtaaattgctacatgaaatgttgctttaggggttgcgctcgatgatgtggcggcctatgttgtcctggtgacttactgcttctccggcacgtccggaggtttcccagctggagtgccgcggcaacgtggaggccagtgaggnnnnnnnnnnggggactcctggtccaggagggtggacaccttccgagcctacgcccttcctgatccgacctttgatccaggagagggcaaggaccgtcccaaaagccagccagtgcagtccatacacaaacgcggtgcgagcccactgctgcggcagggcgcagtccagcactccatagatgtacctgtgggggtggatcccaatccatgtcannnnnnnnnnggatgcggatcgcaggcaggacgcctattctcgcgatttctccaaatgacccccgaagcgtccttgtgacggcagggagacggcattggagagctcgccctgcggggccccgtgctcaagccattccccaattccccagccgccgtgccgtcgtgagggacttttggtccgggagggtggacaccttccgagccgacgcccttcctaattcgacctttgatccaggagagggcaaggaccnnnnnnnnnnatgagacctggaaccaacttgaagctgggcagaattcaaacaatattcagctctcgaatccacacagtgaagtccccgtagcagctgcacaacacgccttgcacccaaatgcccatgccatgccatgccatgccatcttcactccctttgcccaccaaaaagcctctcactttccgacgatcannnnnnnnnngtgagacctgtaaccatcttcaagctgggcagaattcaaacaatatttcgctctcggatccacacagtgaagtccccgcagcagctgctcaacacgtcttgcaccccaacgcccatgccatggcatcttaactcccttccccaaccaaaaagcctctcactttccgacgatcatgtaacggatcacagcaaatgtggtgtagatggctgcccagccactgaccacgccggccatggagggtatcacggggatgtctgccagccagccctcaatgagcatgaacaccttggcaaggacacagaggatgaggtggttgagcagatgaggtccaggtctgcaaccttttgcaccgaccttcaccaactccccacctcaccacattcatgccatgctgnnnnnnnnnnatccaggtctgcaagcttttgcaccgaccttcaccaggtccccacctcaccacattcatgccatgctggttgtagctgccaaagttgcagattccctccacggctattgcacgtgctgctgcgtccggcagtgaataggccgacggcagcagcagcgtccacgtcatccccgtcagcaccagagccatctgtgccggggctgaaggccgctgggtgaggcaggaggccgtgcagaggagcggcaggggcggcgggagcatcgcacctggccaacagccccccagcgcattcctctggactgtgtgccctctcgcctcgctggacagccacgcaccgtgcctaggatgtgaaaggcagccaccatccagnnnnnnnnnngaggccgctgggtgaggcaggaggccgtgtagaggagcggcagtggcggcgggagcatcacacctggtcagcagccccccagcgcattcgtctggactgtccgccctctcgcctcgcggaccagtcacgcaccgtccctaggatgtgaaaggcagccaccatccagaatgccaggcgcgaggagagcgccaggagcgccccgtccggcgcctccccccggacgtctctccagctgagccaggcgcccacgaggaagtaggccgtcatgagccaccacgtcctgccacgaggaaggaaagagtgaaaagtgatggcatgccagctcgcggcccaattcttcatgggcatccatgtccagtctgctcaggcagccggcaactcgaggcagccacggcaaccgcacatgtccccaccaagctcataccacatgnnnnnnnnnntgcggaaggaaagagtgaaaaatgatggcatgccagctcagggcccaattcttcatgggcatccatgtccagtctgctcagacaaccggcaactcaagggatccatggcaaccacacatgtccccaccaagctcataccacatggtaaaccatttggccaggaggccccaccccgcccagaaaccctggatgagggagaggcctagggagtagaagcccacaatgcatcgaaatttggccaagcgccgggaggatcctgcagggggatgagctagtggtcatctgaatggtgtgcgccaccctctgcacagggatcaaggagtggcatgcacctcggcggcaggtccnnnnnnnnnnctggtcatctgaatggtgtgcgccaccctcttcacggggattgaggagtggcatgcacctcggcggcaggtccagacaacagcagggcaaggtgctgctgtggggcctcgagggaactgcatgggctggaatgggcgacccaatgcacatgttctcctggaatctgggtttcgcagtgcacaaatctgtgatggagnnnnnnnnnngcacatgggctggaatgggcaacccaatgcacatgttctcctggaatctaggtttcgcagtgcacaaatctgtgatggagcaactcagacctgcagtgcgcgtcagatcctccaggcgaggctgccaggtcctgaccaggtgggtgcagggatggatggttgcccggcagtttgaagtttcagtccatgacttcacggtggtgatgggggtggtgagcctggctccaggactcgcatgtacgacataaaatgacattacaggcacctgagattgccagggaatgctcgcaggatgaggacgnnnnnnnnnngttcagtccatgacctcccggtggtgatgggggtggtgagcctggccccagaactcgcatgtacgacataaaatgacgttacaggcacctgagcttgccagggaatgctcgcaggatgaggacggcctgtgcaatcaccacgaggtccagcgcgatgaggggaatggggagggcgccaggcatcacccgatctgcgacctggcgccgtgcacagccagcactgtatgaaataatatctcccacgaattcatgaacttgaggctnnnnnnnnnngcccgatctgcgacctggcgccgtgtactgctagtactgtatcaaatagtatctcccacgaattcatgaacttgaggctgaatttagattggcggaagcctgcgaggtggcccgccagcttgcaccaggtcaaagccctcagctttggcttcatgtggcttcatttggatggagcccgttgaactcctcgggcacagagccgtagtatatagcacgctcgtcctcttcttacatcagtaagcaggaaacgggccctatttgagtaaacttgaaaattttgagcgctgacaattgcacaggtgtgctcctgcagtcatgagagagatctcgacgtacgttcattaggccgcatgtggcttnnnnnnnnnngagcagtaaatgggccctatttgagtaaagttgaaaattttaggcgctgacaattgcacaggtgtgctcatgcagtcatgagagagatctctgacgtacgttcattaggccgcatgtggctttgcggtcggcctgtccgcgccgccattggacgcgatggatctctgcgactccaccctctccaccagcttcttcttccgggagaccagagccaggaccaggccgaaggaggcccattggagggcagggatgagcagggccgcggaccactgctgcatggcgccgccctcaaagatggggtaatgaaacctgtgtgggttgcgcaggcttgcactgaggttggtcgcagggaatgggcatcaggtgtgccaggaacgtgaaataccacatgagcatggcttggaggttcagtggaccctgcagtccccgccctgaccatgatcccctcatttacgcgatcctgatttcatctccacctccacccactcactggtcccacactatcttgctgaaggactcgaagaggaagtagagtgcggtccagacgcccacccagcccagatacctggactggaaggggaggtgggccaggaagagctcccccagcatgaacaccacgttgccaccgtgctggttgtagctgccaaagttgagcatgttctccagcttgtcccgccgctcgcgtgggtcgggcatggccagcgcggcggggtagaggatgccccaggtgatgaccaggagcagccagaccatggcctggtggacatgatacaggacgaggatggcgcgggggagccacaggccgggccggcggtgatcgtccccggcgcgtggcgaaggggggcggtccatgtaccgcgtcgtccagctcgctatggtggccagcacaaagtacaggaccaggaggtaccaggacctgcatgggcaggagttgtgatgggagtggacactgtgggctttgctccctgagggtcaggacggcaggtgggggagtgcatggctgtccgggtcggcacgatgtggacgtgtcccagtggcagcagcaagcgggccagggcgtccgctgggcagcaccagccctccccaccggcctgccgctcaccacatggtgaaccaggggcagagctccgtgaatcgagccgcggggctgcggcccagctgccagatgctgaggcccaggacgtatgcgcacacgctcgtcctataccacctgaggatgcgtggcgaacctggcgcaggggtgtgtggattctgtttcttggaggagcgggcgagctgcggcgcagctctggagggcagggcagaggtgcagtctcccatttcagccctcgagtgtgccgatgggtgacgtacataagcaggacttggcacccccttagactgaagacccgcttgctcaaggatcgtcccagggcaaccctggcctcaccatagggggcatgcgctnnnnnnnnnngattctgtttcttggaggggcaggcgagctgcggcgcatctctggagggcagggcagaggtgcagtctcccatttcaaccctcgagtatgccgatgggtgacgtacatgagcaggacttggcacccccttggactgaagacccgcctgctcaaggagcatcccaggggtaccctggcctcaccatagggggcatgcgctgtgacctcctccagggtgggatgctgatcactgcgtattggaaatggcggcaacgcatgcacagcctgcttcaggaccgtggccagatgcacgccttgcctggatgctggctcgcgccatgggaattgccttccatgcgcgcggccacccaacgtgcacattgtgacagaannnnnnnnnngagggtgggatgctgatcactgcatattggaaatggcggcgccgcatgcacatcttgcttcaggaccgtggccagatgcacgccttgcctgggatgctggctcgtgccatgggaactggcttccatgcgcacggccacccaacgtgcacattgtgacagaaacattcctgtgtcccacctgccaatcttcaggacatcatgtcgtagcaggatgtaggcctgcaccgcattgatgagctgggctgccacaaaggctggagggaggaccatggcagcgggctcagcctagcacaggcctaaggtgggttgttggggaacagaggaaggacctggctcaatttcgaaataatgaatggaaagaggctcagggagactccctcagcccatcgagaatcgttccaagtgtcgttgggcggctccatgtgcagcctcatcggtgggcagtatcgacgacggagacccacctgtcatcgaatagagcctgacaccaatgagcacgctctacgagtcctattcccatgcatgagtctctcttttcgagtatgtcgcgtcttggagtgggggcccatgcccgccagggcccggggtggagatcctgcgcgtggatgcagattgcggcnnnnnnnnnngctgcgcacgctctacgagtcctattcccaggcatgagtctctcttttcgaacatgtcgcgtcttggagcggtggcccatgcccgccagagcccggggtagagatcctgcgcgtggatgcagattgcggcttcccagtggaggcccacactccccgtcacacactagtaggaggccgttccatgatggctgcccctccttgtcaccctgaccagtctatccctgctccttctcccgccacacactcatcagcccctcccttccccaccgatcacatcagtcgcccggctccatcgcaacccccccctccccgccgtctggcaattggtcnnnnnnnnnncgtccctgctccttctcccgccacacactcctcggccccttccttccccaccgatcatatcagtcgcctggctccatcgcaaaccccccctccccgccgtctggcaattggtcacacgtctcatcactgctccagatcgtgtcaacttccacgtccccgcccgggccagagccccgcacgtcaccgacccgggtctgcccggatgtacagcgcgttgctgtgcacgctgctgtagcgctgcgcgcgctcctccgccaggtcctccaccgactcccgccccgccgccagctgccagctgtcgcccagcggcgccgcctgccagccctggcccttgtgccaggcctgcaggcgcgccgacagctccgcctcctccaccagcggcgcgtcggtgtgcagcagcggcggcgcgcgcttcagcgccagaccgcgcgtcggcggctgaaccggcgaggcatcccgcgactcgcctgtgccctccgccgggctggcgccctgccgcaccgagaggtcgttccggtacnnnnnnnnnntcggcgaggcgtcccgcgactcgcctgcgcccgtcaccgggtcggcgtcctgccgaacagagaggtcgttccggtaccaggccagggggcgcggggtgctggcctcgccctcctccacctcgtgcagcgtggacaggcggtgggggggggcgccccgccccgcctctgcgccgtcctggccaacccggtccccgcccgccaccgccgccgcctcctgccgagcctnnnnnnnnnntctctgcgccgtcctggccgtcccggtccccgaccgccaccgccgccgcctcctgccgagcctcccactccgccacctgggggcccaggaagcccgcggtctggccgttggacaggcggtgcagcgtggggcccgcagccgccgcggccgccgcagcctccttggccttcttggagcggccgccgccacgcagcatcttggccagcttgtgcagcgcgcccttggacttcttgcgctgcatggcgctgggcgccagctccaccactgcgacgagggggtgagaggaagggaggcggcggtcgaaggataagtcttgaggttgacctgaggatgggcacggtcggtggcctcccaagtcatcacgtccatcgactgtcggtcgctgcctgttgcctgggccggctagcacagccagccgggcatcgcccctgcccccccaccccacacccccccatgaatgaaaggggtgcctcacccgtgtcggaccaggatgtctcctggctcatggcggagtggggggtttcgcaggccggggtcagggaccccggcgcccgcggcgtgccatccacgctcggtgaggggaagtgctgcagccggccggcgccggcgcccggcggcggatccccgcgcatcgcggtgaaccgccgccgcagctcggcctccgcggccgcctcggccgccgccgcctcgtctgattccagacgccccccgcgcgcggcaggcccattgtccccgggccgggcccccagctcctgggcgcgggcctcgcccggggcggcgcccagcgcctcggagatggaggtgcgcagggaggccaccaggtagtcggccagctccccgtcctgcctcgacggccgagcgcgcggctcgcccgcccgcgcggcctccgcggccgcgctcgcctgggcgtggggaggggtgacgggcgggagggggttgagtatcgagtggctggaggaggatcaacgcctcgcaagcggtcgcctctttcccccccccctcagacggcgcgcctcctcattcagctgnnnnnnnnnngctcgcatgcagtcgcctccccccctcctcagacggcgcgcctcctcattcagctgcccctccgcagcccacctccctcccaaacagaaaacgaacggacgacccggcacgcctcaccgcctcggcccgcgcggtggccagctgcgcggccaggtcggcgatctggcgcatggcgagctcgtgccccgtctgcgtggcggccagctggccgcaggcccccgtgtgctccgactgcagcgcgtcgtgcatctggcgcagcgccgccagctcctcgcccagcgccgcggcgcggcgctccgcgcgctccacccgcgacgcggcggcggcggcggcggcctgggcctccgccaacagcgcttcgctggcgcgcaggcgggagcccagctcgcgctggcccgcgttggcgccctgggggtgccggggggggtcatccgtgggagtgagggagggaaaaggagggaacgctggcgtggggagggaagggagcctgacgtgccagctgacaagcaggtcgtgcgggatgctcgaaggacacctccgcccccccactatcaccgttgcacacgtcatccgcacctccagggcctctgccagctgggctgcctcggccttcttctgctccgcaaaggcctgtgccggcgcgcgaaccccggggtcgggagtggggcccaaatgcacaacccttgcagccaagggcctcacaagcaggcagtcaggagcccacacccagcaggcaccgccagggcccagccagcatcccacctgcagctcatccaccatatcctggcactccgcgagggcggcccccctcctgttcacaggcggcggtttggtggatggagggtgagcacagcacgacaccacacctcacatccaagtatcgccacagtcaggcgcgacctcgaggcccccggcacggcgccagacttaaagtagcaccccacacctggataccatccacgcgcgcagtggaggctctccccttcccccacgcccaggccccacccacctctcgcactcctcctggcaggcctccaactgggccgcgaggcggcggacgtccgcgggcccctctccgcccgcgccacgccgcgcaggggacgcggcgcccggggtggagccgccgctcgggctgccgggcccgcgcatgccaccg

SEQ ID NO: 33537 - DNA, 61 bp, Chlorella protothecoides
gggtgattgcatttggaaagcggaaagacgagttagattggcgcatgaagcgtttcccagc

SEQ ID NO: 33538 - DNA, 96 bp, Chlorella protothecoides
ggagttggggaaattaatgcggtgtttgatagtttggaagatgttatgtcccttttgaccccctcgcattgattggttgaaacggctggacagtcc

SEQ ID NO: 33539 - DNA, 117 bp, Chlorella protothecoides
aggctggaagaacgcaaagaatgcagctgcgatggaggggtttgggatggggctgaggagtaggtattcagaatgtgaagcgcagagttcctgcacgatggcaacctgccaggaaat

SEQ ID NO: 33540 - DNA, 61 bp, Chlorella protothecoides
cgccggtttcgggggtgcttccgccactccacccaccgtgcatgtgcacgcatgtatctgg

SEQ ID NO: 33541 - DNA, 94 bp, Chlorella protothecoides
ggtcgatgtcggatctgagtgaggtgcatttggacacctcaggcccgagtgcaggggggccctagctcttggtcccgcgaccatgcgccgctgc

SEQ ID NO: 33542 - DNA, 93 bp, Chlorella protothecoides
cttgccttccggacgctgcccttcgtgagcttgaccaacagcactcgagctattccgcagcgcatcgcccacaaccaccgatttccccctcgc

SEQ ID NO: 33543 - DNA, 83 bp, Chlorella protothecoides
caacgccccctttgccctctttgccctcttgggaccctgaaccctcaccctggcctcacccaactccctcgtcaggcctacgg

SEQ ID NO: 33544 - DNA, 136 bp, Chlorella protothecoides
gaacagaggggcgcagcgcagcgctcagagcggcaaagagacagcaagcatgcgacgttggcaggggccatcatcggcctcgcatgcgcaggtccctctccgcctcgtactgccgcacgtctgcttcttgcaggaa

SEQ ID NO: 33545 - DNA, 61 bp, Chlorella protothecoides
ttccatgaaccatagcctggatgatatcactctgtgcaccaacactggcatcgaaaggtac

SEQ ID NO: 33546 - DNA, 61 bp, Chlorella protothecoides
gtgaggactgcccatggctggtgaaatctcatcctgccatgctgtttcgccacactccgat

SEQ ID NO: 33547 - DNA, 116 bp, Chlorella protothecoides
cccaagcccacaaccctccgcccacctgggatgggaccaagcagacggcaaagccaacggccaggcccagagaagtcagtgcggctagcaggatgacccaaggcatgcacgccacc

SEQ ID NO: 33548 - DNA, 81 bp, Chlorella protothecoides
ctgggaaggggagggagggggtcgctctgcaaccctatcattgcagtttgtagagcagccaacagtggcccgccagggtcc

SEQ ID NO: 33549 - DNA, 102 bp, Chlorella protothecoides
ttggggaggggtgtcttgcaagggcagaggggggctctgctgtgcgcccgatcggtccagtgcacattcccagagtgccacgcaccgaagcgaggatgctga

SEQ ID NO: 33550 - DNA, 61 bp, Chlorella protothecoides
atgtgcatgccagagcgttttctctggaaatccatgtcagcgatatgtgcttgcagtgagg

SEQ ID NO: 33551 - DNA, 64 bp, Chlorella protothecoides
gagggtctgtcgccatgggccagggaccctatgtcacataagcatactgcatatgacaaaactc

SEQ ID NO: 33552 - DNA, 128 bp, Chlorella protothecoides
tcctgccaggcgccgcgggcgaggtgtcggtggcggccagccagtctgcagggtctgccgctcccagggcgggcatcgcactcgccgggcccggccgggcctgggcgctcccggtgtggtgcggcgca

SEQ ID NO: 33553 - DNA, 16855 bp, Chlorella protothecoides
  modified_base (391)..(400): a, c, t, g, unknown or other
  modified_base (758)..(767): a, c, t, g, unknown or other
  modified_base (1461)..(1470): a, c, t, g, unknown or other
  modified_base (2062)..(2071): a, c, t, g, unknown or other
  modified_base (2265)..(2274): a, c, t, g, unknown or other
  modified_base (4478)..(4487): a, c, t, g, unknown or other
  modified_base (4702)..(4711): a, c, t, g, unknown or other
  modified_base (5584)..(5593): a, c, t, g, unknown or other
  modified_base (5793)..(5802): a, c, t, g, unknown or other
  modified_base (6100)..(6109): a, c, t, g, unknown or other
  modified_base (7123)..(7132): a, c, t, g, unknown or other
  modified_base (7961)..(7970): a, c, t, g, unknown or other
  modified_base (8339)..(8396): a, c, t, g, unknown or other
  modified_base (8480)..(8489): a, c, t, g, unknown or other
  modified_base (9349)..(9358): a, c, t, g, unknown or other
  modified_base (9696)..(9705): a, c, t, g, unknown or other
  modified_base (9939)..(9948): a, c, t, g, unknown or other
  modified_base (10233)..(10242): a, c, t, g, unknown or other
  modified_base (10569)..(10578): a, c, t, g, unknown or other
  modified_base (13546)..(13555): a, c, t, g, unknown or other
  modified_base (15587)..(15596): a, c, t, g, unknown or other
  modified_base (16511)..(16520): a, c, t, g, unknown or other
gcggcctccgcctcggccgccgcccgccgcgcggcggccagctcggcggccagcttggagccgcctcgctgctgcgcggccagggccttgcgcttctcggccagctgcttccgggcgtgggccgcgcgcgtggcggcctgcgccgcctcgctcacggcctccgtctgagggacgggaggggagcaggagtggaggggaatgggggggggcggatgttgcatgtcccttggacggcagcaggctgaagtgcggtagtctccggggagcggtctgtgcacacattgccgccctgcggcgcagatcaactctcgagccaagcactcatcgcggcccgagcaacctcctcggccccccccttcgcccccccctcaactcccagaagccggcccannnnnnnnnnccaactctcaagtcaagcactcatcgcagcccgagcaaccccctcgcccccctccttcgccccccccctcaactcccagaagccggcccacctgcgcgttcttggcgtcggccaggcgctcctgcatggacttgccggaggcgtccctgccgtcaccggcctgggcgcccgccagctcagcctgggccgccgcaaggtcagaggcgcacctgcagccagaggggcgtaccagggcgtcgcttgttgcagggcgtcacagtcaccgaccagccttgggtccacggttccccaggctggtcccgtgcccctctcacactcctcaggccggtcacatggccccacaccgcgctcccaaacnnnnnnnnnncccccaggctggtcccgcgcccctctcacagtcctcaggactgtcacatggccccacaccgcgctcccaaacaccatggaatcgctcccccccccgccctcactttgccagcgtggcgtctgcggcggccgcgtccacctgcgcggcctccagcctggcggccagctccgcctcccccaggtcggccagggcggcctccaggcgcgccagctccccctgctcctgcgccaggctctctttggcatgcttccaggtggacgtctccgtgacgagcctcttggacagggcgtccaccgccgccgtcagctcccggacctcccccgagctctgcaggtccttctcggtctgcaggccggcgatgtcatcgtcgcgatccttgagtgcctgctgcagggccgcccccttggcctccagctccttcatgtcggcgatcagggcgtcgatgtcggcctggccccgcttctgggatctgccatgtgggatggaggcgggggggatggagagggcatgggctgagcatgtaggcatccggggctgcaaggccccagggtgtgagccatggctccatccaccttgccctctcaggtgcacatcccaacatgattcctgaccaccacccttctgaaatgctgacagaatcacactcaccccccctcccaagggacggccggcccacctctcggcctcgacatannnnnnnnnngcccatccagcttgccctctcagatgcacatcccgacatgattcctcaccaccacccttctgaagagctgacagaatcgcactcaccccccctcccaaagtacggccggcccacctctcggcctcgacatagcggtgagcgacgcagaagtggcgcaggcgctccaggctggaggaggcgtgctgccactccatgtaggcggccttctcccccctcagcttgttcagcgcgggcatgatgtcctccgtcagcacccggttgatctcctccagcttcacctgcttcttgtccagggtgcgcagcgccgcctgcttcttgccctcgtacatcttcgtccccgccgcctcctcgatcagccccaggatctcgggcggcttcatgttcaggaccttggtgatgcggccctgcatgatcaggaagtgcgggttgttcacattcagctgcaccgagtggaacaggttctggacgcgcctgtgggcgggggggaaggggggggagggagggggtgagcatgggaaggatctgcccacggttgatgaaggatggggacatagttgcggatggattttcacagatttcttagcaacccccnnnnnnnnnnatggggaggttctgcccagggttgatgaaggatggggacattgttgcgggtggattttcacagatttcttagcaacccccttgccactccgaatgcatactcatcgtgtcgcattgcacctcccctcactcacgatggctccgccactctgccgttgatgagatacttgctgcggccgccgataaccagctggnnnnnnnnnncgcaccacccctcactcacgatggctccgccactttgccgttgatgaggtacttgctgcggccgccgataaccagctggcgggtcaccgtgatctcgtccaggtggtcgtaccccaccgggctgcgatccttggcagcattgtcaaacacgattgacactgtggccttggtgacccctgccaggccttgcttgtacaccaggtctgtcaggttggaggcccgaacctgcagggaacaggggggtggagcttggaccgacatgcgtgcatgcacgcgactgtgcaagtaagggattccatccatggcaagtatatcctcaccaccgtccccaggactcgcctgctgcaggttttgaatgcccaggacgaagcaaatggagtccaggatgttgctcttcccgctcccattcaggcccgtgatggcgttgaactggggatcgaatcctggaatgaccacgcgctgggcataggacttgaagccatccacggtgatttccttgatgtgcatgtcgagagtgcggggagcccgcccggctctcgagacactgaattcgccccgctcctcgcaggcttggcgcacgacggcctgaactgaaggatttaggcctctttcaactgtgcttgcgtccctccggggctctctgggccagaattccagccacactccagggccgggagctgtccccgcgcttgaattgcactggcattggaagaaagggaggaagtgatcacggacactagccggcacactctgaggtggatggaggtgcacgccagctcagccaggattcgcgcgcaggacgttcggctggcagcgtaggcatcgaggtggacactgtgctggatcgtgtccaaacatcaaccgatcgatcggctggggttcctcggcccctttcctaccacctcttcatggctgtgcagtgaccgcccgaggcatgaacgtgtcatcctccctggtccagaggaatacgctcccattcctgaaaagtgcttgcctccgcatgaccacacctctcggccagccacgaggcagcgctgccgcacggctccgccagacgctgcgcatggtacaggccggcaggccgatggcagctgccgcagacaattctgaggccacaccccccgcgatggctcataccgatgccaggacggggtacatgctccccccgcccgagatggcagcggtggtggacgccccccccgagcccactctgtccttctcacccgacaggaagatggtgctgcaactgggcagacccccttccaacccccccatctccgagctggctcgcccggagctcaagcttgcaggtgtgtggcttgtttgaggtgctgtgatcgtgcagactgcctttggtttggacgctttacttccggcgatgtggggttccacagtcgcagctccgccttcctgatgctggctgcccggccctctccattcccgcccccctctggtcgccaaacaggcctgcgcatcgacccggagaccttctcgcgcagcaggatgtcctactacacggatctcatgttcacacccttccacgacgcgctggttctccccgccccggcggccgactgccaccacccgacgggcatcccccccggctcctggatcaactacgcgcgctggtcgccggacagccgccacgtggcgctgacgctgcgcagcagcgccgagggcgcgcgcgggccgctgcgcctgtggacggtggacactgagtcctggcaggcgcgggaggtcttccccggcactcggggcctcaacacaatcttcatcaggcatgtggagggcgggatgggggggtggggcgtggggtgagtctttgatgttggtcaagggtgagggtgccgcgttcacggcagagatggacgctgcgctgcggcctcggcgagcgctggtgcacgttttgcgtggaggtcgatcagaggggccccaagcccagctgtcctttgcccacccccctcccagctacgactggatggacagcgacaccatcatcgccgccctgatccccgaggaccatcccacgctccccgtcaagcccgccaccgtcggcgggcccaagattgaggacaacagcagcggcaagaagtcacaggcccgcacctacccggatctcctggccagtccccacgatgaagcggtgtttgaccacctgggcacctcccagctcgtgtctgtcaaggtgcggagcgtggtgcctnnnnnnnnnncctgctggccagtccctacgatgaggcgctgtttgaccacttgggcacctcccagctggtgtctgtcaaggtgcggagcgtggtgcctgatcgggattctgatgatgtcatcatgtcgtgtgcgggcaaggtgcaggcgggttgagctgcaccctcgtagtcttccacgggagcaggcttagtcatccccccccccccccccccccccccaccannnnnnnnnnagggattctgataatgccagcagctcgtgtgcgggcaaggtgcaggtgggttgagatgcaccctcgcagtcttccacgagagcaggctcagtcatccccacccccccaccaactctcaataacagatctccaccggcgctgtcacgcgactgggcccgtccaagcaatacacgggggcccatgcctcgccagacggccggtacctgctggtgtcctacttccacaggccctactcctactccgtgccgtgcggccgcttccccaagagcatcgagctgtggagcgcgtaagtttgtggtgaatgtttcgcgggatggagcgtggcaagggttgggggaggtactctttgggggagatttgattgtcatctcaagccctgcaatggtgcgactccgccactggtggtgaagctggttggccttggtatgtggacctcaatgggcacctcatctagtaggccagccattggtgtctaggagaaggcggtgcgcatgctgtcatcaggccaaacatggcatgccagctgtgtcgcagctggtaattcctgactccaaccaccacatccccccccgtagtccatcatgtttaacttgtacaagcctccagagcatcgagcgcctccctctcactatgtacgcagggatggcacccccctgcgtgtaatcgccgacctccccctggccgaggatattccagtggcattcgacagctgccggcaggggccgcgccatctggagtggagggatgacaaacctgccgagctggcgtggatcgagtgccaggtgggcgggagatggctggtgtggaggtggttgattgctgtattgggtcctggaaacatcccgcatagcttgtgatgtccttggtatcgcnnnnnnnnnntgagtgccaggtgggcaggagatggctggtttggaggtggttgattgctgtattaggtcctggaaacattccgcatagcttgtgatgtccttggtatcgcaagtgtcccatgtgtcaagctacagagcacaagggtgtgtatcttccgcctcgtgtgcatactttccatcctcagcccaccccatgaatgcaggacggcnnnnnnnnnnacgcctcgtgtgcatgcttcccaccctcagcccaccccatgaatgcaggacggcggggatcctgcagtggctgccgagcctcgcgacattgtctacacgctggaggcgggcgacctggaagcagaggccaggccgctggtgtctaccaacctgcgctgcgggggaattgtctggggggacgatgacctggcgctggtaggctcatttgggtggcatgatattgttcgacgctctatggaggggttgggccaccagatcgcgcctgtttgtggtcggactgtctggcatggcatggctnnnnnnnnnngtgcggaggggtggggcctccagatcgcgcctgtctgtggtcggactgtctggcatggcatggcttggatctggaggctcaggcattgaccccggggcccaagcccttttgccactgcccagtcatgatctgtgccccctcgcctgtgaccgcccgcctgcctgcactcgacctgcctgcactcatttatacaatacctaactcctaccccccccttccgccaaccctgtccagctgtacgagtctgagtggaaatcgcggcgcagcatcgtgtcgaccttcagtccggggagcgggggggcggcgccccaggtcctctttgaccgcaactacgaggatgcctacacaggcaaggcccctgggtgcacagggtgggtatcgtcctggcagaccactcgcagcgcatggcatgcaaggctgagggaggaggcctcccaacccctcaaccctcccctgcgccgccaccctttagaccccggctcgcccgcgctgcgacggacgaggtggagcacgtacgtgctggccaggctggacggcgcgcggcggctgctcctgcagggctccggcgccgggccgacgggcagtcgtcctttcctggacgtgctggaggtggactccaaggccacgcgccggctgtggcagagcagccccccttttttcgagaccaccagcaccattctttccgatgaggacgagcggacaatcaccctggacggcctgcgcatcctggccaccaggtgcgtagtcggggtggtaggggtgtggtactcgctgcattgggttgagtgcttgccggatggaggctcagagacagggagaaattcggcgtctggcaggcctcccccatccggcttctatgattcgagtgtctccggtggcttccctatcggcatgttctgatggaatgcgctaaggaattgcggcctgctctcaagaccttggcatcttgttccccagcgactcggcagccgtggacggacaagtgacctgtccaacaacccgccccgaccttgnnnnnnnnnnctatgattcgagtgtctccggtggcttccccatcggcatgttctgatggaatatgctaaggaagtgcggcctgctctcaagaccttggcattttgttccccggcgactcggcagctgtggacggacaactgacctgtccaacaacccgccccgaccttgcccagggagtctgagcgggagcctccccagttttacatcaaaagttttgccaacgatgggagggacatcagcgagcgctgcatcagcgccttcccgcacccctacccgaccctgaagggcctgtcccaggagattgtgcgctacaagcgggacgatggggtggaactgaacgccacgctttaccttccccctggtgagatgctgcttgtgtgggagaaagagcacgagccagccatgcatctgtgtcttttttaaagtggggctggtgggagttatcatggggatctggtcaaactgggcgtcaacttctatcccatgattgagggtataccttggacgtcgcatgcatgcatgccactccctgcatgctgtccacaccttcctcagggtatgacaaggacagggatggaccgctgccttgcctcctctgggcgtaccccaggtaacgggtgttgggttgagtgtatctaggttcatggcgcggtgtgttgagcagcacacctgccaaacgctcagtgccacgtcaccactcgggtgacaaggcctccgtgcatcactcggatgtcaccccttctccaacagtccttcatctgctttaacctgctagagcatgtatgcgttgcacaacgcatgttcaatgccaaatctcagattatgaatccccattgcnnnnnnnnnnacctccgtgcattactcggatgtcacctcttctccaacagtccgtcatctgctttaacctgctagagtatgtatgcgttgcacaacgcatgttcaacgccaaatctcagattatgaatccccattgccccgcgctcacagggagtacaaggacaaggcggctgccgggcagctgcggcgctcaccccaccacttcagcgcggtgggcgcctcctcccccctcatcttcctgacgcggggctgggcggtgctggacggcccgggcttccccatcgtggccgagggggacgaggagcccaacgacaccttcctggagcagctgaccgcctcggcgcgggcggccgtggaggtgcgagtattcgtggctggnnnnnnnnnnnnnnnnnnnnnnnnnnnnnnnnnnnnnnnnnnnnnnnnnnnnnnnnnngcgatagtgctgcacggcatgtctgaaaaaggttccacacggatgcccgagacacgctggccccctctgtggctcggccgagtnnnnnnnnnnccgatagtgctgctcggcatgtctggaaaaggttccacacggatgcctgcgatacgctggccccctctgtggctcggccgagtgccaagttgcaactccccggcactcccacaatccacccacacctgtcccacccgaccctttccccaagcaatgcccacccccatccacccaaccaggaggtggtgcgacgcggcgtggcccacccctcagccgtggccatcgccgggcacagctacggcgccttcatggctgccaacctgctggcgcacgcccccgacctcttcgcctgtggtgtgggccgcagcggggcttacaaccgcacgctcacccccttctccttccagcaggagcagcgcacgctgtgggaggtgccggagacctacctcaagatgtcgcccttcatgcacgcggacaaggtgcgtcgcccgctcctgctcatccacggcgccgacgataacaacacggggaccttcacgctgcagtcggagcgcttttacgccgcgctgaaggggcacggctgcgtcacacgcctggtggtgctgccgcacgagagccacggctaccgcgcgcgcgagtcggtcatgcacgcgctgtatgagatgaacgcctggctggaccgcttctgtcggagcgcgctggaggggcagcggggggcggcagggatggtagcgggggaggaccgggctggtgagcagaagcaaggggccgcggagcggtcgggcgacgcgctcgtggccgcagccgcagagcgcgacacctgaggaggggttgtggcgtggagcctgaggaccgtgaatgccgtgtgagccatgatgtaagcactcttgcgctgcctggtgtggccgccttggcctggnnnnnnnnnngtgtggtgtggagcctgtagagcgtgagtgccgtgtgagccatggtgtaagcactctcgcgctgcctggtgtggccgccttggcctggtgtgcactgtacagaggggctggcccatgcaacagacggtaccagctccctctacatcggaccgctggcttgtggacacccctgagagtgcttcaaagcatggttgtcacctggaccagaagtgccacgaggcttacaacacaacgcttattgaacagcagcggcttcacgttgacttgcatgagtgtgacggtagggtacccctgcatgagcactttacaacgatctttccaggtaggatgggtctcannnnnnnnnnggttgaacagcagcggcttcaggttgacttgcatgagtgtgacggcagggtacccctgcaagggcactttgcaacgatctttccaggtaggatgggtctcaacagactcgttgagtgattcatcttcccaaagtgctcgcgtcactctcaactcattgccaggcaggtgtgcggtggcgccacacacccctgcacctcaccctttgacgtgccgcttcgcccacaccccctggnnnnnnnnnntatcttctcaaagtgctcgcgtcactctcatctcattggcaggcaggtgtgcggtggcgccacacgcccctgcacctcaccccttgacgtgccgcttcgcccacaccccctgggcgacactcccgagcttgctggcgggggcgcccaccccgccctcctcctcgtcgctgtagaggtaggggtcgtcgccctcgggcacggccggcctgggctggtccacctccatcttctggggtccgttccgctctttcttccccttggcgcgcgcctgcaggctggccaggnnnnnnnnnngtcgggcacggctggccggggctggtccacctccatctcctggggtccgttccgctctttctttcccttggcgcgcgcctgcaggctggccaggtcctggggggccacctggccctccgccacgcggcccacaaactcgttgtagggctgtgcggcactatacaggcagccctggcggtcgaaggtgcagaggggtgatggcgatgtgtgagctcaggctgacttccccaggcagggggcatagccttctttaccatgccgcaggcacttggctgggcaaggcagacccggtgcagcagagagtgacaaggcagcaggccaatgacnnnnnnnnnncttaccatgccgcaggcccttggctgggcaaggtagacccggtgcaacagagagtgacaaggcagcaggccaatgacacatcctgccatcatttcctccagcgacccacccccgtgaaccctccccacccagcaccttggtggcgcagacggagaccagggcgccccagttcccgtcctgggccagggcggcggcgttgcccaccaccaggagcgaggagcgggctcgggtcaggcccacattcatgcgccgctcgtccgccacgaagccgatggacccgcgccgggagctcctgaccgtggagaagatggccacgtccttttctcggccctggagcgcgtgttggggaggaggggaggcgggtgagcgtgtgattctttgggaccaggtttgtgggtacaggattccttggcgtctttgcctcggtctggagggcacagcagcacaagactaccccggaacaccttggaacccctgctccacgacctttccccaccagatggagtctccatgacagcacatccgcaggaccccgctccacctagtacctggaagccgtcgatggtgttgatgtccaccgtcttggccatgtccggccccagggcggcgaggaagaggcggcgcaggagggacacctgggccttgtaaggagagatgacggccaccgcggggcgcccccgcagctccgggtggcggtggatgagctcgcggtagatggacagcaccacctccgcctcagtggtgttgaccagggagttgctgccggcgggggtgccctccctccccgggacgtcgtagaagacgaggggcgcaaaggcgggggaggcgtgccaagcgcgcttggtttgcgccgcgacgtccgcgccgtccttgagcccgccgccgtagaaggtggcggaggggaactctcggatggcggggtgcatgcggtactgcgtgtccagcaccttggatttaggaaagagggcgttgggaacaagagggtgagacttggacagaggcaccgggggaaaggggggggggcccaggtcgtgaagtgcaaagtcaagtgtgcggtctggcgtgcagggggtgccccgcagtcgccggggtcaccagagagctacgcgccgattccctcaacacccagctccctttccttcccatatctgcaaaagatccctgagatatactccacacagacccccgcccccccgctcgtccccttgcacagcaagcacctgcacggggtaccctgcgctctgcaggcggctgaaaaggctgcccgagtagccgtgcgccagggcgcgggaagaaagcacggtggccgggagctgcaccgggtcgccgaccaggtagacctggcgcgcgccgccgtgcgccaggggaaccagcaccgccggctccaccgcctgcacattgaggaggggcaatgtgagggggcagggggggtgggggaagggctgcgcacgtgcacaccagggaccagcgagcctgagtgtgtattgcctgttgagacaagtggtgacactgcaggtcgatgttctcggagcggagcagcggccccttcctttgcaacatcatgcaccatgccatgggaaccagccgccctccacggacgccccaacatgcagcacagacaggaccatcccctgtcacgcacaccgcacctgcgccgcctcgtcgacgatcacgacgtcaaacttgcgcgcaagcctgacgaaggaggctgagccggagaaggaaagcgtggtgcacacgatgctggcctcctccaggatggccatgcgcgctcggtcccgctccagcctcgacgcgctcgacgcctgtgagggagggttgggcaagacggcggtggccttcgtctcacaatgctggatcgcttgttgggctgcaggggcgagccggggctgcacgaggaaatggtgcagcaaacaggcaacctcatcccccaatcatatcacatcaccacctcgccccccccacaaaaccatcctccttctgcaccgcccgcagctcgccttgcccgcctcggagccgaggcgtagcgtgaccagcgtgtccagcgccacgctctgcacgctgtggtggatgttcacccccacccgaaccacgctgggcgtgaaggccttgccgtccttgtcggtcaggcccgaagtgatcagccgcagcacgatctcgtccagcgccgagttggccggcgcgcacacctggccaggaggaaagggcggcgtgtggggtggggggcggttgggtgggtccgtggatggggatccccagctgaccattcgcgaagcctcaccatccctctcagctaccagacacggtgtgccccaccagcagcccccgggacccccagcagaatgtacagtccttccccttctaccccagagaataatcaccactcacgaggacgcgggccttgatacccgcggacttcccgatgcggaaggggatcgcgcgccgcgtcaggccgtagtcgtcgctggggtccgccagctccgccggcaccaccgccgcgcgcgggtcgggtgcgcccgtgagccaggggcagtgcgcctgccaggtggcgtgcacctcggcgggggtcaggctgcggcttggccgcgcccgggcctcgggtttccctgcctgcgccgcggagccctcgccggcaggctgcgcacgctgggaggaaaaggcgccgcgtggcgcggcgtgcaggacgatggagagcaggcccaggatggtcttggtcttccccgtacccggcgggccctggatgagcgtcagggaggtgccgtccagccccgccgtcactgccgcaagctgggaggcgttgtaggactcggccatggcctccagcatgcgcggcggggcctccagctgcttggccgccacgccggaggagctgggctgcacagggaggtgtcgggtgaagggtggcgagggacgcgggatgggggtggatctgggggaacccgctgccagtcatgcttgtactgagtgnnnnnnnnnntgcgggatggaggttagatctggggggacccgctgccagtcatgcttgtactgagtgatgaaggacagtgctgggacatgtggagccacacgagaaggggctgcccaactccaatacagcccttcagcacagtacagcctctcatcagccccgaccttggcggagaggaggacgtcatgcagtggggagtgggccatgcagtgcaccgccgcccactcgcgctggatggtgctggtgttggccaggcgcaggagccaccagccggagccggccacaggcaggagcgcgctcatgcgtttgaccctgggttgttgggagaatgcatggagggttgggtgggctggctggtcgcacgctcggggtggggcccagtatccgctggcccaggacaagagcgccggcgatgcacagcacggcatgccgctggaacccattgcaccgttactctgcagcaccggggatggccacatgcatcgccaatcccaacccacaacttgcctggccgtcccggcggcgctgccggcctgggccacttcggagaggttgaaccggactcgcagactctgctcgccctcgtgccccgccaccattcccagggcatggtgcacctcgtccgtgctttcttccgactgcagtgcacggcaggggatgtggaggacgccagactggtcagcgagcccctcggatgatggcacagcagggctcggtgcctgtacgcggcgcgccgtctggcagcgtttgggaatgacgatggactgccccacgacatcgcctgcagacctcggtccctgctacagccctcaccgctgcagcccctgcaaccctgtgcacctgtgggtcatctcgagacaccaggacgacatcgttctctgaaaaggagctgttgacccccggggggagagtgaggacgagcagcaagcgcccctcacccttgtcctcgcatgccgccaccacacagcgctgactcagtgcaacgctgccctcatcctggcctcgcaggagctgggccgccgcctcctccagcagcagcggctggaaggtggaggtgtaggcctgcaggggtgtgcggccgggcgccctggctggccagcagtcgtgcatgacgaggctttctcgtaataattcattcctggaaccctggacttcgacatgggcggagtcactcaggcccaccatgcagaagtcgcgcagtaacctgccaaatgcaagacagactgcgctcccacctcccacccaccatacccaccgacctggacgctggaaaaggtcttggggatggttgggagctgggatataggtcccttaccgtccgtcacatcccgttccagctgccagtagtcccaggactgcacgatctcctgcagctgagccgcatacccactctccatcccttcacagctggcgagtgtgcgccagcagcgttctatacgggcctctagtcgggcatcctagcacacccagattgttattattggtattttacccacttcgcgctctgcatgcattatactgtgcccacttcccaattagggatttgcgcgcgcagggtgctgggcctgctgactcctcttcgaactgcgatcatgaacgatgcaggagttccacctggggtgcaccacagcgcggcatgccctgtgtcatgtacaagagtcatcccaattttgatttctctgttcacatgacccattgaatcggatccagagtggatgggagtccgcgccttccatgggaatggtgccgggctaggactcggggtcggctgtggcttcgggatcggtgaggctggattctgaggatggatgcccggagcaacagtccaatgcatgtgctcttatcacgatctccgacctcaaactgcgcaggctggggctttggcgggaccaacctcggtttcgctgggctgggcgttggtgagtgggtggggaggtgcaacagcagaggcgcagggcatggaggcttgcatcctctatggaagcctgtcggcgtggtgaattcacgcgcattaactcccgtttgttaccatctgcacccnnnnnnnnnngagaggcacagggcatggaggcttgcatcttctatgaaagcctgtcggcgtggtgaaatcacgcgtattaactcccgtttgttaccatctgcacccttcctctcgctgggcaacacactacctcatcccgcccaggtggcgggtgcggcgtggggctcgggctcggctggggccacggcatcggactgggcgcgcagtacatcaacatgtcccccgtacgttgcagtgagggctgtgcagagaagctacaggcgtggatgcattcacacgaccatgtcctgaactgcacggctcacttcccctccatgcatccacccttacccttgcggccatttcctccgacgcaggagttcacagagagcaagagccacagacccaacgtcttccagcaggtcagctactttgtccgccgtgtctccaccctcaatcgtgggctgggcccctgactcccgggcggcaggcctgcttgctttccatgtaacacgacccgcccggggctgcaacagtcctgggcagggctcagaaggcggggggagagaagccaaactggacgcctgttttcacgcggtcgtgctcccgggccctgaccacccgcgtcaggttcagctccagcttgcccacccgggtcggccatacgatgcccgcgccctgggacagacgatggggagagggggccatgggttgtcagcatcgatggtcacttgcgaaacgcggcccgcgggtggaagagaagtgatccaaggccactggcgcgcggcatcgaatcttgtgcctggctgcagacgagacttctcgtcccaagtcgatgagcgtacaccctgcctggcgcaacgatgcccgcccgaggggcatcggtggccctccccctccctctgaggcccatttgcacggctcaccatggaccaccggaaaccnnnnnnnnnncctcgtcccacgtcgacgagcatacaccctgcccggcgccacgatgcccgcgcaaggggcatcgatggccctccccctccctctgaggcccatctgcacggctcaccatggaccaccggaaacccgacgcaaaggcggcggcctcctccctgcaggccgggcccagccccaccacgttgccgccgttgacaaagaggtgggcgtacagccccgccgcgcgtgtcgcctcaaagggcagctcgaagttcagagcgcccaggaaggtgcagaagacgtcgccgcccagcgcgtcgcgggtgcgcccgcccggcgccgccggcgcggcgggcgccgcc

SEQ ID NO: 33554 - DNA, 61 bp, Chlorella protothecoides
tatcttttgtagtaacaacataccgatgtggtttctggggtaagggcgggcacttgcacct

SEQ ID NO: 33555 - DNA, 128 bp, Chlorella protothecoides
gcctgtactgctgtgcgtctacgctggcaggcagcatgcagggccgctgttcctgcttgacgcgagttcatgtgcacagacagcatcatgaggacacggggaagcacctgcctgctatgtctttattc

SEQ ID NO: 33556 - DNA, 106 bp, Chlorella protothecoides
gtcagggaatcaccacaagcgattttgtatgctcggcgggccagaccattctcaagcacagagccaaaaaccatcctctggctctgctacttgaatgtacaacaca

SEQ ID NO: 33557 - DNA, 165 bp, Chlorella protothecoides
gactcgccaccggtgggctgctcggtgggtacatctccgccagcagaatcctcagcagcgacggccccgcctgtcggtggcatgctggcctccagtccctgctccgacacgccaccctccgcaccctcctctccagccgtggcggtctgcgcagtgggcccaggg

SEQ ID NO: 33558 - DNA, 160 bp, Chlorella protothecoides
attcctcgctcgaaacaccatcgtcagatggctcggaaagagaggaatgcagatcgcttccctcatgacgcatctgctctgccactcactcacctagacaagatcgatcttcccgaggtcggtgccgcaaggagcaggcatgccatgatgagggccaggg

SEQ ID NO: 33559 - DNA, 97 bp, Chlorella protothecoides
caaacgaatgagacgcggtggaggccggcccctcagatgcatggcgtcatgcgcattgcgaaccgcttcattgatgcattctctcgtttggtcatgg

SEQ ID NO: 33560 - DNA, 15284 bp, Chlorella protothecoides
  modified_base (394)..(403): a, c, t, g, unknown or other
  modified_base (709)..(718): a, c, t, g, unknown or other
  modified_base (1459)..(1468): a, c, t, g, unknown or other
  modified_base (1737)..(1746): a, c, t, g, unknown or other
  modified_base (2666)..(2675): a, c, t, g, unknown or other
  modified_base (4440)..(4449): a, c, t, g, unknown or other
  modified_base (5716)..(5725): a, c, t, g, unknown or other
  modified_base (6245)..(6254): a, c, t, g, unknown or other
  modified_base (6646)..(6655): a, c, t, g, unknown or other
  modified_base (7030)..(7039): a, c, t, g, unknown or other
  modified_base (7294)..(7303): a, c, t, g, unknown or other
  modified_base (7837)..(7846): a, c, t, g, unknown or other
  modified_base (8608)..(8617): a, c, t, g, unknown or other
  modified_base (14889)..(14898): a, c, t, g, unknown or other
  modified_base (14972)..(15024): a, c, t, g, unknown or other
  modified_base (15197)..(15206): a, c, t, g, unknown or other
cgggcacgaccgatgtgtggtgacggcgttttatcgctctgtactcgatactcttacgtcatatgatattaacaaattgaaaaatgcctcttgcgatgcgttcgtatccctactggccacgacggggtctcccgaaggggcgaaaatggcccccgccggacgggggcctctcggatccccatcagacaatttttcgcacttgcacatcttgctgaaacataatgtttggcttgagtggcacatgactgagcgattagtattgtcccgggttggccgatctgggactcctagagcgcaactcccccatagcagcagcaatgtttgcgtgcgcttgtctcccaacgcacaaaaatacatgagcggttgatcatttcgacaatgcgaagtcggtttnnnnnnnnnntaactcagtcgagtctgcaccgcccaggacactgcctgatggctgcatcagcaacaacaagccgatatgggaaaagccctgatgccatgccattacataaggtatgacattgtcttggggtgggcgctcggttcaagaaaagatgtcggggattgcaaaatctacgatatccccctgtcgagcgctcaaagactgaagacattgccaccggcaccatacttttcgaaagtcaaatattgagtactcgtactttctgcagggaggagttttggggtttattagctcttccggcgtcaaggacacacnnnnnnnnnngcgggatgttgctgacatgtaaaattcttgggagaggcatcccattcacggtatgccccagcagtgtaaggaggggccgacctgccagacctccacgaaaggatttgtgtgcgagtgcttcccggccccagactgccgcagagcatggtggtaagtggcatgcattgcatcctgcgacgccattccaaagtaaaccgaaaacaaaacgagtgtctccatcctgctcaggggggaccaagaccttgcacgacagcatcgctgttgtcgagactgtgatggccgctgtgacgagagacctcttcctggatgcatccaccagctatgtaatgggtgagctgattgtgggttcatgaagggatggcttgggagcgcagtgcactcgaggctcgaaactggtcttgccttggaagattccatctgtaggttcactggcacgaccacgcaggggaggagagccagaatcaggctgctgagcaggtgatgcaagagcatctgggccgtcatgtcaattacctggacgagaacttcctggaagtactgcagcagtacattgccagcagcaaggatgagcgcatcaccggtgaggcccagcacgagattccccaggagcgtggtgctgtgacgcgggggctctgcgcctgaaattaccccttcaagattcggggttcaagcattgtctcctgcggcatggctttgctgccgggtctcttgtatccagccatgctgcactcttggagtgcnnnnnnnnnnacgtggtgctgcgatgcgggggctctgcacctaaaattaccccttcaagattcgggggtcaagcattgtctcctgaggcatggctttgctgccgggtctctggtatccagccatgctgcactcttggagtgccatcccttccccggcattcatgccgtgcacccaccttgcagacctgctcaagctcatgcggcaacaggttctgcaacagctctcgcggcaccttcagtccgagctacaagtgctgacggctctcagcgactgcaacnnnnnnnnnnttgcagcagctctcgcggcaccttcagtccgaactgcaagtgctgacggctctcagcgactgcaacaccaggcgcgaccccgccctgaggttgcagggtcggacctgaggctacccggtcactgagaggagcctacttgcaagcgcctgacctcgatgatacgcccatcccttgcagggaggcccggcaagcaatcatcgagcagtacctgtgggcagctggcactgctctgccgtcgcagcctgcatcagcgaggtcaggcgacgatgtgccagacgaagtccagtcccccacccagcgcatcagggcgctggccaacgcagcttcccaggtcatcgcgcacatggaagctgcagacaaggtgatgatttgggtatcctggggtcaaggcatgggcctgctgctgtgtccgggctgccatcaacaccctggtgcttgacatgccggcattgcccttctgttgggtcagaccctcaccccttcccagtcagggcaactcacccagctcccgtctcctctcatcatacaggtcctggatcgccggctgctggcccgcctctgcctcgtcctgctcgacctggaagaggaaacggcgtcccccgggcgtgacgggcacggcgcggtgactgcggtacccaatgccatgcccagccccttcttctttgacgccgactcgctgtatgtgcggctggaggtcgtgccaccccacatcatggcctttgtcaaggagctactggccgtgccagggccggacgagaggtggggtcgcgtttgggagggaaggggaaggtggctgcatagctcaacaattaaagggcccccctgatgctcttcctttgaccaggactgtgcccaattaacccccagtggccctctgagctgttcatgtatgtgcgtggcagggcaactgatgaagtccnnnnnnnnnngggctgcatagctcaacaatcaaagggcccccctgatgctctttcattgaccaggcctgtgcccaattaccccccagtggccctctgagctgtccatacatgtgcgtggcagggcaactgatgaagtccagattgaatggggccttggcggtacggagtaccaaacctctgagcatccatccacacacaggatcggggcattaacgagggcgtttgcgacggggtggagcggccgcccgggcgctgcatcctccaaggacgacatccggcctgggaagttcctgtatgtcctcggcgccatcagggcgctgctgcccgctggtgccaaccagcggggccccgccctgggtctttcggcctcgcccctcgtcctggagcgcctcgccgccatccagcgagacgcacgggccgccctgatccgggcaggcgggctggcggactgaagaggcaacgggtgacctttgtgctgccggggttggatgctgggaggtggacggcggtgactggttccgtttcttaatcgtcggacacttggcatccacgcagttgtttgcggcctaggatttttgccgtgtggccaaggctgcatggcagactcacacccagtgcactctgtgcatgtcgtaacatcaaattcttggtgagaatattccacatcacatcccctgctcccctgctgggaggtcacccaccccgttgccggtgttacaatggaaagaatgggtacctcaacctctcgactccttcaccataggatcacccaatgtgatcacagcaactctcagtcgcgcagcaggtcgtaccaaacacggggcctgggcaccacccccccacccagcgccgcctccagcacggcgccggcatgcagcaggccggcctcgtgccagggcggggccatcagctgcaggcccagcggcagccccgccgcatcgacgcccacgggcagcgtgagcgcggggaagcccaggaagttggcgggggtgatgaagcgcatgaggcccagcgtggtggccaggtcggtctcgcccgcggccagcgcgccgggcttgcagcgcggcgcggcggcgggcgtggtgggagtgaggattaggtcgcaggcggcaaaggcgcggcggaagtgggcctcggagcgtgtgcgcacgcgctgcgcgttcacgtaaaaggccccggtgaagcccaccgcgttggtcagcgaggccctggtctccccgtccagctggcagcgcaccgcaggcacgctgagcgggcctgtggaggaatggggtgagaggggagtcggggggttcattgctctggacactggccgggcaggaccatcgccgcaggccagcctgtgcagggatgtcgatgtacgactggggaagctgcggttcgacgatcgatgagaggtgtgggccagccctgtcaccgtcgaccatgcggtccctcgaccccctgccctcacctccgggcagacctacccacccgacatggcggagcgcatctcgctgcagatggtgacgctgtgtgcgaggcgttggtgacggagctccgggatgacgatgtcgaccacctccagccctgcaccgcgcagcttctcgacagccgccctgcaggcagccaggacctcgggcgaggcgtcctcaaaccactgcagtattggttgttgtgaaggtttctgggatactggtgggctggagggggacttttggtgtggtgcagggcaggatgcacatcagaccgtcggcgtcgcacgggtggctgtgtgccagggtgatcatcgggnnnnnnnnnngttgtgaaggtttctggggtactggtgggctgcacggggacttttggtgtggtgcggggcaggatgcacatcaaatcgtcggcgtcacctgggtggctgtgtgccagggtgatcatcggggacgagagacacacaccaagatgtaccaccccttctccacccccgcaggcttgccttccagtagatgccggcctgcttccccgccagggcccctgagaggtcctgcccggcccgcggcagccccgccgacaagcggaccggggggtgtgtgggcccggggtcaaagccatgtggccccgcacacgatcccggccccctggccccggccatcaccgcgtacgccagctggcagtccgccacgctggcggccagcgggcccagcacagccacggtgcagtccacctccggcccctggctgtggtccaggcggtcgtgcgtgggcttgagccccacacagccgcagagtgcggcggggatgcggacgctgccgccgccgtcggagccgagcgccagcgggcacagcccggcggccaccgccgccgccgacccgctgctgctgccgcccgtgtggcgcccggggtcgtggggattgcgcggcgtgcccagcaccgtgttgagcccggtggtgcccagccctatctcgtgcgtggccagcttgcccagcagcagcgccccggccgacagcagagccgccacggcggggttggtggcctcgacccggcgcctgcaaagtggtgggcaggggtctcatcgggtggtcagggaggcaggagggaatgtatgatgagccgcgccgcacggtgggtgttcatgctccgataccatccctggtcacccccacgcactttccccctgctccagccaacacccacccaccagtctgccatccaggaggtgccggcggtggtcttgtagcccagcacgtccaccaggtccttcacgccaaagggcacgccgtccagcgggctgagggggctgccattccgccagcgctcggtcgaggcggcggccgcggcacgcaccttgtccggatcgaactcggtaaagaggcacatggcagggtcctgagtacatgggtcccgggaaagtggtgacggcatcaactgtgcattgcctctacctccaagccggcccttggcgcaagatgtgtctgtccatgggggcaaggcacgctgccccaccctacacatactagcagcctcccacctcctcaccagctcctcgctggccgcgacggcagtgatgacgcgctccgccacctggctgnnnnnnnnnnccattgcctctacctccaagccggcccttgtcacaagatgtgtccgtccgtgggggcaaggcacgctccctcaccctacacatattagcagcctcccacctcctcacctgctcctcgctggccgcgactgcagtgatgacgcgctccgccacctggctgggcgtgctctgcccgctagcgtatgccctgcggtagtctgcgcaggtgtgctggcgccaggggccctggtcggttgctggatcctcgccgaaagtcagcttgaacgccgcgccagctcgctccacatctgacagctctggttccagctccaccatgggcccctgctccggccgccaggccctcgtgttgggaaggaaggtcggcatctcggggatgaacgtctcgccaaacagctgcgggggcagggagtgggcgcgggccagagatcgagtttgctgccaagtcatcggaactgagagtaagattggtgtattgaagtactgatgatcgccagccagtcactggcgcttcaactgctccnnnnnnnnnnggtctcgccaaacagctgcaagggcagggagtgggcgcgggccagaggtcgagtttgctgccaagtcatcggaaccgaaggtaagattgatgtattgaagtactgatgatcaccagccagtccctggcgcttcaactgctccaaggcagggagcccctcaccccagcacctgtgtgaatccattatcacgcaagagcttcccgcggacaatgccaaagagggaactctccatgaacctcacaaacaacttgaatggtttgcctggagcgagggggggtagagggccattattagatgttgagctggtgaggtccaagcccaggtgatgtgcgatagaacaatagtaatgcaccgccctgccgtccagagcaagtcaagcacgctcaccaggnnnnnnnnnncattagacgttgagctggtgaggtccaagccgaggtgatgtgcgatagaacaccagcaatgcaccgccctgcggtccagagcaagtcaagcacgctcaccagggatctcacctgagatcgcaggagcatcaaacacctctggcacatagtcatcatcatgcagctctgcagctggaggaagaaccttgatgttggatgccatgctgcctgtgccgatccccaggactgatgagctatgcgtcgcgaagagaggtgatcgggatgccgtgctaattttcttgactcatgctgtccatccctgccagtgggtcgtatctggcctctaaggaatcccaggtgtgcctgtgcttccaaccaggtggcgcaaggccgagnnnnnnnnnnatgggtcgtatctggcctctcaggaatcctcggtgtgcacgtgcttccaaccaggtggcgcaaggccgaggagatcatgcagcaagcagtcggattcgtgggtccgaaaagcaacaaccccccaattaacatttctttacacattagtcaatgctgccgccgacctgcattcggtaagcgggaaggtgcggcagtgagtgaggacgaggtcgaactaaatgctgtggacaatacaaagggccctgctcatgtgtnnnnnnnnnncaagcaacaaccccccagttaacatttctttacacattggtcaatgctgacgccgacctgcattcggtaagcgggaaggtgcggcagtgggtgaagacgaggttggactaaatgctttggacaatacaaagggccctgctcatgtgtgcatgaacgccagggcgctcaaggctcacggacgtatagcagtgccatctattggactctttccccatatcggtcgaaggatgttttacgtgacttcaggtcgaagatcccgtaaccttcgactcccgaaagcagcgcgccacgttttccaggcacggattctgtcatattaagacgcttctcaagtaatcaaccaactacttaacaccggcatcaacattctgcagcatattgagttgaagatcacatatccctccgcccttcgcgctcggttcattgagctaccatgtcgctggcgatgacgtcccccgtcacgatgaaagtgaacgcgcagtgcgccccctttgcccagaggggacagatgagtgcttccgtgtctcggtcgcnnnnnnnnnnaatgtcgctggcgatgacgtcccccgtcaccatgaaagtgaacgcgcagagcgccccctttgcccagaggagacagatgagtgcttccgtgtctcggtcgcgcaccgtgaccatggcagctgcctcaacctttcagagcaccaaggtgcgagtcagggtttgggagcagctggacctcctccggagctactcgcggacttcagggtggaatgctactgacggaaccgtgactaatatctcgtaggagtgtttgaaattgtgcaacaatcaccaaacaacgccctcgccgtcccgtgcaggccccggccacgctgaaggccgccaaccagcttgaggccctgaagcagatgagcaaggtggtggccgacaccggcgaggtggatgccatccgccggtacaagcccttcgactgcaccaccaaccccagcctggtgtacaaggccatgcagctgccagagtacgagccgtacctgcgcgccgccatcgccgccgagaaggagtcgcacaagggtgcccgcccctacgcctacatcgccgaccgcctggcggtcaacattggcgccgagctgtccaagctggtgccagggcgggtgggtggaggcggtgtgtgtgtgcagggaggattggtgccggggagttggcgatcaggcctctccatggcaggtgtattggccccagtggtcgcctgcttttaatgattgcagatgagggtcgtcccctcagtggcagattcaggggccccaacaatcccaacaatccatnnnnnnnnnngggattggtgccagggagttggggatcaggcgtctccatggcaggtgtattggccccagtggccgcctgccttcaatgattgcagatgagagtcgtcccctcagtggcagactcaggggccccaacaatcccaacaatccattccttcacgccccacaccctgccctgcacccaggtctccaccgaggtggatgcgcacctgagcttcgacacccaggccacggtggacaaggctctgcgcctgatcgacctctacgccgccaagggcgtggacccctccaagatttacatcaaggtggcctccacctgggagggcattcgcgcctgtgaggtgctgcaaaagcagggcatcagcaccaacatgaccctcatcttctcctttgcgcaagtgagtggcttggaaagtggaaggggggggaaaggacctccgagttttcgatcgtggctgtgccatgcttcctgctgggtggtggatcagacacggaatgcactctgtcctttgccatcgcccctcataattgccccaaactccacaactctctctcatacccctcccccccaccacacaaaaatcacccaggccggggcatgcgccgacgcgggcgcgtccctgatctcccccttcgtgggtcgcatcctggactggtacaagaaggcaaatgggcgcgactatgcgcctcacgaggacccgggtgtggaaagcgtgaagcgcatctactcctactacaagcagtacgggtacgacaccatcgtcatggccgcctccttccgcaacatcggcgagatccgggagctggcggggtgcgacaacatcaccatctcccccgccctgctcgccgagctggaggcctccaccgaccccctgccctacgcgctgtggcccacccagggcggctccaccgacccccactacgacctgtcgggcaaggcggagggcaccttcctgcagatgcatggcgaggaccagtgagtttgacaagggatgaggggggggtatggctggatgtctggagggcgaggcctgaagggagagtctggtgttgagagcaggggcctctaaatttggaggggggcacacgagatctccactccatggcctgcgtcaagtgattcgcatccaatctccgcccttgtgtccgcccaggatggcgctcgacaagctggcagagggcatcaagggctttgccgccgaccaggacaagctggaggtgcagatcgccaaggccatgggcgcctgagcgagcgaccaaccgaacgacgccgagaggctggccgccgatgcgctgggggctggggcgccgtcggcactcagaccgtggccacccgagttgtgttcccgcccccgagacaagacaggaaacgaatcagcaccagcggcttggaagtcatgtatcccgcccatgaacaccgcgcttccccactgcatgccctgtgtaggatgatcatgcgagagccacgacagcgttcaaagtggtgggcagttgttcaggtggcagcgatggacacaagttgggggagaggtgtctcctgcagcattgggtccttgaaatgtgcaagcaaagagcatggggaacagcatgaaaaccaaaactaagctgccgcatgcgaccggcagcaggggttccctcgccccttccaggggcgtacctcgctggctcgggatgtatcgcgccacacctcacctcccacaagcgaccctgtcatcgtaccacgcgatggcgtcattgcagcgggcactgggcggcgcacccatcccgcgactgggcgaggctgtgcagtatcaggccggcagctcgctcccccgaggcccaggcgccgtgcgccgtggaggggtgctccagggatgccgcctcccctgcaaacaccaggctgccgctcaccggctcccccagcgtcgcccgatccgacggcgagctccccacttgcaggagggggcgggggagggtttgcatcttggcacggggttgaaaccacttacagcagggcatgtgagggaccctccccgttgcccagagcaacatacactccccagcccactctggaatacctgggtagtaggtgtacccccccagggtcaatgggtcccggtcccagcgcgccagttcccagtgcagcggcgttggtggagtcccgccgcccagcatgctgcccagcgtggccagcacggcggccgccacctcgtcgtctgcctttccagccagactgtccagggcaggccccgtcagcgtggccaccagggcgggggaccaggtgagggagtagaggggcgtgaagcggacccagccctgcgcctggctggcggtcccgggctcctgcgcgaagctttgccaggacaggtcccaaaaaggctgggcaggtgtgtatgggggaatgggggaggatgtagggggtcgggtctgagtgtaagagtgtgcctgaccgatctgacagatcatgcggggcgtcatggccaggggatgccccccgacccctgggcaagtgaatagcccagagagccggcttccctcatcgcatccctcctatccacccagtaagccaccggacctggtcaaaccagagggccaacgccgccgcgccgcccacgcccagccgcctcatggctcgcgtcagctggtcgggcagcggcggctggatgtccacagcgccggtgcgcagcagccccagcggcagcgtgcacagcacgaactgcgcgctgagcgccgcgccagacgcgtctgtgacgccggcagccaggtcgccgtggctgatcgatctcacggtcgtgcccaggcggacgtccaggtcggcagccaggctgtcgaccactgcccccagtccggacaccaccaggtcgtccacgccggaggtcggccccacggcaaaagcgtaggccagggagaggctggaggcgtgggcaccggcctgaccctcgacgagccggatgcgggccaggagggccctcctcgcggcggccgtgagcggcgcagaggccaggtaggcatccactgcgtcttggagggatggggccggagcggggctgggcgaggggggtggcggcgggggcggctggcaggatgggagcgtgccctcactgcagggcgccaggctggggggcgaggctgtcggtaccccgggggactgaactgttgagctgtgagcaggggtcgagggacccagaggcggagagccctctgcaacttcgtccccctcgtccgacccgggtgcgttgtcaggcgacagcccctccacgatgtctgcgagggttgcggtgcacagggcctcagcagccgccaggaagccaagccaggtggagctgctggcgagcgaggggtctatctctgcgttgccgctgccaggcagggccaagacggtctgggagtcccagccggggtcgaagatggcgcgcttgaccccgagcccagtgaggggaggggccaatgggttgctgatgtcgccatggaggacagaggccccaagctcggcaggtgagtcgtcgtaggtggctgtttgtaccctgccacccacccgatcctgtacgtggggccgggtgctcgggatgaaggatggtgggggggaagacgaagcacaggatgggggtaccaatcaagcctagcgcacacatctggacagcatggttgcttctgcaggcccgtgcgacatggtactggatgatgtcctgctcccagccctttaaattcaatcaccatggagttctaaatccgatatctcaccctggcctccaggacgacgacagacaggcccgccgcctgaagcttcgtagccgccgcgatgccagccaatcccgccccgatgactatgacgtcgtgatcgacgctcattccctggctgttgagctgcgcactattcaggtaggtatgcagggatccatagtaggcgggcgggtaagaggagctgtttacggagtccagtgtcccggagtagaggtcttgcggccccgactccgcggcccggcccaacaagcccagactcgctaggactgccagggccgctgcagcagccacgaatatgctcataatggtaatggcaccaattatttgcacccatggagccggccgggggggagcgctcgcctgcggaaacctgggcccggtctccgtcgacgaggtcccgacctgcacatgcaccgtggccgagcgctctttgggccatgcttccatacgagcatgtaggcgtttgaacaagtgtttgaggttcgaatcttggtctcgcacaggacgctaggaggtgcaggaaccccacatgacctcgacagtctcggtggtcaaagagagggcgtcacattgccatgcagctgcagtccaaccttaccccagcacaggagcctcctgtcaggcggcggtgcccggactcggctcgttcatgagctctcctggcactcaccagttcgtttgcatcattttgcaacacagcctcgtcaatcaaatcggatgtgcctgctgccactagcgtttgacgaccctgaatgccctgcaatgccatccgcagcttcgagtccttgggcctcccttcttcgcgatctcctatggccgtcttgtcccgatctggcgattggggcaggagacagaggatgggaagggttgcgtgtgtcttctcttgcggcaggcgcagccccctcctcctccaggctgagactgcgctccctgtgcttcctcttcttcttattctgcttctcggcggcctcctgcgcagcgatgcacgggggcgggaggtgtgtcagtgggcgactcgcatcactttcaagcagtggctgagatcgctgccgatccttctcccatcaccatactccgcgtgcaccatcacaatgtgagcggcaaccttccgccctacctgtgctgccggggattcactttttcgcttcttcctggacttcttgtgagggcgctgtggtgactccgggtgtgcaaccggcgtccgcatgaagagcacagggtccaagcgcagcacgcgggcaaggatggactcctttgggctagaaggtgccaccatccgcagatatgcatactcaaacgcggcgcgcacctagtcggtgtggggttgagggttgaacatgtatgagtgtaatactgtgctcttgaggaaacactagtggctgccaggaccttctaaggggcggtgagcacaagcagccctccagtcccctccagtctcaccctgctaatgttgtaagagtttcgggcaaggtcattggtcgggtcgcaggggtcctctaccgcgagcaggtagggacgttcactctgaaagggttgaggtgagatggggcagcatggcgaccgagaagtctcaagaatctgagctttgcctggaccacacacgtgtagcagacaggtctggagtccacatgtcaactggtgatgcctccgtccggggcgcactcaccgagtagaaaccggaggccgacttcttgatgtaggctcccccgttgcggcagctcacccccacctgcggaaggttggtgcgtcggcgatgctgcagattggagcagcgcatcccgtggcgtgccctgcctctctcggcctcccaggatgatgcacaacctgcgcccgcgcctgtccccttccctcacatcgtaagtgttgagtgtccggccgtagagcctgaagaagtcgatgagcaggatgcccaggttctgctccaggtcctcaggcttgctgggccccttgccaaagcgtcgggagggctgacgggaggggtgcagctgcaggaaggcggccaccagcaccagcagggcgtaggagcccaggccacctgcgtagacctcattcaggtcgcgctggtgcaggaagaccttcaggaccatgaccaggtgccgcatgggcggcaggacgtccatcagcgccctcaccgactcggccgcctgtgggtatgggggacgggaaagttggggggtgcacttgcgcagcaggcgggggttgcaggcacagggatggcagtgcagcggcgtgtgccggctttcgtggaccaccagtgcccttcagcccctgcttggccctgcagcggctgagctgcaccagaggcagttgcaggaaggggtgcctctccccaccaagcaatcatagcagccaccccttctgctgacacacctctggcccattggccacatcaaaggagatgtcgaatttgtaacacgactctgcctcctcaaacttgatgatggggaccttggccttggtgatcacctggtacggtgagggaaagggtgcaccaggtgtgtgaactgtttgctgtgaacagcctgcgccgcgtgtgttccggtccacaaggtcgtgctggtnnnnnnnnnngtggccctgcaatggctgagctgcaccagaggcagttgcaggcaggggtgcctctccccaccaagcaatcatannnnnnnnnnnnnnnnnnnnnnnnnnnnnnnnnnnnnnnnnnnnnnnnnnnnnggtatgcgcgccgccctccttgctctgaggtccaccccactcaaaacccccatgcccagccctgtccattcccctcccccccggcatcagccttccaaacccaagacaccacgcccttccagcgcgcctaaccccgcgccagccacccaagcccccccccccccccccccccnnnnnnnnnntgtatgcgcgccgccctccctgctccgaggtccaccccactcaaacccaccaagcccagccctgtccatccccccccc

SEQ ID NO: 33561 - DNA, 91 bp, Chlorella protothecoides
gtgcagttcccaccctgcaaattctcatgcagggcctgaggtgacggcttgccatctcaacctgccggccagggcatgcaaaccttgaagc

SEQ ID NO: 33562 - DNA, 78 bp, Chlorella protothecoides
gagcaatcagcttgatgtgtgggacctcaacctcggggaggcgctgaccccagtcctccgctgcatggttggcggggt

SEQ ID NO: 33563 - DNA, 79 bp, Chlorella protothecoides
ctcgcagaggtcggtgcggggaggggtgcaacggcgcacctgggcttcaaagacggcgaccggcaggagcttgatttgg

SEQ ID NO: 33564 - DNA, 180 bp, Chlorella protothecoides
gggggtcacctgttactcctccatgctgcctgtcctggatggacaggtctttgccgtggtgcgaggggattggcagggggatgattaattccctgggtgagttcaggaacccacattgatgtttgggtgaccaggcgcatgtgccatcctacgcgcagaccatcctggacgagtgcagcc

SEQ ID NO: 33565 - DNA, 89 bp, Chlorella protothecoides
tgtgatcgacgtgcgcgtgacatgcacccaacaggtatcaagcgacacaacacttaccatccagcgcggcgtcattggggacccaggag

SEQ ID NO: 33566 - DNA, 13733 bp, Chlorella protothecoides
  modified_base (476)..(563): a, c, t, g, unknown or other
  modified_base (639)..(648): a, c, t, g, unknown or other
  modified_base (724)..(733): a, c, t, g, unknown or other
  modified_base (944)..(1046): a, c, t, g, unknown or other
  modified_base (1464)..(1473): a, c, t, g, unknown or other
  modified_base (1883)..(1892): a, c, t, g, unknown or other
  modified_base (4043)..(4052): a, c, t, g, unknown or other
  modified_base (4244)..(4253): a, c, t, g, unknown or other
  modified_base (4674)..(4683): a, c, t, g, unknown or other
  modified_base (5008)..(5017): a, c, t, g, unknown or other
  modified_base (6989)..(6998): a, c, t, g, unknown or other
  modified_base (8064)..(8073): a, c, t, g, unknown or other
  modified_base (9431)..(9440): a, c, t, g, unknown or other
  modified_base (9818)..(9827): a, c, t, g, unknown or other
  modified_base (10032)..(10041): a, c, t, g, unknown or other
  modified_base (11622)..(11631): a, c, t, g, unknown or other
  modified_base (11887)..(11896): a, c, t, g, unknown or other
  modified_base (13084)..(13093): a, c, t, g, unknown or other
  modified_base (13270)..(13279): a, c, t, g, unknown or other
gggacggcggcgagcgcgccgccgccccggtctcctcctcgggggcgggggccaggccggtggtggccggctccgggaggggggcctggagctccagggcggggggcagcgcaacagtctctgcagcaggggcctggccgccgggaagcaggctgatgacgccggcggccgcagactcagggccgggctccagaccgggcagggccagcgcctcctcaggcgagggctccacggcgggggtgtccagcacgctgtttacgctgtggagggtaggtgtgatgagggtggcatgtggaggaatgaaaaggaaagggggaggagtttgatgaggggccagccccagccacgaagcttgctggccagccgacggaggcgtagaacagctgctccattgccacttgagacgcaaatacaggcacccactccatcccatgcatgcttgcatgcaggcagggacgacacactgcaccactcannnnnnnnnnnnnnnnnnnnnnnnnnnnnnnnnnnnnnnnnnnnnnnnnnnnnnnnnnnnnnnnnnnnnnnnnnnnnnnnnnnnnnnnagccccctcccttccagacttgcatgccctttgacgcagagtcccctcacccgttgacaagtccggaggaagcgcnnnnnnnnnnggccccctcccttctagactcgcgtgccctttgacgcagagtcctctcacccgttgacaagtccggaggaagcgcnnnnnnnnnnaaacagctggctccattgccacttgagaggcacatacagccacccactccatcccatgcatgcttgcaggcaggcagggacgacacactgcaccactcacgaggcctcgggctcaggagtcgtcctgtgagccagggatgggtggtcgagagtgttcacaagaatcatgtaaataatcccaaggatggcaccttcaggcagacaccgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaaactgcacgccggtctgaatgtcgcccagctgaccctcttcggtgatggcgctcctgcgtcgagggaaaggtgcggcgctcgaaatgtgctaccacagggctgcagcttaaagttggcatcgctcgcggacttgccagtccagggactcactggacgatcagcgtgtcgccgccgcgggtgatcctgatgtccaagggcagggagggcagggatgaggcgtcccacgccgcaccgaacgacctcgccaggggagcccagtctccctgtggtacaggattgcgtgaatataggggggtgagagtccctatgccagagtccgtgatatcggtgaggcttgcggagctgccgtccgacgcaaccaccgggcgccccttccagggtctgatctgagtgtgacgcttgcccccttacnnnnnnnnnngcaggattgagttaatataggggggtgagagtcctatgccagagtccgtgatatcggtggggcttgcggagctgccgtccaacgcaaccaccgggcgccccttccagggcctgatctgagtgtgacgcttgcccccttacagtcctctggcagtacctgggatccgctggtccgcagctcgacggagtcgatggggccctgaccggccactgacaggagcacaagccggaggtaaccgcccagcgtgggcctaaaggtgtcgatcctcacaacaatgtcgccgggaggggcgcagggcacctgcggggcggtgggggatggcctgagcaagtcaagtgatagggagcagcaggggatgctggtacattttggaccgtggggcccctgggcaggctgtgcgggccttgatnnnnnnnnnngaaggtgtcgatcctcacgacaatgtcgccgggaggagcgcagggcacctgcggggtggggggggatggcctgagcaagtcatgtgatagggagcagcaggggatgctggaacattttgagccgtgtggcccctgggcaggctgtgcgggccttgatcaggcgctcctctgtcatggggtgctccttgcaccctctctgcacagggtctacactgaaagccttccagcccttccccccaaagcgccagatcgctgccgcccaggacgcaccgcagtggcacggcctgttgccaggccgatgctgggactgaagctcttggcatacgcggagggggacacgtagatctggctgaggtcgcagccgtcgcagttgtcggtcacgagcgcaatgaaggcgccggcggcactgccacacacctgctgcagggaagagggcgcgaggagatcctctgagcagggaaaggatgttcctcgcagaggcgcagcatggacgtgcacactcgtgcttggcaagctgatgcggcgcagcaggactctggaggtccttgagcgtcatggacacaggctgtccgacgacccttcccctgcaagcagattaagccttgcaaacgccctgggccacactgcccagttgccccccagcaccctgcaaaaccaacctcgtctgtacactggatctccaggcaggtgccgcacccttggggagcggacccggccaggaaggggctgtccgggttgaccacggcaatggcgtcatacggccagcttgaagcggacagggtcccgtacccgcaagccccggagccagctgggctgtcctggagagacgtgggagggagctaggggagtgagccgcagtggcttcctcgattacccgggctgatcccgccgcccgggaagtctcgccccgcacgatccacctcacccctccactagcagcacttccgacagtcacaggtgtccagctcgtctggcccttcgccacagcaagcagcgccagcaagaacccaagtctgcgcgagacactcatggtcgcgggtgcttcttgtcgcggtctagttcaatacgctcaataagctgtgggcactccaacccacttctaataacgctataatgtagcgtaaagttgtgagagggggtgcatgtggcgcgctgatgccccatcaggtaaaattctaggatggtccggcgtcagatgctggaagcctgttacccgccatctggtgcccacgtgatcgggcatgtcatgtctttttccatgccgttgccgcgttgaacattcatcgtctcccagaaaaaacgcaccattaaaggcgaacccacggcgtgtgaaccaccattacatattttagagcaacccagccctgacgtgcctctgcaatcatgacgtaccgtctccgtatctcgctgcttcttgcatgggcaatcgcgcaagcatgtctatcccccgcgtccgcggcctggcagggattgcccgctttcggcgcggtacaactgtgcgtgccctataacgtccaggtcaggcccggcaccacctacgccctgtccgtggagggtgatcagagcgtggcatctgccatcacaaccggagtcaccgggaacgtgctggcggtgggatccaacggcttcacgagctcccagcccatccaagtcgtcattacgctcccgagagacaagctggtgggggtgtaccagaacggactccaggccgctgcctacgttgcaccaggtattgccacgacgtttcataccgggcatgggggaggccaccgagtgaccagcctgcatggacaggcatgacgcgcacccttggttacttgaagcccctcatggtttccagaaactcatgaccacaggattcaacggcggggcgctgtccgtcgtctccggcttcggagcaggcgagatcttcgtctccggagcctcctacaacagcgtgaatgtcgagaacagcgggtaggcttttcactagtggatggctggcatgttgtatcctgcccgttgtatgctggtttaatgctgtgatatctgtattcccgttcttgtgtatagcttttgcactgcatgtcctgagttcatgcggtttctcatcactagatcccctcacactcgcaccgtcgacaggactggcgtggtcagcctgtcagggtnnnnnnnnnnaaatgctgtgatatgtgtatttccgttgttgtgtatagcttttgcgctgcacgtcctgagttcatgcggtttctcatcattagatcccctcacactcgcaccgtcaacaggactggcgtggtcagcctgtcagggtcgttcaatgccgtcaacctgcaggcaaccggcatcaccaacacctacattggcggnnnnnnnnnngggatcagcaacgtgtaccttgcccctacgagctcaagcgtcaagatcactgggaggtgggttgaagaggaagggcggggacagttgtgtccattaggtggcgttgtagacacatggggcttggcaaacggttcctgatcttcatgccaccacattgcatacccttgcagggcttcgggcatctcgtctgtgcaatacagccagggggcctgctccgtgcagtccgatttcccactgcgcagcacctgcgtgcagagttcgggcctgaccatccaggtgtgcgtatgccttgaaatcttttccttgagtgggcagtgtgtgagtaccttgtgtggagtcatgtggtctcttagaaggataatgctctcctttgcgcctggcatgatggtcgtgcatcctcctggcgcttgaagcgtgttcnnnnnnnnnnttgcgtgcagagttcgggcctgagcatccaggtgtgtgtatgcctaggaattctttccttgagtgggcagtgtatgagtaccttgtgtggagacatgtggtcccttggaaggataatgctctccttcgctcctggcatgatggttgtgcatcctcctggcgcttgaagcgtgttccatttagtggttgggcatggccaaccatgccctaagtgtcttctccggtatatttggtgcaacagcagtgcctgatgtgcccactcttttcctttccccttctcccccgtcttcaaacacaggtgccttctgagccccagtggacatctnnnnnnnnnnctctccggtttatttggtgcaacagcagtgcctaacgtaaccactcttttctttccccttctcccccgtcttcaaacccaggtgccttctgagccccagtggacatctggcctgactgcccgtggcaccttcaactgcgtgggttccagcggcagcacctcctcctccaccgccagctcccccgtgcccacccctgtccccaccccccaggccagcccctcccagagcagcgcctctgcggccgccacggcggtgagcagcccggcaccaacgcagagtccctctcccagcccggcatcgcccagccccagtcctgtgtcgccctcccccagccccaaatcgccaagtggcggctcctgggcgccggcgcccgagcctgaggccgaggccggatcctacaactttgccacccccacccccggcggcttccagtcccagtctgggtctacggggccacagggcaacaacgccaatgcggtggcccagggcaccaactcggcctcggcatccagcacggcaggccccggcggggtcagcactcagacctccaacgacggcaccagcaaccagctgagcacggcagggtaggggagcaagtcccgcgcgcagcgtttcctattctgtgcatgcatcctttcctagcgattccaaacgtaaactctgtgtgaaacctcatgcgtggccctgcaagatttcgcctgggctccctccatgcgtgcactttgtctctcttccctgcctcacactggacaggcccgtgctcaacctgacgccccacctccattgactggtgtgtgtacatgatttagtgagatgtcagaggggggtgggtggaacgatggggttccaaaggtgtttgcggcatgcgcagcattgcagaatggtgttcctgggcagagacaagccgagcggacagcggataagagagcgagcgacatgacaatacaagataccaaacagtgcacgacactgattgcaagctactgctgctactgagactagaacttctagatatgttgtgaaggtgaggacatgatgagccccatcagagcactgcggatggtgaggcgagcgatagagaaatcgtcacgctccgccccatctctgggtccagctcagctgctgctgctgctgctgctgtggggtcttggtacgcgtctgcatggatctcgggggaactgggagcactcggactccgcttgtccttaggcacatgcccagcgctgtaggccaccagcgctgttccatctgctgggttggagtcacggcaggaatggctttaaacataagagcgtaggcttggaaattaaaaataagtacattgaactgaaacggtatcatcaatcaaccatgatgaaactcccagagtcatttccacccacagcatacctgggttaacaacgagcattggtacacggctctggatgcctttgctcatcatgtgtgccaccatcgctcttcgacgctcgagttccgccagattgaatgcgcgctgcttcctggagggactcgggggaatggcctcctacttcgtaacccccggcacataccgaaacggtcaccacacgacccacctacgccatcgcacggcaacaccgacctacctgcaggaataccacagcaatgtaccaatgatggcgaagacgatgaggagaacgatgccgccgattgcgaaactgccgaggtcggggctgttgctgcctgggaggcgggagaatgagttgaggatgaaagcctgtcctttgcacatatccttcgtagccaacgaacacaaatacttacacggaagtgtcaacgtcaccgcgggagcttcccatccggtgtcacctgaactcatccctcgtcgatcccggaagacgaggcacccggcgaccaagcgggtcaccggggtgggcggcctccggtcagatggtcgggagaccagaaactcacgataatgagttattcccacatttgcaatcggcactgcccnnnnnnnnnnggatggtcgggagaccagaaacttacgagaatgaattattcccacatttgcaatcggcactgccccttctgggatggcaggacacctgtcagcagtgaattcggaactcgggcatggcgccaagatatgacgacacgcagcaccctcagcatggaaaccccccaccatcaatctggaactcagatactcgacattcagggagattaatgtcctcaagcctcgtccagcaagctgggcatcggtattcttcaagccggcgctgaacttaacctatgcagagagctgccgaagactcctggcaaagaattgtccgaatcgcatttgaaaactacccatttctgaaaagcatcccgcagatatcgacgcaccggcaatcattggacatacagcccatgcattgccggcatgatacgtcgatgacgactgctttccattcatccatgcatcagcggtgcgttgtgctctaaaacgggagcatgcgcttattcacggcacgcgccacgtacacatgcgacggacacaagaagctccggcacaatcgcaagtggctggacggcttcctgaacatctcggagaccaccgtcgcgctcctgaatgaggacaggtcgtccgtgctgggatcatgtcgcccggatggtcccactcgagcctccctgctagagggggaggaggtgttgctggtcaagcccagcattctcgtggtcatggacaccagtcctgggctgccagacccacctcgaacggatgggactggtccatctaccgccagcaatggcagcatctcaaaacccaggctccaggcaaaggcgcgcgtccgtgtgcgtccgaacccggtcttgtacctccccgagcctggggacagccctggcgcacaagggcatgtccaggagtctgcagcgccatgccttgctcatcaaggtacggattagggggccgtggctgcgctggtacctcatcatgcatggcccagacaggcccacaatcgactgttaatgatacatagccaggacccgtgtcccccttgcaggccaccctctcggcagtgaagagaacctccaccctgcgnnnnnnnnnngcctcgccatgcatggccctgactggcccacaatcgactgtttatgatacagagccaggaccagcgtcccccttgcaggccataccctcggcagtgaagagaacctccaccctgcgggctcgctgcctcggtgggaggcacagccgggtgcgccgagcttgcaggcaaagatcctcctcccctctaccgcgcaagcgcatagcggtgtgaggaagcgctttttgccgcctgccgtcgtcagtacccctgcccctcagctgagaccaagtgacggtcctggcgggccactgctcgcctgcccagtcccaactaccgcagcagtcgctgctgctcaacgaacggtgaccttgccggatgtttggcccagtgccgcagcctacatggaaagcatggccttggccgtcagggaggaggtttccctcaggtgcgtcgagatggtctgtgttgagaattgatcggagtattctgagtgtgaaccagcatgcagtgccctggggtgtccagcttggagcgcagcgtctcggcaatcctctcaacatccccatcccttctctgcctcagggtagtggaggtgctgcgcaacttccatgcggccatcgccgcagctccgcaggacagcgctgccccaccgtcgagcttgcgcatgcatgggctgcggtattactcgccctgcgacctcatcagctgggcacccaaggtgggctgctgtttggggcgttgccctggagcagcttctgagtgccaaggggggcatgccacacattgagagtgaggcagcctcgagggctgtgtcccacaacctggccgtccatacacagcttccctgtcctgactggaagaagcctctgaacgctccaaagtcctgtaccgcacaggcgtcttcgcaagagatgcatcgcaggggcaagctgcagcgggcctgcgccgacgggggctctgacctaccctcggagaagatggccggggcttccatctgcctggtgctgcccaagcagcgtggcccttcctccgagtaccggcgggacgacatctggatcctgagcaacgacgcctggctgggcagcagggccgagagggctggcaggcccatggaccgcctgcatgcgccctgggtcgctctggcccggagcctgtggcatggtcccaaccaggagggcaggtgggtggcggcatgggtcactggccgtgccagggcagggtggaagggtcgtccatggtgccagtaccacccagtcacgccctccgcatgcgtccaaggcgtctgccgcccaaggcccccaggccccctcaccactcaggctggcgatcgagttcctgacggatgcggccccccgcctgggtcgccagcagaccgtcannnnnnnnnngaaggcgtctgccgcccaaggcccccaacccccctcaccactcaggctggccatcgagttcctgacggatgcgcccccccgcctgggtcgccagcagaccgtcaccgccctgaagggccccgagtgcagctcggagctgggcatgctgagcatgctgtgctctcccccagcccactccctgcccctgctcgcccctctcatgagcccaccccattgcatcgtggggccctccgatccagacgcagatggggcccagggccaggccggactgaatgccgagcagctcaaggtgctgcgtgtggtagcttcctggcagctccacgacgacgtcagtgggtgcatagggatgggaggctgtcctgagcaaagggatgggcnnnnnnnnnnctcctggcagctccacgacgatgtcagtgggtgcacaggggtgggaggctgtcctgagcaaagggatgggcgccgccggtgcctcggtggctggccccgaggtcccctcccgcctgcccagctccacgcccccggcgaccgatgcgcttcccaccacctcgccaaccccagaacccccccgctcccaggcgcctgcccccatctnnnnnnnnnntgaggtcccctcctgcctgcctagctccatgcccacggcgaccgatgtggttcccagcacctcgccaaccccagaaccccccgctcccaggcgcctgcccccatctgtctggtgcatggaccctttgggtcgggcaagtccaccctgctggtcaccctgctacgctttcttctgcgggcccgaaccgtggccgggagccccctggagggggcacgcattctggtgtccagtggcaccaacgttgcggtggaccgggtgctgatgggtgagcccggggggtggtgactcccgccagggtcgcagctggtgcagggtgcagcttcgatggtggggcctcccgggtgcctgtgcgagaggctggaggaactcggctgcaggcagggcgagaggcgccgccgagcgccccctccatgtctcctggaatccgcgcacaggcctcttggaggcggggtgcaccgacttcctccggctcggtcccctgaaaaggatagacaggcgcctgctgccgtactctctccacgcaaggttggtggcaaggggtccgttgcagggctcagcgcagggtggtatgctggcaggcctggctggatgtggtggagcgtgtgagagtccatactctgtgctcacagccggtcagctcatcccaagttccaccccacctgcccctgcttgcagcaagaccaaggccactggaatcagtgaactgagggagatgatcaaggccacgacctcccaagccgaagcctgcttgctgcgcgcggagctgcttgccctcgaagcaggcgcgtgaggggggagggggatgcatgctgtaggtgggtggcagtggctgaggagagatcaggcaagctcgtcgatgcaaaccagaccttggctgctgcatgtgggctaagagaactcgcattcctgtgtcactacgcatccaagctacctctccaggaccaacacattccttacctcttctttcttcctccttgctcatcttccaaggcgctgagcgcacccggcgtcacatgctgtccaccgtccccatcgtgggggtcacctgttactcctccatgctgcccgtcctggacggacaggtctttgccgtggtgcgaggggagtggcagggggataattaattccccgggtgagttcaggaacccactttgatgtttgggtgaccaggcgcatgtgctatcccacgcgcagaccatcctggacgagtgcagccagctggtggagccgctgtccctgtcacccatcatccgcgcccagtcgaggtggggcagaggcttcatggagctcatctggatgcagcactcccaccgcgtgtgattgaggcacagcttcaccaactctcagacatgcataccccgaccctgttttgcagcacgagctctcctttccaagtgcctgatgcatggctcttcatcgcacctgcacaggtacctgattgcggtaggcgacccattgcagcttccccccatcgtcgcgacgcccacggcagtcgcaccggccggcggcgaggccggccccgccttgcaggccggtgcaaggcccacagctcgccatggcctggcgcggcccatgtttgtnnnnnnnnnntggctgttgcaaggcccacagttcgccatggcctggcgcggcccatgtttgtgaggctggcggcggctgggcacccagtccacctcctgcgccgccaataccgctgccacccagtcatctcccaggtgagcttttactagtgttctctgccaatgccgactatgggaatggcatgtgaagggtggcccccccccccccgggggagggattccaagcaggcatatatttattctgaggcagctgcattagcaggctnnnnnnnnnnaccaccaccccgagggatttcaagcaggcatatgtttattctgaggcagctgcattagcaggctgttgcatgctgtccagggatggagggctcaccccagtgcaccgtacacctccccaatgaaacctctccacatcctccctgcagattcccaaccgctgcttctacggcgggcagctgctggatgggtgcagcgcttcccagcgcggccccgtccttcccggcctccccccttgcctgtggatcgacccgcggggcggcgagagcgggggcgagcggggggcccgcagcgtgaccaaccgccgcgaggccgacgtcatctgcagcgtggtgcagcagctgctgggacatggggtgccgccctctgccatcggcatcatctgcttcttcagggcgcaggtgggggacactgggagggggtggatcgccagcatgccagctggtcgatgggtggctgaggttgtgcattgcttgttcgctccgaagttgtgcaaggtctggcacagctgaacggcctcacgaacagccgacaccctggaaggttctgagaagtgggcagcatcctttcgctgcacggcgtcgcaccaattcgctcgctcacatctgaaaagcccacctttctgcaggtggcgctgctgcagggcatgctgaacccccagcctccaatgaatgtgactcccgaggcggggcagggcgttgcacacggcccctgcaccgtcagcgaggcgccccagggaccccttgcagagcaggcgggggtgcaggtggcgacggtggatgctttccaggtgagggctggtccgacgctggctgtcctcggacgctgggcgccagctgacacgattctcatgatcaagccagcatgtcacacaccatgctcgtcatgcaagccatcccccaccccaccacatgcagggaggggagcgggacgtcatcatcctgagcacgtgcgtcacccggccctcccacttcgtgggcgacccgcagcggctgtgcgtcgccctgacgcgtgccaggtgccacctcttcctggtggggtccccctcggccctctcccagtcggctccagccttccaggccctgctggcctcctgccacagcctgcccggctgcttcagcatcacggaccgctggcccagcatggaggggaggcttgtggcttgaggcatgctggcacacggctgcacnnnnnnnnnnccacggaccgcttgcccatcatggaggggaggcttgcggcttgaggcatgctggcacacggctgcacacaccgtaagtaccctcggcagtccctgctgctgtagcacggtgtctatttcaagtacatccaggatcggcaggagagggcagcaactcattcgggtgcaaccggagcgnnnnnnnnnnccaaatacatccaggatcagcaggagagagcagcaactcattcgggtgcaaccggagcggcatacgccgactggctgacgtatacgtggaggcagggctggccccagggaaggggcccgagcaccagtctggggaactgggcagctctgtgacatgtctgtcatctcgtcctgcagggggccaatgtgggacgcactgctcaagtcaaaaccatcaccccaggctgggggcctggcccacgaacccgtcgttggccagcatcacgttgcacaccgccgccgcgctgaccagcgcggccagctcgtcggcctcctccgcctctgcagcaggctgcgcgccgggcgtggcagccgccgaccgaccgctccccgcccccagctcctcctccgtctccgtgtgccgcggctccctgaactgcggggtgggtggcccagcgggacccgccgcgggggcc

SEQ ID NO: 33567 - DNA, 103 bp, Chlorella protothecoides
agccagactgtactgtggtggcacagtatattccctttgcaggctctagagatgagtgaccatttcacccaagataaacttgcctggtaggagagagcaagcc

SEQ ID NO: 33568 - DNA, 152 bp, Chlorella protothecoides
gggggggggcccaggtcccgcccgctcaccccgacgggaaagcgggcgggccgagtgcggcctggcgcgcgggccctctgcaacctgtcggtgcgctgatggcttgtgcgcctcgggacatgacacccgccccctcaccaaacgcaaaagga

SEQ ID NO: 33569 - DNA, 99 bp, Chlorella protothecoides
gcgaggagggccggtaccggactcggtgggtttcagtgcgcgcagggtcgccggccgggtgttcggccgctggaggttccaccacccgtccgaaaacct

SEQ ID NO: 33570 - DNA, 139 bp, Chlorella protothecoides
tcgtggaacggatcatttgggcgttttctttctcgggggcacggtcgcgatagacacatccgacctccgagggacacgcggtgttcgtagggtggttttgcgcgcacccgacgagagcccccttcaggcacagcccgcc

SEQ ID NO: 33571 - DNA, 70 bp, Chlorella protothecoides
acgcgactcacattgcactgggaagcgcgacgaatgtggagctgcatgtggcctgcggtggtcgaggaag

SEQ ID NO: 33572 - DNA, 225 bp, Chlorella protothecoides
agactccctgctcaacgaggtgggtacctgcgtcatggtgttctctggttggcaagggctccatgtgtcctctggcgctcctgatgcatcgacaaccaggcgcgtgtacagacacctgtgatgaggtgtgtgagccaggggtaccctcccttccaccccccactctctcaccccaacaccctcccaaacaacccatcggacaggtgtcgcgcgccgcgctcgcgc

SEQ ID NO: 33573 - DNA, 326 bp, Chlorella protothecoides
ggactgtcggccgggctggggctaggggccggggaggggccggggctggggctgagagccggggaggggccggggctggcgctcggactgtcagggcaatactggacgaggaccagactgagcgggttcaggaccagttccaggcaggtggtggcctggagcagcccacagggtgggatgatgccgatctcgaacagctgaacgccctctgggcaggtcccttgaagtggcggcgacgcgctggggctgggcagggggctggggctgggcgagtcctcagggctggggcttggggaatcctgggggctgggtgagggagagtcctc

SEQ ID NO: 33574 - DNA, 61 bp, Chlorella protothecoides
ggcccgaggcacctgcgggggccggcgaggtgaacgccgactacgggacccacctccgacc

SEQ ID NO: 33575 - DNA, 103 bp, Chlorella protothecoides
ctcggtcacggtctggggcgcgcctgcggagggaggggagggggtgtttggagggaggggagggtgggcgtgggagcaagggcagggtgggcgtggggaagat

SEQ ID NO: 33576 - DNA, 61 bp, Chlorella protothecoides
ggccaagaccctgggacggcagtgtgcatcactgccactgccaccgttgtcgccctggtga

SEQ ID NO: 33577 - DNA, 135 bp, Chlorella protothecoides
ccacgctaccgcaccttggtaaatattgcgggggagagctcaccatgattcacaccacagggcacacaggggggcatagtgggacagcgcacgcgaccttttccctgccagtctcactgcgttggcgtgaggagg

SEQ ID NO: 33578 - DNA, 61 bp, Chlorella protothecoides
gcgcgcgctggcccgcgctggcctcaagatcgggcgcatcgaggacgtgacccccatcccc

SEQ ID NO: 33579 - DNA, 358 bp, Chlorella protothecoides
cgcctcctctgccagagcgacatgcgcgagattgaccccggcgtcgggcgcggccacgaagccgcccgaggccgccgccgcctcgttgaccgcggtgaaggccacgcgcgcctcgcgcaggtgccccgcctcggccagcacgcagcccagcccctgggcggcccagaggttggcagggtcgcgctcgagagcgcgcgcatactcgcgggcggcatacgaaaagtgcacctccgcgcgctcgacgtcgcgtggcgtcttgcgctcgcgcggcgcggtgtagaggttcagattgcccagcgcgacgcggccgaacgcctcggcacgcgcggccgcggcgccgccgccgctcgggcgcccg

SEQ ID NO: 33580 - DNA, 352 bp, Chlorella protothecoides
  modified_base (183)..(246): a, c, t, g, unknown or other
cgcccaagtcctcgccgggcagtcggcacctaccgacacgggtgttttcatcgtgagtggcggggtgttttggtgatgaacccctgcaccgttatagcggcctatgtcccattcctcccagaccagcctcctgaaaatcccccattctcacgcccgtcttgctgcagggtgtctcctccacgnnnnnnnnnnnnnnnnnnnnnnnnnnnnnnnnnnnnnnnnnnnnnnnnnnnnnnnnnnnnnnnncggcactgtcagcctgtcggtaacggcggggcggctgtcctaccactacggcttcactgggccgtctttccccattgacaccgcctgctcatcgtccctggtcagg

SEQ ID NO: 33581 - DNA, 106 bp, Chlorella protothecoides
ccccccccccccccccctcgaaaacaagcaggacaagtaccacctctacttcctcatggactacatgggcggtggcgacctgatggacgtcctggtggcggacgcg

SEQ ID NO: 33582 - DNA, 80 bp, Chlorella protothecoides
tcagcttgtcacgtgcagtgttggcggtccttcactccgcgaagaggtccgcatgaagcctgcatctgtcgcattcgtcg

SEQ ID NO: 33583 - DNA, 77 bp, Chlorella protothecoides
tattcccatccctcgggcatgggcaggagtagatgtgttcgacttattgaatccccctggctgctccacatcaccct

SEQ ID NO: 33584 - DNA, 61 bp, Chlorella protothecoides
ccccctgctcaccatccctccctcccgcctggcttgatacccgaaggtgttcttctcgggc

SEQ ID NO: 33585 - DNA, 127 bp, Chlorella protothecoides
gtccctggcaacagcagtgcttcccctcacgcaggctgaaaggataccctggcggaggaatcatcgcccacaccttacaactgcgtccacgtgatccattcatcgatttctccatcaacaccattga

SEQ ID NO: 33586 - DNA, 61 bp, Chlorella protothecoides
agacatgagccctagccttcagtcatgcaaccagctaggcgcggtggcacatccccgcccg

SEQ ID NO: 33587 - DNA, 80 bp, Chlorella protothecoides
gcacgttgcaatgttttggtgctgctgctgctggtattgtgcttcaagccgtacactccctgacgtctctcactctctct

SEQ ID NO: 33588 - DNA, 904 bp, Chlorella protothecoides
ccgcctccccagcccccagcccctcacccagcctccctccaccacaccctccccctgcccgtccaccctctcccttccccactgcatccccgccctcgcccgacgcccccggcccctcgcagccgggccctgcctcggccccgccacccccgccctgggtgcccaccgacgtcgtggggtgggccacctgggcgtggttcaccaccaacgccagctggggctcctacaacgacgcggtgctggacacctatcgcgccgccctggcccccacggtctccctcatccccggccagatcaacttcacgctgatccaggccgtcacctccagagtgaccgtgacgggcggtgggtcggacgccgccatcttgcgtgggggggtccaggtcgccgtagcgctgaccatgggtctgcccgccgaagacatcgacatcagtaccatggcctccggcacgagcgcggcaccccaaacccccccaccgcgcggggccgggcgccgcctggtcggcgcggccacagaggcccctgcagcggcccccgcgcccgccgcctctccacccaccagcacgacgcaaacgttcagcgtactcgcgcgcttcccgagcgaggcggccgccgaggccggcacggccaagctggccgacctcaggctgctgcaaaccgccctgatgacgacgctggccggcgcgcccggcttctcgcccgccaaggtgagcgtggccagcgccgccgcgcccgcgccctccccgctcacgctgtccaacgcgacgctgacgacggccgatgcggccgccggcgtgtacgccgcgctgcagaccgcgatcaccgcggccaacatccgggcggggctggtggcggcgggcgcgccgcaggggatcgtcgtgaccatggccagccgcctggccta

SEQ ID NO: 33589 - DNA, 61 bp, Chlorella protothecoides
ggccaggggcaggctggcctccagctgccaaccctcctccaggcccaggtccacgctcaca

SEQ ID NO: 33590 - DNA, 79 bp, Chlorella protothecoides
cctcctccctcgcctcctccctcgcctcctgctccctcgcctcctccttcctcgcctcctcctccctcgcctcctccct

SEQ ID NO: 33591 - DNA, 61 bp, Chlorella protothecoides
catgagacgactggctgcaggagaagtttgacaccagggggcctggtggcatgctcctggg

SEQ ID NO: 33592 - DNA, 263 bp, Chlorella protothecoides
ccagccctccacctccccctccgccgccgtttccacattccagccctccaccgtcccctccaccatcttctcccccaccccattcgcagccatctcctcctcccagccctccaccttcccagcccgtctccctgaccggcacaatctccttcaactacccatactcggcgggggtctgtgtatacattgacatcttgtcgacaggctacaccaattatactgcccaggcctatatttggacctcctaccttgccaatcccttt

SEQ ID NO: 33593 - DNA, 64 bp, Chlorella protothecoides
gcacagaacgtgtgagcctgggcaggacggcacccgtgctcacaggagtagccaaggcacatac

SEQ ID NO: 33594 - DNA, 112 bp, Chlorella protothecoides
gctgagcaagtggtgcaggagggtcgagaagtgatcaggggaggtttggacggttggcatggaagtgaatgatgtcttcgtctcgaggggtagtgcttccatgagggggggg

SEQ ID NO: 33595 - DNA, 108 bp, Chlorella protothecoides
cctttgttgggtggagtttgtgggaggtgtctgccatcctgcgatgaagtgcgccccctactcaaacccttggtcccatcccacctgcatgcccatgccaccgccctc

SEQ ID NO: 33596 - DNA, 140 bp, Chlorella protothecoides
tctgcatgtggcgggagcccggagcagcagccgggcccctcctcccccgcccgcatcactcagcccggcgagcgggcgtgccaccttggcgccgccgcgccgcaccagagcggctccgccggtgccacggaggccatgct

SEQ ID NO: 33597 - DNA, 66 bp, Chlorella protothecoides
agctcaagcgcctggttgagggccgtgcgaagcagcacgcggccaacgaggacgccggcattccca

SEQ ID NO: 33598 - DNA, 74 bp, Chlorella protothecoides
ctgtccccgggatcagcaatgatgtgctgggtagcgtgctcagatctgcacaggagtgaagggcaaagaaataa

SEQ ID NO: 33599 - DNA, 110 bp, Chlorella protothecoides
gcgaatgtgctggcatgctccacagagcctcccatttcccattgctatacaagcgagatcagcccgagaaagggagatgcaagggcagcaactgctagacccggggacca

SEQ ID NO: 33600 - DNA, 65 bp, Chlorella protothecoides
gcgcccccgagaccatgagccggagattggtgcgctccggtcgtcagccaattccgtaccccccc

SEQ ID NO: 33601 - DNA, 61 bp, Chlorella protothecoides
gacgtggaccagagttcgcaaccttccgagcctcaaattatgtttcggagtggatcagcgt

SEQ ID NO: 33602 - DNA, 7164 bp, Chlorella protothecoides
  modified_base (148)..(157): a, c, t, g, unknown or other
  modified_base (690)..(699): a, c, t, g, unknown or other
  modified_base (1318)..(1327): a, c, t, g, unknown or other
  modified_base (3039)..(3048): a, c, t, g, unknown or other
  modified_base (3114)..(3157): a, c, t, g, unknown or other
  modified_base (3977)..(3986): a, c, t, g, unknown or other
  modified_base (4164)..(4202): a, c, t, g, unknown or other
  modified_base (4377)..(4386): a, c, t, g, unknown or other
  modified_base (4449)..(4458): a, c, t, g, unknown or other
  modified_base (4519)..(4637): a, c, t, g, unknown or other
  modified_base (4976)..(4985): a, c, t, g, unknown or other
  modified_base (6458)..(6467): a, c, t, g, unknown or other
gaccgcgcggcggccgcgggaagcgcgcccccggggcccgtggactccaagtccagcaccgcgaggctggcgccggagcggcgcacgtcccacacgcgcagggagccgtccgcggcgccgctgagcagctgccaggcggcggcggggnnnnnnnnnntcggggcccgtggactctaggtccagcaccgcgaggctggcgccggcgcggcgcacgtcccacacgcgtagggatccgtccgcggcaccgctgagcagctgccaggcggcggcgggggaccaggccagtgccagcacgggcgcgcggtgcccggccaggctgtgcaggcgcgcgccggaggccaggtcgcagagctggatggccggatcctcgcaccccgctgccgtcaggcagtgcgcgccagggacggcggacagcgccaggcagtgcacgcgggagtccagggagaagctgtccgccagggcaggggtgttggcgtcccacaccttgacctggcagtcgtagccgcctgccagggggggaggcggagggggtaagagtggggcaggctggaggagtggtggggggaggacaagaactgggcatgtggtggtgtggatacccccaatcagctcaggaacacagtgtcgtcaagctactggagacttgcgggcgcaggccagcaggcaagcgcacgaggcctccccctcccnnnnnnnnnnaggcagaggggggaagaatggggcaggctgggggagcggtggggggaggacaaggactgggcatgtggtggtgtggataccctcaatcagctcaggaacacagtgtcgtgaagctactggagagtcgcgggcgcaggcctgcaggcaagcgcacgaggcctccccctcccaacccgtgacgcacccgtgacgaagagaccgttgtcgagggggtaccaggcggcgctggagacgctgaacctgtgcccgccgggactggccttggtcaggctcaacagcggcgcgaggcccgggagcgccgggccctggccgggaggcacctgcccagcagcttcctcctcctgcccctgcgtgtcgtacagcacgacggaggcgtcagagctggctgccaacaggtacctgtcctccacccgctccaggtcaagccagttgacgccccccaggggaaggggccgcagcaaggtgccggggtccagtgccaggtgggacagcctggcgtacgagcggaggtgctggggtgagcatgcaggtgccagccggtcagcatgccaggtcccagatctacatgccgacatgcatcacctagaagcattgcccagccctgcctcggaccctgagnnnnnnnnnngggaggtgctggggtgagcatgaaggtgccagccggtcagcatgccagctcccaggtctgcatgccgacatgcatcacctagaggcattgcccagccctgcctcggaccctgagtccgcatgcatatgagaagcccctccagaccggtcgcgctggtacacggagagccatgatcggatgttcaggccctccctggcatcctcgagccttcttggaacatccatctgcactctatgggctccatgcccgattgtcagaccatgctccgagagcacgctgagcttgtggctttgacctccgccggaggggtccactacatccgcaagcacacactgcccgtcaggcaatatccaagggcaacttaacttcgagaaataacatacacatgccaagagtcatcggatgagttcgtgcaccagcgagggaccaagtgatccaacagtatcgccccctgcttccggaacgcacgcgcgcgcgcgtcatgcccatgcactacttgcatgccataggctgtcaccaacaatttgcgaacacctaatgtcgaagcactgcttctcaagtctgtgataagcagccctgccgtggccctgcatgtcccccacccctcgcaagcccaaggctgaggcggagacgaacgacgacgacgcactctacacccccacaggctgcaaggaggcatacgagaagctagaggtgtgtgtgcaggaaatgtatgtgataaacatgtatgccttactggcagcccattgcgaagctggaggcaattggaggcgtggttgccacctccactgtacttggctggcagagtgccctcccccaacccctcaccagatttgccttgctcaatctgatagagattggaggaagtgtcagaagggtgagaaccaatgcgcaggcttgaggcggacagggacagcacgtgtgttcgtcttgtgtggtgcctctggggttggtgcctctggccccgatgccaccgtgcatgcagcttgaaactcttagttatggccaaacaatcctccagtgacagtcacttccatcaattcaaacgcagaggttcacgcactccagcagtgtaacaaggctgtccagaagaacggtgcctagggtggcccaatcgttacagtgttgcccggcaggcgaaacatcccctgagaggtcttgcgcctggtgtgaggaggcatggcccggtctgttcagatcctgatgctctatcgccacattctccgtgccgctcagcgtttcccgtccatcaagcgggagcaggtactggcggagatcaagcaggagttccacaagaataaggcaggctgggctggggtggggaggcgattgcagtcaggggcctaggtggattctcaagaccttacaacaggcaccgtagcagctcatagacctccatgtaacatgtccgtgccattctttcttttgataggacctcaccgacccgggtagggtggagaaggagatccagttggccctgcggagtctcgaacagctggaagcctacaccggcataaatcgaaaggaatctgattgggatgtatccttgaggggcccaatttaagacactgttgcagagtgactggaatccggcttctgttgtctcacccagtgattccgcatctccccttgccctgtgctgcgagaaacttgcatgcctggctattccactcaccgcaccctcctttatgtggctatcaaaaggctcaggnnnnnnnnnngctgttgtctcacacagtggttccgcatctccccctgccctgtgctgcgagaaacttgcatgcctnnnnnnnnnnnnnnnnnnnnnnnnnnnnnnnnnnnnnnnnnnnngactcgccaggaagaaagagtgcacgatactgactttgtgcatgcacagcactgtgtatcaccaagtgtcaagggaggggaagggaaaggttggtgttgccgggaaaaagggctgtgttggcttggaaagctgtagataacatggtaaaagcatcaagcagctggcgctgccgtgatggtggtgctgctggtccctgctccattgttagcatcccaggagtaagtagcagggagggctgtgccccactgcggcagctccaagtccccagtgctcacataggaccgcggcgccctgcagggaagagcgaggacaggtgaggagctgtcaccggaacacgatacgttggcgaggtcggcaggcacccagctacccatacccgaatgaatcagcgctgccccgtcagcaccgctcacctgccgaggagacttgcaacttgttgttgggatgcgccactgggctgtgaccggttgcagatggcgagtatctcaagggacggtcgtctcggtctctgcgtggacaggagttgtcgggaggggagttgactaaccagttgctgacgaccggctgtacagtccaatttcggtatgcacacctgtgaagctatagttggaggtgaaactgcgctttcgtcgcagtgcaacgatgttgcctggcttcgcctggtgcgggagggggtcgaattcctaaacccctgcggagacccggcagccggcatggcgagaccgagtaggctctcctcgtggggcaccactggagcacagacgataattcgggggcggggggaattgcagacgtctgccgacgggtgcatgcatgagnnnnnnnnnnagatgattcgggggcggagggaattacagacgtctgccgacgggtgcatgcatgagtttgtacagcacggaattttcggcattgtagatacggaagcgttccgtaccccccgcgctttccgcgaatctgagatccgtttccgacacgacgtgtcccctttcctgacctcctctggagnnnnnnnnnnnnnnnnnnnnnnnnnnnnnnnnnnnnnnngcgaggtctcaatcgtccctgcggtgatggtgtggtgcatgggtggggggtggacctgccagatcttgcatggaggtgtgacaatacccacacctcatgactgttgtacggactgcgagcgaggttcctgccacatgccacggtcttgaacggacacaagtgcaagtctgtcacnnnnnnnnnntttgagtattcacaatggtttcacccccagtgatcacaagcacggaggcatgacggcagacgnnnnnnnnnncttgagtatccacaatggtttcacccagtaatcacaagcacggaggcatgacggcagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcccacacctcgtgactgttgtacggaccgcgagcggggtgcctgccacatgccacggccttgaacggacacaagtgcaagtctgtcacagtcgcccactcacatgtcctccgcctccagcgcctccttggccaggcgctccgcctcatccaccaactcctgtgcagatcgggggccatcggagccgtctgggattgcatgggtgagagcactcgtcgccccgctccccaaacccctctcccgagacgcccagcgccctacccagtccccaccacccctcactcgcctgcggaaccctctggaacatccgccccgactcctcgcaaacccaggccannnnnnnnnncccccctcactcgcctgcgggaccctctggaacgtccgccccgactcctcgcaaacccaggccagctcggcctcgaagggcttctcctcgtcgtgcacgcggtgcaggatctgggccacagccctcacaccctctcgcaccgtcagctcccccgggcgcagcttctcgatctcgttgcgcgcggcctggcgccccttgcccaccgccgtgccgtagtagcggtgcaccgtgccggcggggtccacggcgtacagcgcggggccctcctcgtcgtacacgcccagcaacgaggtcacgcccatgggacgcacgtaccagtacaggttgaagacgtggacgtaggaggctaggcgctccgccagcacgtgcccggggatggggtgcccgtagaagcccttgtactgctgtgcctcgctctgggcgcggtccaccaccgcgcgcccgtccgccgccaggcctgccaccgcctggcgagcacggagggaatagggggggggggattgatggtgccaggctgggcgatgaattggctgatgcatacggcaccgccctgcaaggagatgcgcaaccttgagcacacctgactgcccagcccacagccccctttccactcaccaccccggcgtggcggtccactgggaaagttctccggttggagttttctaccaacatcttggagatgatgagcttctcggcaccctgtggagtgtcaaaggctctccatgacaatgcgatgtttgcaccttcctggcaaccatccttcgcccagtatcatatgccaccgatacgcaggcctcaccagcacgactccgtccttgcatcgtaatccaacgaccgttctgcagggaggggtttcgaggagctgggtcgatcaccacaccgagggctgccgcaatatgacgcagaccaatcgcaagaagccttacccgctgctatccaccgctttttgtgcatactcagtctgaaatacccggccatcggggctgaatgtgctgacggacagatcatactgtgcgcgtgggaaagggagggggcttcagcagatcgataggctcccattcaccaggtatcaaacagggaccggcctccactgcttacccctgtgccgatgccactcatcctggggtatccgcggatcccaggggctcaaagcctgagggcagactccggcgcacaggtgatcactgggatcctcaggtgtgcggacgctgcttggagaccgaggagatatgtccaatctatagtctcgacattacacctgttcttctacagagctgcaaaagtaatgcgtcgggcatggcccgcctggggcgggtgcgctcctctcctcgtgctggggaatgccccaacaaagcgcgaggatgctgagtgcgttggcaggcccagcctagctcaaaaccactggcccgccttcaccttccgacactaaaatgcttctagagaatactgagtaagccatgaacacagttgatnnnnnnnnnngcactggcccgccttcaccctccgatactaaaaagcttctagaaaatactgagtaagccatgaacacagttgatcgattcaggcttggcaatcgttcgaaacttcacggtcaccaattctgttgctcatgtaaaaaggcacaaacctggcagcaatgtaagtgatacccatttacactcgatcaatcggtagaccgtcccagcaaaatactaagcggaggattcggaatgctatgattgcacccagcatgatggtctgaaactcgctgtgactcacaccattctttcacccccctggattgtaacggggtcgccctgggggcgggagaggtagcgatttcttggggcactctgcctccggtctcaatggttcaggtacgaccttactctatcaatatgaaacataacctacagactgtcaggaataaggccgttacaacgtaagtcggtgggtagttatacccagggggggcaagtgtcccttggtccaaggttggcatgcaaaggggtcgcatcccatggtgaatggtgccgtgggaaggcaagtaagttccaagtcatagggttggagtggactgtggaacaggcaggggtgcataggggacgggtggtccaaggatgtgctgtgcatgactggcgagctcccgttgcactcgtccccggggtggggggggtagatagggggtcggatagaatat

SEQ ID NO: 33603 - DNA, 120 bp, Chlorella protothecoides
agcggcgcttcggaagggggagagtgagtgactagtgggcggtcgggtgaggagggcattgaaccctcgcttgatccagccattgcgggcggggcagggcggtctaggcgcatgggaccc

SEQ ID NO: 33604 - DNA, 149 bp, Chlorella protothecoides
gtgtggaggggcttggcttgggcaggggtaggaaattgggcattccgatggcgcagttcgccctggggcaccggggaggcctgtgagctgccagactacattcctgtgcctcgccgtcaaagcgatacacccatcgtgaacccaccttt

SEQ ID NO: 33605 - DNA, 62 bp, Chlorella protothecoides
agccggagagcgagacgcccctggagcccgtgacggagaccacagcccccggcgcagccgtc

SEQ ID NO: 33606 - DNA, 138 bp, Chlorella protothecoides
cttcaaatgtgcagcagcagcagcggactgcggcgccgcccagcccctttgacgcgccttcgggaacgcagccgaggactgacgcgccgcccagccccttcgacgcgccttcaaatgtgcagcagcagcagcggactg

SEQ ID NO: 33607 - DNA, 61 bp, Chlorella protothecoides
gttgtcatttcccacgttgttcctgccgacgttgccagtgccaacgtttccatccaggttg

SEQ ID NO: 33608 - DNA, 64 bp, Chlorella protothecoides
aagcatcccttgcaaactgggagacggtggttagacatcagattcaaacatgcaatgatcgcac

SEQ ID NO: 33609 - DNA, 79 bp, Chlorella protothecoides
gttcctgagcacagtctcgcgaagttccttaacattgcagaagttgagaatggtcgtccgttttccgactgcattgttg

SEQ ID NO: 33610 - DNA, 87 bp, Chlorella protothecoides
gggggggggtcccgtcaccatgcaacttttggacttggggactgatgctgataggctggggggcgctactcacatgtatgtggccag

SEQ ID NO: 33611 - DNA, 61 bp, Chlorella protothecoides
gccgcagcacggcctgggctccgagatcatcgcggtggtggtggaggaggccttcgacgac

SEQ ID NO: 33612 - DNA, 69 bp, Chlorella protothecoides
atctcaaggcgagtaggggtgggcagttgaagtctgagattggaatgcatgcgccccacacgcgtccaa

SEQ ID NO: 33613 - DNA, 420 bp, Chlorella protothecoides
cggcactttgccataggcgggcatcttccagtaccccagcttgtggagattcaaggggagggaggcccgcttgaaaaggggaggttgctccgctcaccacattcacgcagggtgggatggtctgaagcatgtccatgtgcctgccagtgacattctctgtgctctgggtctatgcctggacgtatcacaccctaccctgctgacatacaccctggcacggtgatgacaatataatcccagctctctgagcttccggaatgaggagagaaaatacgtctaaaacttgtctgagtgccagactgtttgcctttttgtactttctgcctgggcctgggatagggttgggacagatcttccaccactcctattaccagtgacttggcatgacatagcacgtccaccatcccttgccagctcaaa

SEQ ID NO: 33614 - DNA, 61 bp, Chlorella protothecoides
gccgaggggcggccagctctggtcccatgggcagcccccgtacctggtgcccgacatcaaa

SEQ ID NO: 33615 - DNA, 95 bp, Chlorella protothecoides
agaagggtgaggctgtggtggcaaggattctttgtgtgtggggtcactcatggaggagactgcgcctcgagagctcgcgctggggtgtcatctgg

SEQ ID NO: 33616 - DNA, 91 bp, Chlorella protothecoides
ttcgctttggcgtcacgacaagtgcgcagcgctagttgtggaatgtcgagggtgtggattactcgtcagtgcaggcctggtgtgagggggt

SEQ ID NO: 33617 - DNA, 5622 bp, Chlorella protothecoides
ccccaggcaaagcgtggagcgtgcgggcagggagctcgcgccgggcgcgtcggacgtcggcgcagaccgctcgctgctggtgggccgtgcgtcgccgacggcccctgggtcgccggccgccaccaggtcccccaggccggcgccacgcagcgtcgccacgtcggcggcggcccacatgcgctgctccagcacagactggagccaggccaggagctggggtggggccaggccctcgcgaccccggtactcgggcagcaggtccagcgacagcaggcgccagcgccagccggcggcggggtgcttcaccttggccgtcgccggcgcgaaggccgcagacgacgcgggcccgccgaccgccgtcgcgccatcgccctcggcccgggcccacgcctgcggcacctgggcgacctccgaagcgtcccggccgcccggggccgcgcggtcgccggccccgtactgcgccagggtcacccgctcctcgggggcggggaccagggtcaggcgcgccgtatacagcccgccggcgccgcccagggtgagcacgcctgcggagatggagcgcaccgccatgccctcgggccgcgggttctgtatgcggcggtgcgaaccgggggctgcgtgttggggctgggagaaagaccaagccctgcattcagctcaacccgaagaccgcgcccccgaacccaataccctcccggcgcactcccctcacagccacgccacaaaacagcacctggaggagcttggcgcggatgaggaagtctagctgcgccagggccgcgcgcacggtggagcgtgggggcctggctggactgaccccggcgtgctcctcgatgctgctgggcagcaggttgtacgaccctgtgcaggcgtgggaggtggttgcggagtgtggtttctgtccatctaaagctgggatgtgcaatgcaaccatatggaaggctgcaaccccacaggagcgcatgtcaagctgctctgcaagaataaaggcaacatgcacccctccatggctgcccattggcacgatgccccgtacaccggctctgcctcatggaccccaccagacaagcagcattggttctgcactccaatcccccacaaggctccaacccccaatgcgcaccctgttcagtgacctgcacggccgtggcgatgtcgtaggcgggggctgccgtggccgtgagctcggagtgcaggtaggccagctggtctgccgcgtcctgcagcgccgcagcgtgcacagcggccgcctgcatgactctgcggcactcggccaccgcccgggccttggcggaccaggccaccaccacccccaggcgctggagctgctggcgggaggcatgcagctgggacgtgagggcgcgcttcctggcagcatggagggcatgatcgcagagggggagaggtcttgtggctaggggcagcgctcccgcgcccgacacaggctccagattgccaagagttcgaccgcgggtgggtcggcttcaagcactcggcatgcacattcatcatggagacgccgtgcgccggcgatccaggtgcattccatccctcaaccttcgcaacatgactgctgacaaccagccccatcgcgcacctctcgctgtcctccaatcctggcagtgctccagccaccgcgtggagtccatcgtgtgcctggcgcaccgcttcgaggagcaaggcgcgcagctccaccagactgagggaggtgatggtgtcccccatgggacgaggggtggtacctcagggcatagtgccacagggctgcaggcaaggagcggggagtgatcctagcaagtggagcgctctgccgtctcttttctagcccagccctttccagcaagcctgatcttgtgagaagggggtatgttctgcaggtaagacgacatgctggaggcccaggccaacgatgagccgcatgacctctcacgtatcggagggaggggtcttgcaggtgatgaaatctgcgatgcgttctcccctgggcgcgaaaactcgtgatgggttggggcctccccgatttataaccaacgcaaccacgacaggttcttacttgtgagtccagacatgattttacaatattgattacagtatacggtgcaactcctcacatgcagtgatgctttgagcccaggccagcggaggacacagcttggggccaagctctcgggtcaccagcgactgagagggacgaactcaatactcacgatgctgcagtcaaagacgtttgtcaaaaagacgaaaaggggcaaaatcctgaaggtgggtcggaggagaaattgcaagcttgccatgcagacgtgggaggaggtccagaataccacaacagctctgctcccaggctgggagagccccagctgtgtccgcaacagcaatgatctggaaaaactcgacctgatctcacgcagctgaatggatgctccacaactcattctattctttctaggtggtgagggagcactacctgcgagaggacatatactccggttcgcccctggatcctgagtgcgaccctgcttccttcaaactcagccctgatgcacagagatacatcgtgctcgatacaaatgtggcccttcaccaggtctgtgagggtgtcagcaatgggcagtggtcgggggtggatgtctcagattgacatgtttggtgctctgagacatgaagggccacgaggctatcttgtgaagaacgtctggcacaagcaactatgccctcattatgaagtgtttgcatgctcttgctgtgggtgagctctacgctggacgttatgacaaggaagtcccggcaggtgccctcgaacgctccccactgttccagtctggtcccccctcgcttgctccatgtttcctgccgatatcgttacaagcccatgtttctctctacccctgccatgagcaagcatcccaccttcccccctccccttcctccaaccccttccaaccaccagatggacttcctggagcacgctgcggtgactgatgttgtcgtgccggccatcgtcctcgaggaggtgagggcccggaaccagtctgtgttccagaggctcaaggcactcaccgccagcgacttcaagcgcttctacgtcttcgccaacgagaaccacaagtgaggcgagggggtgcgatgaaacgctgtcggcttgcctgctggtacgccgtggctcccatgacatccatgaccttttaccccagccatggcgcgcctccccaccctcgccccatgtgctgcagggacacctatgtcaagcaggatccgggcgagagccccaacgaccgcaacgaccgcgccatccgccgcgcggcagagtggtattcacagcgcctgcccggcaagcccatcctgctgctgacggatgacgccggcaaccgcaccaaggccatcgaggcgggggtggaggccatgagctgcgcggtgagaggggcatgcaggggggagcaatggggcttggcatggcattatgaggaccgtgtgaggtgtctgttgcactgggtcgtggggtgtgggccatcttatacccgggctgcatggtttgtttgcacactcggacggcgtggcattcgagcgccggggcccgccaccacttccagcatgtcacccttcatcctcatccacaaccaggcctacgctcggctgcgtgaagatgtgcccgagctgtctgacctggtcagcgccggcctggccacccaggctgagcagagagaaggttgaaagggggactggggaccgtggggtgctggaaggcgccgcccagcatccgctgggagggacgctgctgtgcttccgtgcctgcttaaaaccgtgtttgatacactcataccctccatggctccagagtcatcggacagcgagcgctgtgtctgatgagcacccccttgcgactcggtctgaacagcccatggcttgggcttcgggccatcgtcagtattgcttgcctttccacaccacccccccaccattccaccctttctgcgcacagtcgggggcggggccgggcccaagaagaagcggcgagtgtttgaggatcacaagccgctgtcggaggtcaccgccgggatcaaggcggggcggtaccaccagggcacgctgcgcgtcagccgcttcaacccctgggaggggtacatcgcctgccagagcgtggagcaggagattctgctctctgggcgcggcgcgctgaatcgggccatggacggcgatgtggtggctggtgaggtggcgctctggggtggggtttcatacccctcctcccttcctatggggcctgtgagcgcatgcagcgcatgtctggcaggctggccttgctccagtagcatgaggctcgaggctgccgcctgatgccattctgcctcctccaagcacgtcatgcccattgtcaatcagagccaccctgtaccatactgatgcacagccttgcacgacctctacacgggattcccgccccgatcacatcccccattcaacacaacaacacacaaaactcccatcccccgcagtggagctgctgccggaggagcagtggcgcggcccctctgcccacctgcccacccaggccgagctggacgccgccgatgccagcgagggggaggaggaggtgctgggagaggacggcggcgcacacatcgcccaggtcgaccccggcgagcactaccccggcgtcgccggagctgcgggcggggacgacacctcggccgcccgccagccgacgggccgggtggtgggcatcatcaagcgcagctggcgcacgcgggggtactgcggctcgctgcagccgccgcgcgtaccgggggcctcacacgggccggggacggcctcggtgctggtgtgccccgtggagcggcgctacccctttgtgcgcatcaccacccgccaggtgggaggtgtgaacaccaaattgggtgggggtgaggccacaggtcttgggtggggagcgtgggcgcttgatcatgcggacggctgtggaaaatggtggtctgcagaggcgtggacgcacactggggtcagacgcagtgagggccctggaccctccatcccctcgcacccaggagtggcacacacaacccaccaggttgccccacaccctagccctctttcccccctcatcaagcccacccaattaacccatccacccacccactcaacaaccctgccccccctttccaccccgaaaaggcggccacgctatccgacaaacgcatcgtggtggccatcgacgcctgggacaccgactccctgtaccccacgggccactacgtgcgtaccctgggcgccatcggtgacaaggagacggagacggaggtgctgctgctggagaacgacatcaacaccgcgcccttcacgccggcggtgcacgcctgcgtcccgcccctgccctgggcgctgggcgaagccgaggcggccgacccggcccgcgccgacctgcgccacctccccgtctgctccgtagacccgccggggtgcaaggacatcgacgacgcgctgcacgtgcggcggctggcgggcggcaacctggagctgggggtgcacatcgccgacgtcacccacttcctcaagcccgacaccgccatggacgaggaggcgggcaggaggtggggtggggggagtgggggggtggattggagggggtgg

SEQ ID NO: 33618 - DNA, 79 bp, Chlorella protothecoides
gtaggtgcgggcctgtgacttcttgccgctgctgttgtcctcaatcttgggcccgccgacggtggcgggcttgacgggg

SEQ ID NO: 33619 - DNA, 79 bp, Chlorella protothecoides
ccaaatcaagctcctgccggtcgccgtcttcggtgcccaggtgcgccgatgcacccctccccgcaccgacctctgcgag

SEQ ID NO: 33620 - DNA, 137 bp, Chlorella protothecoides
gaacctcgaagactagatcgaaatgcatggggagcggaacccgtttcataaaaagatcagccccacgctggtgcatacagatggcgacgaaagcaaaaatcgcatgcctcatctgaactcgatcccttctcaccgtc

SEQ ID NO: 33621 - DNA, 66 bp, Chlorella protothecoides
aggaggagcacgatttggttcccctttgctccctcttccgccttggtggagagcctcgacgtggtg

SEQ ID NO: 33622 - DNA, 61 bp, Chlorella protothecoides
gccagggcagcgtagcagcggcagacgcggtgctgcggcgaggccatcctctctgtgcggc

SEQ ID NO: 33623 - DNA, 87 bp, Chlorella protothecoides
tgaagctgcagggcgccagcgtccctcatacgccagatcggagtgctcgagaaggatgccagaatcgaagcgtgacgacgagcaaaa

SEQ ID NO: 33624 - DNA, 196 bp, Chlorella protothecoides
tatgggtggcaggacctgcggcggcggcgtgagttggagctcctctccgcgtacggcggcagcgctatgcagccctcaacctttgtgcccacaacccagctgccgctggtgcactccccctcgacgctgcacagcaatgatgccatcgagcggcccaccacctccctcccccgccaggtcagtggcatggtgagcg

SEQ ID NO: 33625 - DNA, 102 bp, Chlorella protothecoides
agcacgccgcccaagcagtgagggagggggttcgggaaggtagaggagtgacccaagggcaggtgccccgcctgccacacgtccatctccctcccctccccc

SEQ ID NO: 33626 - DNA, 130 bp, Chlorella protothecoides
ccccccccccccccccggcaccgtgcaccctcccccctgagacatcacagtgggtgggcgccgcactctcggcctgcccctaaagatccaaccacgcgcgactcacacagggatgcccgccttgactgcc

SEQ ID NO: 33627 - DNA, 64 bp, Chlorella protothecoides
cgccattctcatactatcacactgcaggccggtgaaatggaagcaaaggggaagcttgcacggc

SEQ ID NO: 33628 - DNA, 62 bp, Chlorella protothecoides
gctatccagctcaccgatgttatggtcgccaacattgttgctgccaaagttatctttgccct

SEQ ID NO: 33629 - DNA, 107 bp, Chlorella protothecoides
tcagaaatgtgcatggatccctgcgctgcccgcccattgaacacttttcccatccgtctacccaggtgtttttatttcacacagccagctgccacggcaggggctgg

SEQ ID NO: 33630 - DNA, 67 bp, Chlorella protothecoides
tgggcagggactaccgatttcatccctcaagcaggcggcctggcgtcgcatgagatcccccgatgat

SEQ ID NO: 33631 - DNA, 61 bp, Chlorella protothecoides
tgcgcctgtggggagggacccgggggggggggatgaacggacctgcgcgggctccgcggcg

SEQ ID NO: 33632 - DNA, 76 bp, Chlorella protothecoides
ccagcatcccagcactgaccctcctcagcccgccctccacaacgatgccagaggtgtacacctgctcggcctgtgg

SEQ ID NO: 33633 - DNA, 150 bp, Chlorella protothecoides
ggggcgggggaggatgagggcaagtgggcgcccggcggggagcgaggcagaccgatgaaagggagcgcggaggccgcgtggccgcacacagagctccctgacatcgccacggcaccaagaaagcggagcgatgatggggactggcggcgc

SEQ ID NO: 33634 - DNA, 79 bp, Chlorella protothecoides
ttccccgcccggcgctggctgggggatcgccatgggctctcgctcacgctgcagcctggcacaggccagccaccgtgtg

SEQ ID NO: 33635 - DNA, 101 bp, Chlorella protothecoides
gctttgcaccgcgccatacaccgaggactctgccaggtcggccacgccggacagcaggtcggtggcggccaccgcggcaccatggccgccgcccgcaccct

SEQ ID NO: 33636 - DNA, 61 bp, Chlorella protothecoides
accccgcgtgctgccggagggtgatgtgagtccactgcctctgagcaggtgctagagcacc

SEQ ID NO: 33637 - DNA, 147 bp, Chlorella protothecoides
gctgaactgtgtccccagtatgaaagggtttctctctttggacagagactagagtatgggcagcggacgaacgcgatgcacccccacatgactccaaagccgatgctaggtcatccaaagaaacattgccagctgcatgaaggaggc

SEQ ID NO: 33638 - DNA, 127 bp, Chlorella protothecoides
gcggagacctggtgcgagattgcgtgtgggtcatggagtactcaactcaaagttgatctagtgggagtggatgcaagggcccttgcccaatgtctcaataccctcgatttgacggcccctgtacttc

SEQ ID NO: 33639 - DNA, 4017 bp, Chlorella protothecoides
  modified_base (398)..(407): a, c, t, g, unknown or other
  modified_base (2369)..(2378): a, c, t, g, unknown or other
  modified_base (2784)..(2793): a, c, t, g, unknown or other
  modified_base (3336)..(3345): a, c, t, g, unknown or other
  modified_base (3543)..(3552): a, c, t, g, unknown or other
ggggggtggggggggggcgcaaataatcgagggaggagggatgtgtatgtggggatccaaatggagctggccgtgggacaattcctggctccttgccctgtatccactccaatatacattgaacgagtgcaagtgctgatgggtgccctggatatcacgggacgcccccctcaccgtgctctgcacaaaacccatggttcttctttcctccccccccccgcctaggttgccgctgcgctgcgggaacgggcccagcgcatctacgacaagtacggcaacgtgatgctggacacctcggggatgacgggggcgggcattgagcgcaaggccaccagcaggtgtggggaggagggagggctggcgttgggaaggctttgggtggtgtgatgtggaattgnnnnnnnnnnaaggagggagggcttgcgctagaaggctttgggtggtgtgatgtggaattgggtgtgtggttgtccctggcggaacaggcccgagagtgctgccaagcttcatgtgtttgcgaatgttaaatggcaggtgcagtacatgggatatacaaaagcttctggttcatgcttggcctgacaacaactatagcctgtgccttctcaagcacgtgtgaatcaagcacaagccaatacccaaacacacagggccctcttctccaagctccaatacttgacgcaagtcgaggggttgctctctcccgaggctgccaaggaggtggatcttagaaagatatttggtgccacagaggtgcggaggtggggggatgcgatagtgtgctgcatgtgccgccgtgcagccttgcaagtcatcaggagcccagggaccgcgctgcaaaggtccaaggtcccactcctcaggcttcccttgtccattacgtaatccgcttcatctcccaggacgatgtggcgagactgaggatcgtcagcctgcaggacgtggacctggaggcgctgatggaacagagctcggcagtagagcccaagaaggaggagcctggagcccagctgtgatcttcagtcgcgaatgctgagttgcacgcttgcctgttgctcaatcctcctcctaccgtcgatggcccaatcctttctggatgcacgatgtcaagttttctccagcgacggtgctgtactgcatcaactggccgtgtcgagaggcagcagcccatgccggccatctggcatgctgtgtgcggagcgtatcagacggattcccgacaccggtcgaccgtgtcgaggccaagcacgcgttccatgcaccgtgtctgcctacttcacctcgtgcacgctcgacagggcaactcgtcattctctcttggatcaacaggcctgggagcacgtcctgccgattctccaactcctcatcaccaggcccaggtgcacccaacttccgtacgcgccccagagggatctcccgccccagtaccaactcatccaccacctgctaacatggctgggcaacaaggctggctgcgcggcgtggtcaaggaggtgctgagcggcgacaccctggtggtggctggggctgtgaagtccggtattcccccggagaagcgcctcaccctggcgtctctgatcgccccacgcctggtacgccggtgtaaagggctttcgtgttagtttcatttccatatggtagcaatgtgccgcgaggtgtggccgcccgactcgttcctctgacggtgatgatctcgagacagctcaccagcaccgaggcctgcacctgctccgatcacagggacggcgggacggatccactcctgacgagccgtttgcttgggatgcccgcgagttcctgcgcaagctgaccgtcggcaaggtgcgcggacccgaccacggcgcttgcctgatgtcggcattgctctgcatgatcctacacgaacagccgagccgcccgctccaggtccccgccccatcatcatgcaccccagcccgtcgtgttccgcgtcgagtacaccctggaccagagcgccgggcgcgagttcggctccgtcttcctcaacgagcgtgacaacgtggccgtggccgtcgtcgcggcagggtacgccaaggtgcgccccgcgggcggccagcagtccgccttctacgaggacctggcccgcgcccaagagcaggccgaggcaaaggcgctgggcctgtggaccaaggtgtgtttgagatgggtggcagggctgggcattcctgatcgagcgggcacgggcggagacccatgcactgtgtgcctggccgatgattctacgcttgggctgctgaaccgcatttgtgccggcgcagctcttccttggtggcctttgaaggtcttcacaacaatctttaccatcccgcaggatgccgctgccctcgaggctgctgtccgtgacgtcactnnnnnnnnnntgggcggagacccatgcagtgtgtgcctggccgatgatgctacacttgggctgctgaaccgcatttgtgccggcgcagctcttctttggtggcctttgaaggtcttcgaaacaatctttaccgtcccgcaggatgccgccgccctcgaggctgctgtccgtgacgtcactagcagcgatggtgagtgggtatatgagaggcagagagcggcgtgtgaatgccgcccattgggtctccggctgcaatgggtgacaatgctgatgtcctgtcaaagccagcagtcctcacttgctttcccagaaccctaccctcaatcccttcactcttccacacacacgcacacacacaccattcctctccctccttacagccttcgacgcagcgtccttcctggcggccaccggcnnnnnnnnnnacccggaaccctatactcaatcccttcactcttccacacacacacacacaccattcttctccttccttacagcctttgacgcagcgtccttcctggcggccaccggcaagggcaagcccgtgcaggccctggtggaggccgtcattagcggcagcatgctgcgcgccacgctgctcccctccctgcagcccgtcgcggtcatggtggcgggcgtggcggcgccctccatgggcaagcgccccgacgccgacgcggccgagggcgccgcggcgccccagcccgaggcaggggcccgcgaggccaagcactttacagaagtgcgtaccttgcagcgcgaggtcaagctcaccctggagggcgtcagccaggtgacatggggtgtcaagacggagtcagggaaagggtgggggggtgataccatgcttggctccctgaacggcaatggggacggcgtgttgaaagtgtgcaggcggttgtccatacgattcccagtgtcctggcaatggacgcagcgtcggattcccctgccctcgtgcgtttccnnnnnnnnnntttgtctatacggttcccagtgtcctggcaatggacgcaccgtcggattcccctgccctcgtgcgtttccaccttgcgttcctgtgttgccctccccacgacccgcctgccaaaaggctgcgccgcctggctcctcattttccttccaaccgcatccgtcacccccacctccccaaatcacaatcgcctcccagtttnnnnnnnnnngcaaaccacatccttcccccccccctccccaaatcacaatcgcctcccagtttggcgtgctggtggccagcgtgtcgtaccccgtgggcgagtccgggcagggcgaggatctggccagcggcttgctgcaggccggcctggccaggggcgcggagtggagcctgaacatgatgcccggcgccgccttccacctgcgcgaggcggagcgcgcggcgcggcaggcccgcgtcggcgtctggcacgcctacgtcccgccccccaccgcctccgccaagctctccgacgacttccagggcacggtgaccgaggtggtgagcggcgactgcctcatggtgcgcgacgcggcctcgggcgtcgagcggcgcgtgacgctgtcctccatccgcacgccgcgcatgggcgggcgcgaccgcgcgccggaggcgtgggccgccgaggcacgcgagctcctgcgctcgcgcctca

SEQ ID NO: 33640 - DNA, 165 bp, Chlorella protothecoides
aacggctcccgggactgggcagggaggggacgtgcttggcgcatgagggcaaggacttgggacgagaggctgcacactgtgcttggcctctaaaggtacctttcccccagcataggatgccgtgccacatgggggcccaccctgtctaagcacacacaccagctc

SEQ ID NO: 33641 - DNA, 405 bp, Chlorella protothecoides
  modified_base (142)..(324): a, c, t, g, unknown or other
ttgcaggagccgtggggcttgcaggagccgcacacacggggtccgagccctgcgcccccctttcttccggccgccgtagcgccggcgcgacaccctcctcccggcgcccggcggtcaccccgcgggagcgggcaaagcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaccgccatccacgcgaggcaggcgacggccgcgccccgcgccgcgccgtccccgccgcgcaggctgcgctccagggcg

SEQ ID NO: 33642 - DNA, 141 bp, Chlorella protothecoides
tgagccccatgctggggttaccactgtccccgcctttcgtcttgcctcggacccccgctcagccccgtccgcccctgccacctctccacagacgcgctgcacggccgaggtgagggcacgcccctccgccaatggcgcgca

SEQ ID NO: 33643 - DNA, 75 bp, Chlorella protothecoides
aagggtttgtggtcgctctgcaatgccctcggcctctggaaaaacccgatcccagtgaggacctttcgcaccttc

SEQ ID NO: 33644 - DNA, 79 bp, Chlorella protothecoides
ttccatcctcccccctcaccatgctgcgtgccgcctcggacatcttgtcaaactcatcgatgcagcagatgccgcgatc

SEQ ID NO: 33645 - DNA, 62 bp, Chlorella protothecoides
ggaaagcaaaggtcacagcggcagagtggtcggcgggcgatgccgtgtgcaagcgagccgcc

SEQ ID NO: 33646 - DNA, 94 bp, Chlorella protothecoides
gcctgcggaggacggtgacgggcaccccggtgaggtgggcgggtctcttcacacgcaccggattgggggcctgaggcgtgcgcatggggtgcga

SEQ ID NO: 33647 - DNA, 61 bp, Chlorella protothecoides
tcaatggctgcaggcatgggcttgcccgggtcgcagactggactgcgatgggagcagccag

SEQ ID NO: 33648 - DNA, 126 bp, Chlorella protothecoides
catacagggccacaaagggaacctctggcgtcccctctggcggcccggggtgcacatgatcaaacgcccgtggcccctcgctcgcgcggcccgtcacaggcgccgccagcgcggctcggagcgctg

SEQ ID NO: 33649 - DNA, 732 bp, Chlorella protothecoides
  modified_base (95)..(317): a, c, t, g, unknown or other
  modified_base (420)..(662): a, c, t, g, unknown or other
catgcattgcaacaccatggaagcaaacaatagcagtttctacatgaagaggagaatccaaagggcgagccacacctacagcatctacaccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagaatcagcctcgcagcacttgcctgcctccaatcccaatcccctacaccctacaacctcacacccaccttgcgatgctgcgtggcggcctctccctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgtggggtgcgtttgaatgttcagagacaagcaacgtcattgaaacgcaacctgcgccgcgaacatgg

SEQ ID NO: 33650 - DNA, 78 bp, Chlorella protothecoides
ccaaaggcgaagcgtgggcaaaagcgcgggagagatggggtgacgtcggtgctgggccgccgcatcttggcgctgacg

SEQ ID NO: 33651 - DNA, 62 bp, Chlorella protothecoides
gcactccccgcaccgggacaggaggtgcttcaggtactgggcgagacccagggattggagca

SEQ ID NO: 33652 - DNA, 485 bp, Chlorella protothecoides
  modified_base (252)..(282): a, c, t, g, unknown or other
cgctggggcgcgccggtcctggcggcggccgccgacccggccgctcacgcgccgctgctgggcgcgctgggcgccgcgctgcgctacctgcgcgaggcgctggtggaggaccaggtgctggcgctggctgaggtcgaggcgctggacgtcgtcgtcggcagcgggtcgggggagaccgggcctggtgtggactcagcaccgaatggcgacgcatgcacgcaaggccccggcccggcgcacaccagccacctnnnnnnnnnnnnnnnnnnnnnnnnnnnnnnncaaggcccccgcccggcgcacaccagccaccttgccatggatgcggcggcgctggagaacctggaggtgctggagggcggcgagggcggcgccggcactcacgccggcgccggcctggccggctcgctgctggcggccgtggaccactgcgtgacgcccggcgggcgcggcgcgctgcgcgcctggctcgcgcgcccgctgtt

SEQ ID NO: 33653 - DNA, 66 bp, Chlorella protothecoides
caaccgttgaacatagaccatcaagctcctgcaccgtccacaccatacggggaccttctccccaaa

SEQ ID NO: 33654 - DNA, 85 bp, Chlorella protothecoides
tgtgatccattccacgcgcaggatgacgtccttgtgcgaatcgtagtgcctaagccccggattcttgtcaagtggcgcttccgcc

SEQ ID NO: 33655 - DNA, 65 bp, Chlorella protothecoides
cccccccccccccacacacacacactcttcttaactaccccactccgcccacctgccaaccatgg

SEQ ID NO: 33656 - DNA, 76 bp, Chlorella protothecoides
accagggtgttgagcccgagaagttttgccccctttgtcacctgcgctcccttccttgctgtctggcagcggcccc

SEQ ID NO: 33657 - DNA, 98 bp, Chlorella protothecoides
tgaccccctgggaggcgggcggatggggagttatgggttgagctgatgtggatgttgctggagaaaagccccctctcaccactgcacagagtcgcgct

SEQ ID NO: 33658 - DNA, 61 bp, Chlorella protothecoides
cggctcggcgctctgcggcggagtggaaggtcggcccgagtcctgcagacccagcgtggcc

SEQ ID NO: 33659 - DNA, 61 bp, Chlorella protothecoides
actccttctggatgttgtagtcggacagggtgcggccgtcctcgagctgcttgccggcaaa

SEQ ID NO: 33660 - DNA, 79 bp, Chlorella protothecoides
ctccccagcagcccttcaactggctagggcagatgtgctcccgcctgcaagggaccggccagcctacagccgctccacg

SEQ ID NO: 33661 - DNA, 528 bp, Chlorella protothecoides
  modified_base (218)..(455): a, c, t, g, unknown or other
gtgtccatgcttcgggctgccggccctggaaggggctgtgccacgtccccatgggtgactgccagccctcttgcacgtacgagaatctggcctcgcagctcatgaccccctctcgataccttccccccccccacacaatacacagctggcgaccatctaccgcgaggtcaaggagcagctggccgcacagacctacgtccccgcggccatgtactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgcactcctgtgtgccatgtgaggtcggggcgccgcgatgttacgcacgatgaccctgccctcccttgcc

SEQ ID NO: 33662 - DNA, 80 bp, Chlorella protothecoides
agctcattcccgggcgagtgggcacgctcatggccacccagtgcctcaagggcggtgcatgtcctgccactgtctcatct

SEQ ID NO: 33663 - DNA, 67 bp, Chlorella protothecoides
gaacttgctctgcaaaggaccatgatgcagcgcgagtacacctcttggtcctatgtttggtgtaaaa

SEQ ID NO: 33664 - DNA, 8423 bp, Chlorella protothecoides
ccccgcccccttcctccccccgccccgtcacagaccatcctggagcagggcggacagtttgccggcatcaaccgcaaggtccagctgaagccgctgcgctgggcctcgcccgcggagggcgagcccgccgcccgcccgcgcgtggctgaggcgctgctgatcctgaagcacggcggggtgctgacgcatgcggggcggggccaggcggaggcgctgggctccctgttccgcaacatcatgtacccgcagcacggaccgtcgggtgggggcctgctgcgcctgcactccacctaccgccacgacctgaagatctactccagcgacgaggggcgggtgcagtgctccgcggcggccttcaccaagggcctgctggacctggaggggtcggcgctgacccccatcctggtcagcctggtgaccaaggacacgggcatgctggacgcgtacggcaagggcgccagcgaggacatccagcgcgccaaggccgagctgtacgcgcagatgacgctggacccggagacggggacctcacgctgcgccgccccgcactccaccacgcccctggtctccccgcccgccagcccaaagcccgcggagggggtgggcaggggcggcagcgccgagtccagcgtgcacggccaggcgcggtcgctgtcgcgcaacgcctcggccagcgcatccaccatccgcgccgccgccagcgcgctgaagctggcccagggcacgctcgcgggtgaggtcgggagggggaagggggtcccaagggggggaaaagatgggttggaacggcccaggatagactcgggagaggaaggatgtgggggagaagcaccggtgcagggaggggcggtgctcggagaaggttaagggagggtgcccagggtcaaaggaaggcgaggagcatgggaggcgagtggctttggaggtggggcaagggcggcgatcagggtagcacgatgctgaccctgcccgttgcgtcctccttccttcctggactcacgctgggcgctcgcacaagtggtgctcaggggaacgcttgccgcctgatgagaaaatcatgatgcagcagcttcgtcacctctcacacacacaccaccaccacatttacctctgcgccgcagactcggaggcagagggctttgtggagggcgcctccaacatcgaggggcggccccacatcttccccatgcccgagcagccgctggagacgctgaagaccatgcacgtgctgctgggggcgctggtggaggacctgcaccagctgtgcgtggaggagcagcggccgaatgccgacgccgggcgctcctactccgtcctcaaccaggaccccaaggactgggtgttcgaggtgggctggatgtatctggtgttcagatgaagtggagcatgggcccttgtagcaaacgtctggggctgagggtcgcgatgtcgtgggtctgggtgtctgcccacaggacggcgcttgggtaagaggtctaaaacaaggtgccaccccccccaccacctcgcacctcccccgcaggatgacaagccgtgcagcggcgagcggctgctcctgctgtacgatcgctggcgcaagctggccaaggccttttacagcgagaagaagagccagtttgacatcagcaaggtgccggacatctacgatgcggccaagtacgacgcgatccacaacgccaccatcatggggcccaagatcaaggacgtctacctggtcagtgggggcgcatgggtgctggattggacgctgctgttctccttgctttctgcagtcccttcagggccactcctcacccatgctccacagacggccaaggtgctggccgatgccgccatccccaacgagtacgggatcgagccggagggcaggctccgcatctccacagccatctgctcacaggtgtggagtcagaggtggaactggacagggtgggaaggcaggcccctggggcatcccagcggcatcgagagtatccaggatggtggaccacatgcctgttgcggcagcaggaagcactgccaccatgccgtgaccgctgaaccatagcctcccacgttcctgataccatctcaaacactcttggaccgctcagctgctgggaaagctgctggccgacatggcgtacatgcgtgaggagagcctggccacagcagggcatgtaagtttgacctgcccgcttgagcgcctgtccttgctcagaccccccatgggttctgccgtgccgcgcgatccctccccgcgtataatcggaaagcgacgctgtcttgagtacagagttggagcttgtgctgtgcttttttcgatccacccatccacccacccctccacaacaggccgggtctggagactccctggagtatgaggtcccgctgggggcagagccggagccgatgggcggcagcccccatgcaggtgcggtcgcgccgaggcgatgcacccacctgctggccactgcagcacctcagtgcccatgggcaggcaaatggtgcacgctctccaattcctgagatcggctctctgtacccactcctctgctcatcctgaaggccaagcatgtccccgaaccccccttccaacctgcagagagggatggggaggaggatggggacgacagtagtctgcaccgcctctgcccatcctacgcaacggtgagtgagacgggcatgtgcgtaattgccctcccccctggacaatgcctaggccgcacccaccagctgcaggcccaatgctgtgtcggcgcgtgagataccacctcgtgacctcaagcccgatcctcactcccttggaacaacccccttcccccatttgccactcccggcgcaggacatcaactccccactgcgccatgtccgcacccgcatctacttcacctccgagtcccacatgcacgcgctgatgaacatcgtgcgttatgcgcacctgggcaccggtgagttgcttgggagggcgagctgcgtgattgggcctgctatcggaagaagagcattttaaacaagatgtcacggcgtttccaacgtcgattgccgtgtgcaccccgggcgagctgaggccggcaggtatggcggtacaaaaccagggcctgctttagccacagcaaaaggacaacaccccccttcaccccgaccccggctgcgcagggagcaacggggaggcgctgagctccgtgctttccagcgaggggcaggaggtgctggcctctacgcgcgagcttgactacatgacgcactgggtgttccgcatgtttgagaacaaatcgtgagtgctgagggcgagtgggggtgagggggagcgtcatgggtttggtggctttggtgagccagactgggcaaggacttgcctctaccccctcccggcctgcgtatgtaatacctttcccctgaccattgatccctgccccccccccccccccttgtctcaggctgcctctcaacgacccgcgccgcttccgtgtccaaatcctgttctcgccgggggcagcacacaacccattggaggtggtgcccatccagatgaaccacaccctgcccgtgagggcgcgcgtgccggtgcacagcaagggtgaggtggaaagcgcgaattgcatgcgaccggtgcctgcagaagtttgccttcagttgcaggaagggctggagtcagccatttgtttaaaccattaccatggtcccgatttcccctcacagaggatcccacggagggcaagggcggcgttccactcgcgcagctggaaagcacgctcaaaccttacgcaaaaccattcaagcggcagtcggtgagtaatgataccaatgcacagccagcgtggccgggaggggacggccagctatgctgattcaatggcactgtatcttgggcgcctgggatcctgccaagatcttagagcgccacgactcaaaatcttgcactgccaacagtctccctccccccacactacaggaaccatactccatgcgggcaacagagctgaactctcagacgtcagaattggattactggatgtagcttgcatgttgtaatagtggggccttcctggcttatttgcgcagcaggctccgatttgaagagaatcgctgattcgatacaaatctaatgacacggcgtagatactcgccggttccgagggcacgtcgccgtttcaaaatatgttatccgcgtgtttacttcgagcataaagaggataggcacactaccagtgctcgtgcatgccattaggcttcaagtcattacctcctgtctgcccacacaccatgtcgggggctgtagtgacgcgaagggtacatgacgccctctgtcgacaccaactcctcgcttacgcacgaatgatgagcggggtggcgtctctggataccttgcccagcagctctggcctcgggaggcctcacgtgcgcattccatacgagggcgtccgtgttgccgcccggcaacaaccctccgccaatgccttcctgccttccttcaaagccctgctggtggatgcagcagggactttgctgttgccatccgagccttctgcgggggtgagcatcgcatgcggagagcgccgagatcgcatggggtggtcgggcttgttttcggattggccatcagcgggtgattgctattgcagttcaaccagcctccaggcccgtccggtgtaaaataattctccattccatgcctaggtatacctacggtatgcacggaagtattgcgacatccagctgacagaggcggaggtgctggacaggtttaggcaggcttacaatgccccttatcagaggtccttcattcgctatgtgggagatgcacggcccttctggtgagatctggatgaactatgaattgcactgtgattagtgagggaggcacgtctcgtgtatgaatgtccgtttgcacaagctgcgctgcgcctcccttgcataccatagacccctcctcgtcatgctgcacagcgtgaatactcacccccgcattccctgagcaggagcgacattgtggcagcttctacaggctgccacgaccccgacttcctggaggaggtgtatgcctactttgcgcacggcgacgcctggcgagtggccgacggcgcactggaaagcctgacccgcatccgcgcctcagggaccaagctgggcctggtctccaacttcgacacccggctgcgccccatactgagagagctggggctggacaatgtgtttgatgccgtgctcatctccgccgaggtgtgtggaaagacggtggcgcgtgggttgaagctgtgaacctgcatgcgtctgaaagtatcctggaggcgggggggtcccctgcccagcaacattgtgctttgcatgcatgttcagactcccctgtggccccaaaacagcaacaccggctgaagggatctccttcacatcctccgagccccaagctccgacacctcaacccccgcgaatttctgccccctgacccccccccctccaacacacacgcacacagatcggcgccgagaagcccaacccctgcatcttcgaggccgcatgtgaggagctgggcgtgcagcccgccgaggccgtgcacgtcggggacgaccggcgaaacgacctgtttggcgcacggcgggcggggtgctacgcctggctctgggggcaggacgtcagctcctttgccgacgtggagcagcgcctgtccactgggaacttcatggacagcctgacgggggtttgaggttgtggatgattcagactctgtgcaccggcttgctgccatcgattctgacgcaggccaggtggatgactgctcgagaataccttttccacggggccaagtccccttctcatcgtacccatcaccttggagagcacccctatgtgcagcctgaacctcgcttgtcaccatatttcatggcatttgctgaattctttgtccccaaaccaagagaaatcaccaacatccccctttgtcctgctggtgtgactccagaatccattcctccacactgagtgtctgtaacctgggagagcgcacgcaaggccgaggaaatcacaaggggcaggcgaggctattccttccccaacaggagggaggcttccgacaagcccctcaccacccggcattggccagggccgtgccaccatacgcgccgtacccgccgcgggccgcgccaccatcgccgtaccccccgacggcagggcggggggccggtgccccatacccgcctccgtacccctgctgctgcgccggcggggcaccgcccctcgcgaccccgggcagcgcccctggccctcccgcagcgggcacgggggggccgaagatctgctcgccgcgctgcagcttgccaatgaggtccagcagcgtgcgcgactcggcgccgtagtccggcgcggtggcggagaccagggagatgcggatcttggtctcgtcattgtacgtgtcctcagccaccttgagcttcatggtgtacgtcttgaagcaggcttgctgttgagagatcgagttcggggtgggtgtgaggttgaatcgagatctgagggatcctcgtggctgtgctatacccaaaacttggcatctgatatgcacaggcacctcggcaggcacatcctgggtttgacagcatcgcctctgccaggcggccgcgccgcaagacgctccctttaccccagggcatgcaaacaacgtcgccgtcctcgattcccaaaccgcactctcccgtgctcgcacatcgcaagcttcccgggcacttgcacctgcccaaacccctctctaacccattctcacacctggacgaggaaggcgaagcgagggttcccatcctcgcacagctgccgcagctcgcccgctgggacgccgatcagctccggggctgtcgtatgcattgtatggagtggatcgtctcacaaactggcggcaggccagcaacggtaatacgctggtgtgaaggctcgtgcctttgatatctaccactgcggaaggcccctttcctcacccatctcacagccctgtcgcataaccccaccccccccgcgcaaaacacacccaaacccaccggcctcgttgaaggctgtcacccagatctcgccgctgtggtctgcgacctgcatggacacgatgtaccgccagtctggcgttgcgttctgaccgcagcgctcgcagtagctggggacagggatggaagagggggcgggaggatgagagcacggggttgtgggcacgtacgacggacgacaggatgcaggcagaaaatcaacttgtggcgcggccgcaccgggtgacatgagctaggcctggtcaaactcccgctctccgcgcattttacccactctgtgagccatttttactacggcccacgcaggaaccctacccctcccaaccctcacaccagcctccccacatctgcctcacaagttgccgtcgccggtgtggtcctgcagcttcttgttgcaggtcttgccgttgaagggcagggggcaggccgggtagtacatgttttcgttgcgcaggaaggcgacggtcgccaccacctgtcaatggggatccttaaagatggccttgtaggggtccaagaggcgtgggggggcgacatctccagtctgcaggcaagtcagctggacgcacatgcggagcctcggcatctggaaccagccaagcacgctgcttgtgctccgcagagtacgtgctacggcgcagaccatctcctcgagcccaacaacggcattgcccagcacccgcacctgcacccacgcgggctgcccgcccaggcccagcccctcgtcggcgatctggctcagggtgacgcggcggtcggcgcgcccaccgccgccgctcggcttgctcagcgccgcggcggcctgggcgcacccgccctggtcgtacctggagggcgcgcatgggaaggaaccgggagcttgcctgagcaattgatgttcacagagggcgcccgggcgtcggcaccacggcaatcgaggaccgtggcaactgcttccatcggctagcgaacccctcctaaaaccccgtcccaacacctcaacaccaagcttccgcctctctttttccccccagaatgccgcaccacgcgcgcaggcgggcggcctcggccacgtccggcgggtcgatgagcacggtggaggaggagactgtgctcagcgtcttgccgttgaagtcgccgacgcgcgcattcttcactgccaggacggggtgggtccctgcggcggtggtggcctgcaggctgtcgcccggggtcagcgcgtaggcgccccacaacgtcacctcgatggaccgcccgctctcgtcccggatgatcatggagcgcttctgcgtctcgcccccatcacgcttggtgatagaggtccagtcctgcacgctgtccaccactcccaccacgtccaccatctggccggcgggaacgtcctccaactgggagatggaggtgaactgcagtgtgggcgggggggtgaaaggggggaggggg

SEQ ID NO: 33665 - DNA, 125 bp, Chlorella protothecoides
agctttggtcgaggccaaggtggttgtgttcacggtggtgaaacttgtgggtgtcagggtcagagtcctacttggtccaaacgcaaagacaaatatcaacgtcagcaaggagggaatggcagtgg

SEQ ID NO: 33666 - DNA, 447 bp, Chlorella protothecoides
  modified_base (93)..(282): a, c, t, g, unknown or other
tggcctgatcctgctcaaacttatgccggcaaccgcctgcacttttttgtgcaagctcgccgctgtcagtcagcaaccatgcagctctttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggggatgcagtgcctgatcgaggtgcgtgtggatgcggggtcccgggtggacagattcgctgcgctccaaaccaaatggttcaacttggatcgctgctgcgctccagggcaggtgttgagctcatcgctccccgcaaaccctgctgacagccccacgccttct

SEQ ID NO: 33667 - DNA, 117 bp, Chlorella protothecoides
agagcatcaagaggctcgcctgcacgatgttaatgtatgcatgtggtgattggccgtttgataaaccctcgcctttgagtttgtcacgcagatctgaaaaccacacctacttgcagc

SEQ ID NO: 33668 - DNA, 195 bp, Chlorella protothecoides
aatctggggccctacgaccacaagtgatcacgatgactcatcgtcctgtacagggaaacagttatgaccatttgtgtgtgagagtgagtttcgaagatctccttcaacgtttatgtccaggcatcacaaccgcgtcatggcatcaactcgggcttgccgacccgcagaccccagccctttatctaatcttcacta

SEQ ID NO: 33669 - DNA, 65 bp, Chlorella protothecoides
agccacctccacccctgcctctccagcccccgccacctccacccctgcctctccggcccccgcca

SEQ ID NO: 33670 - DNA, 75 bp, Chlorella protothecoides
gcctcgacctctcaaggtgtgtcaggccactccactcccccaaacccctgccctcaccctcccacgctgggcgac

SEQ ID NO: 33671 - DNA, 62 bp, Chlorella protothecoides
atgccggtgcccgaggctgaagcacatcgcgccaggcacgccccagcccaaacctccaccca

SEQ ID NO: 33672 - DNA, 61 bp, Chlorella protothecoides
cctgggcgtccctcccttctcgctcccggcactggaggcagcgctggacccgggaccacac

SEQ ID NO: 33673 - DNA, 134 bp, Chlorella protothecoides
agggtggagggtgaaggtcggttctggggcaagtgggggggaacagaggtgtgtgtaccgagcgagtggcagtgcaaggcgcagtcactgctccatcctcatgagtgcttctgcagcacagcgcgatgatagga

SEQ ID NO: 33674 - DNA, 74 bp, Chlorella protothecoides
atcacgaccgtgcatggctcagtcaagaccgcagataatgtgggcagtggctcgaagagtacccctctgatctg

SEQ ID NO: 33675 - DNA, 61 bp, Chlorella protothecoides
catgaagtggggcgtgttcatcttctttgccggtgagcagggtcgttgcgtggatggagca

SEQ ID NO: 33676 - DNA, 187 bp, Chlorella protothecoides
cgttcgctacatgacgcccctggtgagtgcgtgccgggttgaaccggccgagcgtcgcctggtttgagaagaggtctcggatgcacacgggtctaggggatgctgtgcagtgaaaaaacaccaaaggccccgcccctgccgtcccgtcacatgcctttcgtgaggctgtcccgcatccctgcagtgc

SEQ ID NO: 33677 - DNA, 84 bp, Chlorella protothecoides
tgccgagatgcaaccacgctcacggcgtcttaccctgatgtcgacatgcaccaactcgctaggctgatgccgattgaaggctgt

SEQ ID NO: 33678 - DNA, 80 bp, Chlorella protothecoides
ggcctcgcgcacggcgtgggagggcgaggcacggccgtgctgccgccggtaccgtcagggccggggtgagtcccgcactc

SEQ ID NO: 33679 - DNA, 134 bp, Chlorella protothecoides
agtctccttgccgtgccacatacctcatcctctcccacctccctccacaccgccaatcccagaccaggagcaaggcgctggggctgacccgccgccacaaggccctggccctggtcgcagccctgacggccctg

SEQ ID NO: 33680 - DNA, 69 bp, Chlorella protothecoides
accagggactattgagtgcttccagtggcgccggggttcacacaacgatctcggtcattttggccaggt

SEQ ID NO: 33681 - DNA, 61 bp, Chlorella protothecoides
tcctcgctgtgggccgcggccagcaccgcctccagggccacttctcgcgccggcggccgcg

SEQ ID NO: 33682 - DNA, 61 bp, Chlorella protothecoides
ctctgcacaccaactcttcctccctgttgtctggagcatagggccccagctgctcagcagg

SEQ ID NO: 33683 - DNA, 86 bp, Chlorella protothecoides
acagcaaggcagaggtattatgatcgtgtgggtttcgaacatacccacccccaatcttaccttggcatatgtgggatccagctcga

SEQ ID NO: 33684 - DNA, 399 bp, Chlorella protothecoides
  modified_base (93)..(286): a, c, t, g, unknown or other
acgtgccaggcccgggcgcatgggctgggatctggcggagcaggaccctctcccgcctgggttgcctgcgacctctccgacgccgagctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacggcatgcctcttcaaggcactcgagcttgcgtttggcagagggacagccacgctgcatcaagagccgcctgctgcctctagactcacgtagtctccttgcaacctgacc

SEQ ID NO: 33685 - DNA, 7425 bp, Chlorella protothecoides
  modified_base (101)..(115): a, c, t, g, unknown or other
  modified_base (356)..(365): a, c, t, g, unknown or other
  modified_base (1024)..(1033): a, c, t, g, unknown or other
  modified_base (1952)..(1961): a, c, t, g, unknown or other
  modified_base (3146)..(3155): a, c, t, g, unknown or other
  modified_base (4210)..(4219): a, c, t, g, unknown or other
  modified_base (4545)..(4554): a, c, t, g, unknown or other
  modified_base (6166)..(6175): a, c, t, g, unknown or other
  modified_base (6511)..(6520): a, c, t, g, unknown or other
ggcagggcgcgacgtcgtcgtcgcggggtaccccacctttgaccccgccgcctcgggcctgtcggggccggtgctcacggcgggggcgctcagcaaggcannnnnnnnnnnnnnngatggggtgctgggggcgggatctgataatgttgctggcggcacacccggtggctgcatgtggccagacccccgcacacctgcatgcctgcaaggcagccgcctcttgcctcctcgcaccccgagacccagcgcatgggcctggtcaccctccccaacaccccgcactcaccgaaaccctccccgccttcaccgtcacgcggcgcaggttgtggcgctgcgcggccggccggccatgctgnnnnnnnnnngccgaaaccatccccgccttcaccatcacgcggcgcaggtcgtggcgctgcgcggccggccggccatgctgctgaccagcgccagcgtgcgcagcggggcgtcgggcggggggctgctggaccgtgactccggcgcgctgctgggcctggtcaccagcaacgccaggcacgtgctggggaccacctacccccacctgaacttctgcatcccagcctccctgctgaggcccacgctggcggcgctgctggaggagaggagcgccggcccggactgggcggccctggatgcccccgacccggcgctgagccgggtgtggcgcctgggcagccacgagccgccggacaagcagggtcttgagccaccagtgccccgcgccctgcaggagctcttggctgagcagcagggggaggggggaggggcgggcaaggcacgaccgcgcttgtagatgcaggcacgcctgtgggtggtggattgctcgactccgggcgggcatgctttgtgtgggccccgagcactgtccctgatgccttgtttcctgtgaagctcaggcccattggccgacattacatcgccccactgtcgtagacagccagccttggacttggcagggtgatggtgtcagtggcagtgacaaacagtcgtgaagccggttggtgtnnnnnnnnnngcgaggcgccagacaagcagggcctcgagcccccggcgccccgcgccctgcaggagctcttggctgagcagcagggggaggggggaggggctggcaaggcacgcccgcgcttgtagatgcaggcacgcctgtgtgtggtggattgctcgactctgggcgggcatgctttgcgtgagccccgagcactgtccctggtgccttgtttcctgtgaagctcagggccattggccgacattacatcgtccccactatcgtagacagccagccttggacttggcagtgtgatggtgccagtggccgtgacaaacagtcgtgaagccggttggtgtggaccgcatgcagtgacttttcgcacgcactcagaggaggtcagcctcggcaggggccacctgtccaaggatctgcacatgcgtgaaggtggagagaatggtgatcatctctctcaaaccggaaaaccacgcttgcatgccttgaaggatagcttcagtgctttgtgccgagctcggtcccaccaatcagaccactgcctgcctgtcggctgacacccgacccctcaaacccaacgggatcctgaacatacacaccaatgggttgtccacctcagacagagggaccagcaggcccttgccctcgtggtaagcagcgtcctccttggaggccacgtgccgctgggtgagtcttgcacccgccatcttgttgccctcgtgtgaccgttcatacctggggtgatgcagggaaggggtgttgtgtgtgagagtacccgaccatgtctctgctgctggatcacaccagccttgtagtgcaccatcaaaagtgcttaggacttggcataccattggccggaactcaaactaacatcacatcacagatgccaaatccacatctggtcatcacatttgccagtccatgcagaggaccnnnnnnnnnnaatcacaccagctttgtcgtgcacaatcaaacgtgcttaggacttggcataccattggccggaactcaaattaacaacacatcatagatgccaaatccccatctggccatcacatttgccagtccatgcagaggacctggttcgcatgaactccccgggccagagcccgcgctaccacggcgtcttgtcacacacttgccaccagccgatgacttgcctgagatggcgataggactcgatggctgccgtggccccaaaccgcggctgccccgtccggaggtcatagctggcggccagcccggcggtgaacgccggctgccaccagctgcggaagaccgcggcagccgatacgccatccagtcctgcccgtgccttcagcatcacattcttgtttgcctgcggtgtgcaattgtgagggaggcggtgaggcagcgcgcagccgaacacctcctcagcaaacgcatcttgcatattagtcggggatgtcaggcttaaggcagtgtatgcacatgttcgaaatctcccgcccacccctctcagggaagatcgccgcacctgccagctggctccaaagcggaggaccgagccctgagcggattgcatgtcggagaccatttggaagccaatgtccacatagttggtaatgcccaccacatctgcgcaggagtgggtgggcaagcgtttggcacagtgcattgcattgagaatctagctgcgggaggggcttgttgggatggttcacggagcgttttgcttaaatcccaactcccctccagaccagggcccagcaacaccaccatgcctccaacatcccccacaaaacagcaccccacaacaaaccccctcttctcatctcgcctgatccctcaaaagggttgtggacgttgcgctgcagggccatgtggtagaggaaggcgacgctgagctggcgctcctccaccagctccagagcggcggtgaagcggccgtgctcagtggccgactgggcgccgggggagtaggcgatgccgtagctggctctagagaggcacgcatcgacggcgcgctggattggggaccgaggatcggtgtcgggggcgggctccgagaagagggggcccagcgccagggagggccgggtgctggcgccccacaccagtccacccaccctcccgacctgcaggttgcggtgatgcgcgggggaannnnnnnnnnttgtcgggggcgggctccgagaagaggggggccagcgccagggagggccgggtgctggcaccccacaccagtccacccaccctcccaacctgcaggttgcggtgatgcgcgggggaagtgcttgtcagtttgactcccagatccaactcggtgatgttgctgtaaaaagatccgctctgagggaagatagactcccatgcatctcccctccaccgcgccatcatccactcagcccggcgcggctcaccacccaggcgtcgtgcaggagagcctgggagggggacatcaccgcgccggccgacagggcgggcgaggtgtagcgcgcccccaggcgcaggttctggccctgcaggagtgcgccctgcttcgaccccggcgccaggggcagctgcgcaaaggcggccaggccggagccggcgtcgatcatgcaggcccgcatcgtggccaggttgcccgctgcgcccgctgcgccggccttcacgtccacgaaggagtaggggtggcgagggtctggctcaaagcgcagggtcatggagcccacggccgggccagcagcctcggtgccagactgcccggtccccagcccgatgccgcgagggaggcccagcttagccgtgacgttgatgcgggggtcgtcggggggtgcaaaatgaaggatgctgcgcaggtcgggacccaggtagtcgccaaacagcagctcaagctggggtctcgcaaattgcctagaagtggggtaaggggtggtgggaggggtgccgcctgatgatctttagacagcgcgtgtgcggcaatctcgggactgcaatcctactatcacctgtcatacgagctcttcgtgaaccgagatcgccccttgcgctcgcgctcgaggagtggtggaaccaacacgacagagggcggcaggtcggaaccctgaatccaggagatggcgtttcccatctgtatcagttgtaatgattattctagtgtaaattcaactcaaggggcaaagttatggtgtctaatgtgtgcgaggctggggaaaccctgatattgtgtccctcgtacatgcagannnnnnnnnncgtaatgattattctattatgaattcaatacaaggggcaaaggtatggtgtctaacgtgtgcgaggctggggaatccctgatattgtgtccctcgtacatgcagacgtggtggatctcagacgtcctttactctggagccctcattggattgtgctaataaacagttatctcgacgaatcccaaacctttttgtgtggtatttttcgaggcgttctcatgcgttgatttcagttgcaagagccagtgttcttgggtggtgggatgtgtatttatgaagtggagaggcatcgtgttaaacccccagcacagccagcatgcgggggannnnnnnnnnccatcaacagttctctcgatgaatcccaaacctttttgtgtggtaattttcgaggcgttctcatgcattgatttcagttacaagagccattgttcttgggtggagggatatgtatttatgaagtggagaggcatcttgtcaaacccccagcacagccagcatgcgggggaagctgctgtgtcgaaatgaggaagctgcgcttaaccatacattaacaattccctggccccccgcactttcacggtggcaaatatattgtgtatcgacaccatgtctgaggcatctaagactttgggaaacaagctgaacgatgcgtgggacaacctgacgcagccccatcgtcctggcccggaagtgggtgccgaccttcaggctcaggctgctgcctatgactatgcggtgagcgaggagtgcaacgataattctgtatgtatacagctgatcttggtgcatttgccgatatgcctgccttccgtacccctgcagaacgctgcacctaccgcggaggaggctgcacggaacgctgctgacctggctgccgccaagacagatgtagcgcatgaggaagcggtgtctgggctgcgtggcaccggtgagcgagagttgaatcatgtcacgggggggttcagacattggtaacagcagagagtcattcctgcatcttggatgatgctcggccctgagggccctgaggagtgctggggtgcttggtagctttctggcatagagcatcacgagttcaccaaaagtcccatcctcccatcctccatccgcttacaatgtttaccaggggagtacttggccgatgctgcagcaggagctcagtcaagcctcgccaccgcaaaggagtatgccacgagtgcctccgcaagcctggcagacacccatgctgctacccaggaatccgctcacaacgcgcaagtgaggaggtgtaggattcagcaagacagaaaaggaaagatgtgtcaggaatggacctaggcatggctgctgcaaccccttacagtcacatcacacccaatccattgactccatcccacaggcgagcgctgtaagctcattgcgtgatgccggcacccacattgctggggggctggaggtggctggcgagaaagcgggggatacagtgtctgccatccgcagcaagctgggcctttgaataccagaatggatttgcagtgatgaactcgtcatcgtgtagcacacaagtgcatatgccaccaccatgcaagattgtcctcagcacagcgacctattatctcccgtctcagattagaggtcgtatgtcaagggattgcagtggcagatcctttggatatacatgacgaacaagggggcaacaaccaaacttgcaccaacgggcttacatgaattggtagggtggacacaacagggtatcacctctgtagcgcatttgaaaaaagaaaatagccgagaggggacaccagtggtgagggcaagaatggctccccacaccacatgtccattctgagtcacaagtcagaatcggtaatcctttgaatgagctgggcccctctcaagtagccatgggcaaatgggcgcaagctaagcgccaccccaaaacacattaaggcttgtccgtggtgatgannnnnnnnnntggtgatcctttgaatgagttgggctcctctcaagtagccatgggaaagtgggcgcaagctaagcgccaccccaaacacattaaggcttgtccgtggtgatgagggatggttcataaaagtccggagcctcaaatccgagcatgttgatgtaggttgccgtcacattggtgaggccagccccaggcaggtcctccctgcaaggattgtcgagcatccttgttcagaacaacaacggcctgagcaggtctgacagaaagccgttctatatttcaaacgatccacggggcaggcacggtctcacacaaaggcaactccacatacaccccagccccttnnnnnnnnnnggccgttccatatttcgaagaatccacggggcaggcaggatctcacactaaggcaactccacatacaccccagcccctttatgctcacctgaagcggatgttcttgggtagacccggacctccaatggcaatggggacagggttcagggtgtgggatgtcagaacctcaggttcgccatccgtgtactttggtgagccatccttgttgcgcttgaccatttcctcagcattccctgggggggggcagcacattatgtcatgcgacatgctggaatccccagccgtaactgttgccagggtgtgcttgcggtcccacaaaccctccaggtacaacaagtcgatcatcacagcatgcagggcaccagcatgggcacaggactgcggaaacctctctagccagtgtgtgcctgggacaacccacattaaaaccaacttcctatgattaccatggtctgcagtcaccaggaagctgcctcccacctcctccactgcatccagaaggacctgtgatccagccagaggtggacagtgggcacaccatggcctgtgatcatgatgctcaccctcagcttgcacccgcacattaggttcgagccaactccctgcattttgctccagcaagtgacaccctagcgtctaacaccaagccagaccactcaaaaactaaataacagccctgccttcccctgcctcaccttgactcccctgtctgcagcggcgcaggagatgacagtagccttcagcttcccggtgtgccccaccatgtccgagtttgggaagttgcagcggatgacgtcgtactttccgctcaggatggcttccttcacccgctctgcgtttgattggaagggggaggatatattgcaaggggggtacagggtgccagaggtgccgcagtgtcttac

SEQ ID NO: 33686 - DNA, 112 bp, Chlorella protothecoides
gaggggactgcgctgtctacaggggtggtcctccagcagcacaatccaggcggcaagtggcggcagcagcaaccggtcactcgcccaggcccatcgccccagcctacccttg

SEQ ID NO: 33687 - DNA, 613 bp, Chlorella protothecoides
  modified_base (108)..(219): a, c, t, g, unknown or other
  modified_base (275)..(368): a, c, t, g, unknown or other
tgcctggctgtacagtacagaatgcttggcctctcgagccgcagcacatccagttccaaccagcacctgcagcagccatgggctctgagctcgagaccccccaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtatcagagacggttcaaaagaagggaggctcgctgcttattcttcaggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccaatccgccatgtccagcgaggctgcgagaggagtatggggcgactgcgtctgccaagaacctgtcgccctgcggggcctggccgatccttgccagaacgaatacgggggccacgtgatatgggcacgagcagccctccctgcctacaggcagtgatgccctcccgcgagtccccgccccccgggccgacccccccctaaaaaaaataacccagtccccctcaccctggtcgatgtggat

SEQ ID NO: 33688 - DNA, 124 bp, Chlorella protothecoides
agggcctgcactccccctgtggaaggattttggggcatcaggggcgttgtggtcaggagttggtgacctgggacttgcgcatgcagccagtgggggaggcgtcttcatgcgagcagacagaatg

SEQ ID NO: 33689 - DNA, 118 bp, Chlorella protothecoides
ggggtcgccttggcgaagctgcggggagcacaaggggtgccgagtggccacatgagaagctggcaatgagctcagtaaaagacagaatggtggcataataaaggaagcaatcccatac

SEQ ID NO: 33690 - DNA, 61 bp, Chlorella protothecoides
ccccctgctttcctccacgctctgcctcgcgggcacagcctgggcctggcactgccgcgca

SEQ ID NO: 33691 - DNA, 61 bp, Chlorella protothecoides
gggcccctggccacagcgggcccggcggagggcttgggccccagcagggctcgggcgcgct

SEQ ID NO: 33692 - DNA, 100 bp, Chlorella protothecoides
ctccaaatcttccggatgtgtaccaagtacgatacaatgagaaatgttggatagtcacaggcactgcccggggcatcaatgtgcgaggaaactcccagaa

SEQ ID NO: 33693 - DNA, 127 bp, Chlorella protothecoides
cccccccggccacaccccgcctcaacagaacctccccatccacacctgcccgcacaggcagctctacttcgtggagcagcaggggctggcgcgggatgagatcgcgaagagggagaaggagcaccgg

SEQ ID NO: 33694 - DNA, 144 bp, Chlorella protothecoides
cttttggacgaccaacctcagagatcctgccaagcccagcatttttgcgcgcgccctgccgattccgatgcaatgttgaacgccaagtcggaatggtgactttgtgagaccagtgcatgacctttccagcatttatccaatgta

SEQ ID NO: 33695 - DNA, 102 bp, Chlorella protothecoides
ggagggtgggtggggaggttggtcgaggggggctcggccggggacaagtggtcaggcagacagggtggagctcatcccccggcaggctcgtgcctgcggagg

SEQ ID NO: 33696 - DNA, 74 bp, Chlorella protothecoides
agcaggtgatcgcaggcgaggcatcagtacagagcctggcatccctcagggcctgctcactgccagggccctgt

SEQ ID NO: 33697 - DNA, 85 bp, Chlorella protothecoides
tcgtcgatcatcgcacccactcagagccagtatgcgatatctagcttttaccttacacagtttaaatccatttgcgctgtttctc

SEQ ID NO: 33698 - DNA, 61 bp, Chlorella protothecoides
ggcggcgcggcggaggacgacccgccagcggcatcctcggccggcggcgcggcggaggacg

SEQ ID NO: 33699 - DNA, 72 bp, Chlorella protothecoides
gaccgccaggtcggagaccttgggcgccagccgggtcatcgacccgcccaccggcaggtcgatgcccatgac

SEQ ID NO: 33700 - DNA, 61 bp, Chlorella protothecoides
ccggtatctagtttgccttggatcagtgtgtgtggaagtgtctcatctgagggtcctggag

SEQ ID NO: 33701 - DNA, 139 bp, Chlorella protothecoides
ctgataccagcagcagcaaccctgctcaggccttggttgcgacgcagcatcatccattgcgacgtatatcatgtcttctgtgcatcaaaacccttgcacccttccaagttccttgccttaggaaagcacgggcgattgc

SEQ ID NO: 33702 - DNA, 61 bp, Chlorella protothecoides
gtatttcaacgaagaggtgagaactcgggtgccagtgtgcctcaccctggggtatcacgcg

SEQ ID NO: 33703 - DNA, 61 bp, Chlorella protothecoides
ggaagccgaggaggggctggttgccagcctaaaacgtcggctggacacgctcacggcagac

SEQ ID NO: 33704 - DNA, 61 bp, Chlorella protothecoides
tccatggcggcgtgcgccggctggggagggggtgcaagcatcctgcagccgtcccaagatg

SEQ ID NO: 33705 - DNA, 121 bp, Chlorella protothecoides
attgcaggtgccctggtgcgacccacccgctccagatgcaagcctccttcacccctcctctcatatcttctcgcacccccgcttacacacgaccgcaaacccaccctggaagccgcgctgg

SEQ ID NO: 33706 - DNA, 61 bp, Chlorella protothecoides
gcgctggaactccaggctctcgggcgtgaaggcgccgatgcgctcggagtgctccatgaag

SEQ ID NO: 33707 - DNA, 152 bp, Chlorella protothecoides
ttgttgctggtgggatcggaggcgccagcagatgtaccatgctgctagaattctagatcagtgaaccagaggatcgtctccagctcctccgcggtagagactctcatgttaatatcggccagaggtggaagcttggtgatgaaagaagactc

SEQ ID NO: 33708 - DNA, 127 bp, Chlorella protothecoides
ccaagctttggtatgtcattggtcccgtgtagtatgtggaatttcgcgttcattaactgccaagatggtcgaatccaaggcctcatgatgtcgactagggcaggagcttgattggaaaatgtaggag

SEQ ID NO: 33709 - DNA, 71 bp, Chlorella protothecoides
ggttggagtaacggcctgggagtgggaggcgatctcgaggacggagccagtgcctagggggaagacgggcc

SEQ ID NO: 33710 - DNA, 119 bp, Chlorella protothecoides
tgtgtgtgtgtgtgtgtgtgtgtgtgtagaagaggagttggtgaagagaggatgcagcagagtgggcttgagcgtggtctgagctgctcgttatgagcagctcgctgccgcggccagga

SEQ ID NO: 33711 - DNA, 74 bp, Chlorella protothecoides
gcacggcagtagcaatcacccccctttctcatcccttcagcctgccttggagtgctcgccgttgatgatgggcg

SEQ ID NO: 33712 - DNA, 24476 bp, Chlorella protothecoides
  modified_base (312)..(321): a, c, t, g, unknown or other
  modified_base (1263)..(1272): a, c, t, g, unknown or other
  modified_base (1701)..(1710): a, c, t, g, unknown or other
  modified_base (1965)..(1974): a, c, t, g, unknown or other
  modified_base (2964)..(2973): a, c, t, g, unknown or other
  modified_base (3320)..(3329): a, c, t, g, unknown or other
  modified_base (3639)..(3648): a, c, t, g, unknown or other
  modified_base (3771)..(3780): a, c, t, g, unknown or other
  modified_base (3956)..(3965): a, c, t, g, unknown or other
  modified_base (4030)..(4039): a, c, t, g, unknown or other
  modified_base (5160)..(5169): a, c, t, g, unknown or other
  modified_base (5434)..(5443): a, c, t, g, unknown or other
  modified_base (5567)..(5576): a, c, t, g, unknown or other
  modified_base (6165)..(6174): a, c, t, g, unknown or other
  modified_base (6898)..(6907): a, c, t, g, unknown or other
  modified_base (8038)..(8110): a, c, t, g, unknown or other
  modified_base (8243)..(8252): a, c, t, g, unknown or other
  modified_base (8331)..(8340): a, c, t, g, unknown or other
  modified_base (8419)..(8545): a, c, t, g, unknown or other
  modified_base (9188)..(9197): a, c, t, g, unknown or other
  modified_base (10000)..(10009): a, c, t, g, unknown or other
  modified_base (11415)..(11424): a, c, t, g, unknown or other
  modified_base (11658)..(11667): a, c, t, g, unknown or other
  modified_base (13059)..(13068): a, c, t, g, unknown or other
  modified_base (13357)..(13366): a, c, t, g, unknown or other
  modified_base (14705)..(14714): a, c, t, g, unknown or other
  modified_base (15254)..(15263): a, c, t, g, unknown or other
  modified_base (15765)..(15774): a, c, t, g, unknown or other
  modified_base (16139)..(16148): a, c, t, g, unknown or other
  modified_base (16555)..(16564): a, c, t, g, unknown or other
  modified_base (16869)..(16878): a, c, t, g, unknown or other
  modified_base (17193)..(17202): a, c, t, g, unknown or other
  modified_base (18178)..(18187): a, c, t, g, unknown or other
  modified_base (18441)..(18450): a, c, t, g, unknown or other
  modified_base (18776)..(18785): a, c, t, g, unknown or other
  modified_base (18926)..(18935): a, c, t, g, unknown or other
  modified_base (19268)..(19277): a, c, t, g, unknown or other
  modified_base (19668)..(19677): a, c, t, g, unknown or other
  modified_base (19758)..(19922): a, c, t, g, unknown or other
  modified_base (20153)..(20162): a, c, t, g, unknown or other
  modified_base (20470)..(20479): a, c, t, g, unknown or other
  modified_base (20599)..(20608): a, c, t, g, unknown or other
  modified_base (20690)..(20699): a, c, t, g, unknown or other
  modified_base (21358)..(21367): a, c, t, g, unknown or other
  modified_base (23381)..(23390): a, c, t, g, unknown or other
  modified_base (23496)..(23505): a, c, t, g, unknown or other
  modified_base (24240)..(24249): a, c, t, g, unknown or other
ggcgccgcgccgcgcgcggtcctgggccgcctcgcgctggcccgggccctggtgagggagctgggcgtggccgcgccggggggcgcgcgcgcgggcctgcccgtcgaggcgctctgcgctttcctggcgccggcgctgggccacgcggcgggcgaggtccgctccgccgccgtcgatctctgtgtgctggtgcgaagctggaagtggagggaaggatgagggaggaattgtcccagggagggggggtggagtgggccgcgcgtcggtgccgaccccctcattcagtgatgctggctctgcgctggtacactnnnnnnnnnngagtggaggaaaggatgagggaggaatggtcccagggaagggggttggagtgggccgcgtctcggtgccgacccccccactcagtgatgctggctctgcgctggtacactccggccccatcccctttccagacgagcacagcgtgagtcgcacaacccgtccagccacgcacaaggagcaggcagtacattgccgtcacagccacacctcgtctgcctccatcctttgcaggtcggagaggtcgcaggtccgggaatcttcgcgcacctgctgccctccaacctcaacccgaagctgagggaggcggtgctcagcgggggaaacgcgaccagcccctcccgccgtgcctcgacgcagacggaggcggccagggacggcgcgcgcgcctcgccagcgatgcctgccggcggacgcaggggcccgccggagccaggcgggaccgtctcacacaaggcagcctcgcagcggcggcctggcgcccagcaccgcccccacgcctcctccggcgagcacgaggcggcgcgggggcgggggcgccccgcgtccgaccccttcgccaaggccgcgccgctgcaggccagcccgctggggagcgaggcgagcagccccagcatccgtgcgggcggcgccgacgatgacgacgccgcgctgtttgccgccgagctggcggcgcgcgaggcgcggctcggccccgcccacccggaggtggccgacgcgctctccaacctggccatagtgcacaaccaggcgagggcggggcgagagagtgggagtggaaatgtggatgggggtgggatggggaggagtgatggcggtctggttgggggctcagcacggcggtcggggcattcctgtgtcctcttccctttgggcaaagatcgacagagcacagcagataacaaagcatggcatccacctcccgcacccaccgaccccacgccnnnnnnnnnnggagagcgggagtggaaatgaggatgggggtgggatggggaggagtgagggcggtctggttgggagctcagcacggcggtcggggcagtcctgtgtcctcttcccgttgggcaaggatcgacagagcacagcaggtaacaaagcatggcctccacctcccgcacccaccgaccccacgcctgcgcagaggggcgagacgtcgctggcactgccgctgtaccaacgggcgctgcgcatctgggagggcgcgctggggccggaccacccagaggtggcgcacgcgctcaccgacattgcagtcatcttcctggaacgggtgaggcgtgccgtgcgagagggggccaggagggcatagggagacgaccacccacagacaagcgtagtccacccgagaattctgcaccatccctcctctgcggtcctcccccnnnnnnnnnnaccaggagggaatagggggacgaccacccacagacaagcgtagtcgacccgaggattttgcaccatccctcctctgcggtcctcccccgcgcaccctcctcaatgctcctgcccatcctccaaggccctcctgcatcacctcccaactgtgcacacagggcgaggacgccaagggtaggcccctgctggcccgtgccctggccatccaggagctggagctgggacctgcgcacccagacgtcgtcgccatccggnnnnnnnnnnacaccctcctccatgctgccgcgctttcctccaaggccctcctgcatcacctcccaaccgtgcacacagggcgaggacgccaagggcaggcccctgctggcccgggccctggccatccaggagctggagctggggcctgcgcacccagacgtcgtcgccatccgggaggtgctggaggaaagcgcggcagcatgaacaatgtatccatccccttccctgtgctccgctttcgtgctccccctgccctgtccgtctctgctgttgtgcacacgtgccctaagaaaattgcaaggaggagagtgtgcaggcagggcggggtgcgaccccactgcgtcaggtgtgggcttccaggccgggactcttctcaggcacggggacgagctgcagcctcagggctgccagctggtcgtcgccgacgggggcgggcgccagggtcacggcgcaggtgccctgcgtcgtcttgggaaaggcgatgacgtcacggatgctgctggcgccgcacagcagcatggccagccggtccaggcccagggccatgcctgcgatgggatgaggaatggacggcgtgggtgctggcggctgtggtgcattcggcgaccacgcacgaagagtgattggcgccgcaaaaactgtgaaaccagcccaggacatacaggagcaccccctcccaggctggagaatggactgccatgtgtcatgcagcccacctccatggggcggagcaccctggtccaggcagtccaggaggtagccgaactggagggcggcctcctctcgtgagaggccgatggcgtcaaagaccatctgctggaggtctcgcctgaatggtggggaaggagggcaaggaatggatggtgactttgctgaaaggctgggagtgagtgactgtacaggtcccagccactggagggtgtcttgcagccaccgccgaccagggtcctcagcagctcaggccaaacccagtttcaaacctgtagatgcgcaggctcnnnnnnnnnntgcaaggaatggatggtgactttgctggaaggcggagagtgagtgggctgtacgggtcccagccactggagggcgtcttgcagccaccgccgaccggggtcctcagcagctcaggccaaatccagtttcaaacctgtagatgcgcaggctcccgccgccgacctcgatcccgttgtacacgagatcgaaggcgtgtgccctgcactctgccagcgggacgccctgcgcagaggattggagatggagggggtgctcgctgtgctagataaaagataaggcctgcaaaagcacagaaaaagaaaatgcctgcccactccacaccaccgagtggggagatggaaccgcgnnnnnnnnnntaaagataaggcctacaaaggcacagaaaaagaagatgcctgcccgctgcacaccaccgagtggggagatggaaccgcgggccagtacattacatcctcacacattgcttcacctgcgcgatgtcgtcctggttgggggcggtgaagggatggtgcagggccaccaggcgaccggcttcctcatccctctcaaacatgggaaagtccacgacccacagcagggagtgggcagagtcctgcgtaggcaaggtaggctggatggttgtatcccagaagccagtcctgcttgtgcatgaggcagaggcaaggnnnnnnnnnngcagaaaggatgatgttgatcagggacagatgagggacggaagacctccaaagtatgcctgagagtcatgcattgacgcatccagcaatcataaccttccctgtacgttccaaactcacgggnnnnnnnnnncccctgtgcggcagctgggtggcctgatgttcccgccccagcgcaagcacgaccactccaggcattcaccttcacgagtccaagggagcgaccgaggtgttgtcggacccggtccatgcccttgagcaccgtggctgccagcccagccccgaaaagcaggaggtcgccctggcatnnnnnnnnnntccctctgcggcagcctgatgttcccgccccagagcaagcacgaccactccaggcattcaccttnnnnnnnnnntgcaccgtggctgccagccccgccccgaaaagcaggaggtcgccctggcatgtgtcagtgaggatgatgttgatcagggacagatgaggacggaagacctccaaagcatgcctgagagtcatgcattgacccatccagcgatcagaaccttccctgtacgttccaaactcacgggctgcgctcccaggacctcgcccatctgctgcaggcagctgggccccagcccctgcacaaccgccgaggcgccctccagctccccgcccgccccgacacggagcgagacgaggccccccagcccttgcgcggctgcctgggctgctcagagtggggtgcaaggagcgggtactgagtgtcccgttctgatcatgaatgcaacaggcgcgggagggagccgttcctctgaaacacggtgtcacccggtcacacaggatgctaccgcacagctgcgctcccttgcttccaaacaaagctgatgtcagcgtctcagcagcaccgacctgcaatgtcgcccttgcccttgagccgggagttggagatggcagagccgtggggcaccctcaggccctgcacgatgccaccctgcgccaccgcatccgcaaacagcctgcaggtggagggagtgaccaccgtttcaccggcggctggcggcggtgcagcagcccagcgcccaagtgcacccccctccccccagcacggaggaacccaccggaagtcggagcccctgaccgcctcggtcacatacgtcatttccagaccgaagcgcagatctggcttgtcgcagccgtaccgctccatggcctggctgtacgaaagacgagggaagggcgccgcaacttccacgcccagcaccgtggcaaagacccgtgccatgagtccctctgccagccctatgatggcctcctggtccatgaaggaggtctccaggtcgagctgggtaaactccggctgccggtcggagcgcaggtcctcgtcgcgaaagcagcgggccacctgcgagggggtggggggtggagggtatgctagcaggagaaatgaggtggggtggagggggctgcagcgggaccttgatacccctctgggacgcacaggattgctggagacaccatgtcacgttcctctcnnnnnnnnnngaactccggctgccgatcggagcgcaggtcctcgtcgcggaagcagcgggccacctgcgaggggttggggcgtggagggtatgattgcacgagaattgaggggggggggagggggctgcagcgtgaccttgacacccctctgggacgcacagggttgctggagacaccatgtcacgttcctctcctccgtaccctatggcctccctttggcaccccggcacactgcatgccctccagctgcgacgccacaccccacccgccacannnnnnnnnngagattcctccatcaccaagttgaaccgtctccacaaatccaagcggtcccagtccctgtacacctctgcgccgccgccccagcgtgcgccaccggctgcggcaccaatcccgccccttcttcnnnnnnnnnncgccaccatgagcatctgcttgtagagctgcggggactgcggcagcgcataccattccccgggttgcaccctggaggtggaccgagggaagcgcgattgcaagattcctccatcacagagttgaaccgttcccacgaatccaagcggtcccagtccctgtacgcctctgcgccgccgccccagcatgcgccatcggctgcggcaccaatcccgccccttcttcacccctccacctccttctcgcaccgggagggcacgatgaagtcgcgtgcgccctccggcgtgctccgccccaggatgggcgtctcgatctccaagaaaccgtgctcgtcctccaggtagcgcctcatgcaccgagtcagctcgtgccgcttgcgcaggttcagcgccatttgcgggcgtctgggtggaggaaagaaggaatgggggtttaggtcgaccgacggcggcgacccattgcggtgttggccctcggcccccttgcccgacgcacgcagggctccggcatgcctggagcaggccgagcccatccccgccccaccgagcctttgcccctcaccacccacacctgaggtccagcacccggtgnnnnnnnnnncaaggaatgggggcttaagtcgatcgacggcggcgacccattgcggtgttggccctcgacccccttgcccgacacacgcagggctccggcgcgcctggagcaggccgagtccatccccgccccaccgagcctctgcccctcgccacccacacctgaggtccagcacccggtgccggagcctgacctcgtctcgcagcgcgtcggcgccctctggagaacttgcagaaacggggatgggcaggccaccctggaccgggttcagcacctggatgctggagggctcggcctccaccgcgccgctgggcaggcccgggttggggtcgctacggcgccgcacccgggcccgtacgctgaccacggcctcggggcggaggcgggccgcgacgtcgtgcagggcgcggggcgagccggcgtcgacgaccacctggaccacgccggtgtggtcgcgcacgtccaggaaggtcatggcgcccaggttacgcaccctgtccacccagccgcacaggctcacggcctggtcgatgtcggcctcccgcagcatgcccgcctcgtgggtgcgggagggccaggtgagccgggggaggccggtggtgggaggcagtgccgcccgggtggagagcgaggacccacgccgggccaggctggggccagatggctggcagcgggcattccatgcacttggattcacgccagtgccccgcatcagccccaggctgcgctgcannnnnnnnnnaggagagcgaggacccacgccgggccaggccgggcccaaatggctggcagcgggcattccatgcacatgggtgcacaccattgccccgcatcagccccaggctgcgctgcaagccggacagcagcgtagtgccgggaggcatgggcacacccaccgcagctcaaatacactccgccacaggatcgcgagtcatgtattcattgcagtgcatcaaccgatatatgtcagcgggatagagtatcgtgatccacgcccggcatcctactcatgcatgcagggggtgaactcgaagtgatccgtcatgacgtgccatgctgcgcacagggaacacatcaggggcacgaggtctgtctcctatggccccaggatcttgtcagctgtacatgtcacctcttcaagcacatgaccatgcaagtgagaacgcccggcttctcttgccggcctgcatcgtctgcctctatcctcagacccctgcgataaagtgtgggactgagcgcgtgggcagtggtttgattttgatcatgccgcccttgcctctgctttgtattccctctgccccccttcccacagcatctcagtcatccacatggcttacgtgatgtatgactggttcatgacctccctcaggaaatggatgttcaggcccccatcgccatcgtcaaagagatactctagcaccttgatctggtaatggtttgcccagcagaatttggacaataccatgcttacaaacgcaacatgagatcgagctggattacagccgatgcttgttgctcatccaactcctatcttcccccccctccctctcccacctgtgtattggagagggtggtgcccaacacatgctgggtcacccacgctaggtctgcacccgtcaccctgcctgccacagtcctcgcaaactccagggcgatgacgagccgccgcagctgccgccagatgtgctggaaggcgaggaagtcagacttggtgaccgtctctgctgccaggtcgtctggcatgtcctccacctaaagaatgatgcagtgtgaaacttcatcgacagggttggacaggggtcctggggccagcagctggggatcagcagggatatcacacaggccctgcagtgcatgcccggcccttggtccnnnnnnnnnnnnnnnnnnnnnnnnnnnnnnnnnnnnnnnnnnnnnnnnnnnnnnnnnnnnnnnnnnnnnnnnngagtcttgtggccccaatcacagagtatgcaaagtcctgagcggccataaccccctgttcatgcaggcatggaataaggtaaggttgtgcagagccaatttgtcgaggtcagcgacgccaatgagcagcgctnnnnnnnnnnacttgaagcacatcctcagccaactcattcagggaggaaaccgaggcacaccttgtccaggtactggtccaggtgcttnnnnnnnnnntctcgaagcacatcctcagccaactcatgcagggaggaaatcgaggcgcaccttgtccaggtactggtccaggtgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggtgaggttgtgcagagccgatttatcgaggtcagcgacgccaatgagcagcgctggcgggggaagtatcagaagctcgcaggtacaggccatgcattgaactgccacgcagtgccctgatgacattatcccttcaaccccgctaccttggagtctacgtcgtaaaaggcaaactccatggccatcacttcatccctggtggggagggcggcaggtctccagcagtgagccggccgcagttgggtctggtcatccgattgcaaagcatgcacatccccctgctgcctcatggcaggcacgatgaggggtgcacacccaggacccaggcgtgggatccccgggaccaactcccctcaccgcagtgagttgacaaattgcgcaaagcgtgccagtgtcaggctcccaccccgcgcccccgtgatggactccatgagcgcctccgcattccgcctgtgccatggcaggttgggcccctgtggtgctaatattctttgtgcgcgatgatgagcaccaaagcggtatacacacacacacatcctccctctatgctctatacatccatcgcgctgtgctgccgccacttccatggatacctgctggtgtcaccgacgggcgggttgcctgtgtgaggtagtatctnnnnnnnnnncgtgctgccgccactaacatggatacctgctggtgtcaccggcgggcgggttgcctgtgtgaggtagtatcttgcagtacctcttccggagcgagaccaggagtgcttcaagttccagcacctcgatggatcccgagtggtttgcatccaccatgtggaaggccactggaggggggaagggggtggagaggagggagaaggctttctcagtcctcgctctgagtgagcagcaagctgacgcagcaaagacgaggcaggcgtggctcagatgcaacccaggcgctgctctaccttggatgtcctctgtgggaatggagagcagtgccaggaacagcagccactcctcatagtctatcctcccatcccggtccatgtccagggcaaggaatgcggaccccttggggcaggccgctgcctgttggttaggacaagcagaggatagacggtaacaaaataaacgaggcccagccgaggtatagtgccagcttggtgacaggtaaagatctggattcacagcggtcactccaaatgccttgccctgctgtcttcatgcttccccacctctttcatttccgggctgggttcgccccacaggctgccggcccggagcactgccgatttcgatgggggaaacacaggcacaacgctccgcatgacatcctgggcggtcatccaggcagctggtccgtggcgctgcgagggatgatcaggccacttatatgtgtgaggactggccggcacacgatcagcagctgcaccgggagtggccctcaggaacaccctccctacctgggaggcaaagnnnnnnnnnnagtcaggccactcatatgtgtgaggactggctggcacacgatcagcagctgcaccaggagtggcccttaggaacaccctccctacctgggaggcaaagtattcgaagaccttgtggggaggactcaggtccctgatcttcctctcatacctgagggcgggaaatgttgaaaaaatcacctcatcagcctgtgcctgtggatgccgtggattgtagtgtgcttactcaacccgccccacccccacccttggacccacttgaagaacacctttcgccgctgctccagcgtgaggagactccatccctgcagggatggaaacaggtcgctctgatacatcacatcatgttatgggcggtctcaaagcaatccgtggcgagatggcgccggtgcatcaccttgttctccttagatactggtttgggagcctcggctactgcagtgcatgtgcctccagcgatgctggccacggccgctgatgccagaacccatccgtagcgaggtaaatctcttgaccgtgaggtgccatcagctagctggggcgtcagtgcagagacttgtttcagtaggtgccgcagaaagtgatctctaggtcggacccgagttccccacatcatgcagaacgacagcagcgccggaattatgggtctttattcacatgaatgccgcgttgcagcatcgaacggaatttctagacagcattgaggttggtcttcatatcggatcatgaagtgtctgtcgcgcgcgctgcgagcccacccaagcaatgtcacaggcccggagatgggctgctgagatcatgcggggctacgaaatctactatatttcatgccagatattcggaatatatggcgatggggcttttggaaccagtcaaagcacacgttcttccggacatgtcctcccacagactttcggatgcagccgaatagagaggcctctcatccaatgcatgatcagaaattattccaaaaatcaacttgtaatgtgctgtgatgtacccggcatcgccatacaggttcccggcgcacaagacctgggactttgccttagagagtggctagccttctcgtcccgtcaccaacaaacggaacgaagcgccttccatgcttccgagtgaaagtggccactccagctctgagacagactcaaagcatcttcacaatgtgctatcgggaacagattcgtcttctgcacttcccacaagcccccacctctggcacagaggtgacagcgatgatgccagccatgcgtttgaggagctgaagcatacacatgccctcctgagcgagcacgttggcaggattcaggtcgcagaacgggcccagcatgcagagaccatacgggcgcatcaagaccagctcgctgctttggctcagcaggtccagcgcggggccatcctttcatcnnnnnnnnnnattggcaggattcaggttgcagagcgggcccagcatgcagagaccatacgggagcatcaagaccagctcgctgctttggttcggcaggtccagcgcggggccatcctttcatcgggcaccagggaggacgcacaagcattgagggctcagctcgcccaggtacaatttcctaggcatgggcctggaggcagtccaactcctgagcagcaaattgcactcggctggccttagtgnnnnnnnnnntgcacaagcactgagggctcagctcgcccaggtacaactgccaaggcatggggcctggaggcagcccaactcctgtgcagcaaattgcactcggctggccttagtgattgaagccctcatcctcctcactttccatcaggtccaagccacctacagcagcatcagggatgagaaggcagccgcacagcaatccctggaccggtggaggcaggagcaggttaccgcagaatcagccaggagagaatgctgggctcagctctgcggagcgcagtccctgctggagactgcggatggggaagcccggacttgcaaagagaccatgtgtgtggtgcggtggctgtgtcagaatgtgcaacaatatccttggggtggggaggaattcaaggtcagcctgcccaacgcaggtcctgcactgtcgagttccaggagtttgacagacgaagcctcaaccccgatctcctctccaccactgctccaggcatgcgctgcagcacagagctgctgctgtgcaggagcagctgctggacgcacgctcagaaggcaggaagcggggcgcggacctgctgcaggctgcgcagggagaggcagggcttcgcgcccagctggctgaggcgggggcggcaggtgataaaatccgatcgtccccggtcacagcgtggcagctgcgaggggccaccgcggagggtcggacgctcaatggtaagctggagatgcagcgggtcagggagctgacctgcctgcgccgccaccgtgcagtgaagggcgagcagggcaggatccaggtgaacatggggccgggcagagggatttgcgctgagttgggcttctcaacattggcgtgccgtggaggacagtaagtcgaagaccctacatagcgcactgagcatgaagaggttcctaccgcggaagtgttgtcgctcgatgttcaacacttggcatcatggtcctcgccaacattcccccaggcagggctgaagagtctgggccagcaaagggtagctgcactggccgcgctgcgtttgatctgcggcgcgaggcgcacaggtcgtgccgggcgtcaggcgctcgaggatgctgccaccatccatcggctcgcagcggagacacaggccgcctgggcagaggtgagtctcgagcaccctgtggcgcactgctgaagccattggtcagggcattttgcgaaggtttttaggcctgggctgcctcaaggatggttggtggacgctccttcatattttcatctgtgaagagggtgctggagccactcgtctcatcacacaacttcaacacaggcacaccaactggcaaagctcggctcccacgggcgctgtcagggtctgggtcccgaatgggacaccctgtcggtgatgggcgcaggtctggcggctggcnnnnnnnnnncaaacacaggcacaccgtctggcaaagctcggctcccacaagcactgtcaggatctgggttccgaatgggacaccctatcggtgataggcgcaggtctggcggctggcaccgccgctctacgtctgctgggtgggtctgggaagcagtatgtgctgactgggcgtcgaacagaggctcaaggagtgggaatgctcacatctctcaacaaagagcctcgccaaaacagcgcttccacggaaacacccgcagagaacaagcggaatgagatggtgtgccgccgcgatgctnnnnnnnnnngcaacagcacttccacggaaacacccgcagagaacaaacggaatgagatggtgtgccgccgcgatgctgtcatggcgcacgctgcctccctctccacgctgggtgcagctgccacagcacaaagggaggccttgcggctgcagctggcacaggcatgtgggctctgagagcaggggtgtactggtgctgcgctgccacacaaacaggcacctctagctcacccgcggcgcatcttaccgtccctcatgccagctcaggtgagggcctggagagacatggcattgcgcaacgcagaggagactgggacagccagccaggcgctgctggaaaggatccaggtgtgtgcggctgggatgccaggtggcgccccaccgtcgggtctggagcctgccgaggaacggcacgtgctacagcacgaagcagtgctaccttgcatgcaacgaaagggatcggttttcatatccccatcgccatggccggccacccacgcgccgtccatgcacaggacagctgccaggctgccctgcgcatgggcgaacagcttggcaacaggcgccaggccctgaatgaggcagaggctcggggtgcacagacgcacgctgaggcacggcgggtccaggccgacatcctggcggctgcggtggctggggatgccgcggtgcatgagacgctgacagtgcacaaggcactccaggcgcagcaggtgcgatgccaccctgggtgcaggggtgcggatgcggctgggttggctgaaggacggtggcatctatgtgcccaaccccttgacactgttgcacacggacgcctgaggtcagccaggccctgcgtcgtcgtgcactgtgctcacatcctgcgacattgtcgccaccccaaatactcaccgcaggacgcgctcgacatggtccttactcagcttcacgcggcatcgcagcgtgcagaccgcgaggatgcgaggacagcagccctgcggacccgactgcaggcgcaggatgcatggccgagccagtgggccgccggcattcgaagcggcgctgaggcggcagagtcggccgagaagtggctccggcatctggaaaccatcgtgctgcatggtgcgctgcgataacaaattggtcaagtgggggcaaatggcaacaatggaggcaggactctgctgtgtcagagagaggacacctggggccttgctctcaatccagagcacatcacattgggcattcacgtccgggatttgaaatccagtcctgtaccctcacccaggactggaaaggcttcagcgcttggaacgccaccttgccgcgctgcggtgcctgggaggaaaccacgagagaggcttggaggnnnnnnnnnnttcaggactggcaaggcttcagcgcttggaacgccaccttgctgcgctgcggtgcctgggaggaaaccatgagagaggcttggaggttgagcgtgggaagctcagccgggcctcgcgggatctggacgaggtggggtccttgactcctgtcgagctgcagaatggcggcccgctggcaggggtggtggtgggtttggcccgggtgcatgcaggtggatcactgtcaggctaagctgaagtctgagtccctgtggattttgggacaggccctagggcagcacaggaccgctgcatgccaaggccttcaggaacgcccatggaagctaccgtccatgcaggggtgagggggtctgcgacgagggacggatcggcggtgccagaaagtatgcttctgtcacgggcatcgcgtgtagcctgttgaaacgtgctcaccgcgccgtgcagagtgcgctccgttgggggatcttcggcgcctgcaccagatctcgagcggcaggcggcggacttgaaggcacggctgactggtgctgaggtggcggnnnnnnnnnncggaggatcttcggtgcctgcaccggatctcgagcggcaggcggcagacttggaggcacggctgactggtgctgaggtggcgggcagcagagtgagtcgggttgccgtggttacgagttgaatgcactgccatcccactgcaacccaggccaagagtgcccagcaagcgcagcgtgctgcactcccttgcaagtcgtgccggaggcagctggtcccgagtctttgctcattcctcaaatgccatcccttcttcagctgacggcacggctggaggatgtgtcggccaaggtcaaggcactggaggcctaccagggagctcggtcagggcagcaggtgaggaggcaatgtccctgatcatgtcaaaccgcttccactgtcacctgctgtggcttccctgaggacttgtactgagttgccccagcaagtcagcttctctcctctactgccgtgacagtgtaaagcggcgcgcaggccgcgaatcgatctggatgcccagctgagnnnnnnnnnncgtggcttccctgagaattcgtactgagttcccccagcaagtcagcttctctcctctgctgccgtgacagtgtaaagcggcgcgcaagccgcgaatcgatctggatgcccagctgaggactgccaagtcaagcctggtccaggctcaggtggcaagaggtagcttgttgccatggctgctggtgttggacgttgcaagggtgtcttggaccgaacggcgtatgtgccttggctactcctgtgagcacgagtgccaaccgtcctgcccaggctcacacgttctgtgcactcagtaacagccttgtatcacgcagcttcaagcatcgcagcttgctcaggacatcgacctgctgcgggaggcactgnnnnnnnnnncaacggcctcttgtatcacgcagcttaaagcatcgcagcttgcccaggacatcgacctgctgcgggaggcactgagtgcggccctgtcagtgcaagcacgccctgaattgccctcggcatcttcatgcacacctgtgcccacaaggccaaccgatgagaaggtgcgcactggggctgcttatggtaatctacggagtgttcttgggtacatcggttgggttgcctggtcaaggatgcttgtaaagcttgctgcctccatcggccttgcccagctgtggcgtcctcatcaaccagtgctggggcctgattaggttggggacaccggcctacaccaccaacccattgagtgattttcatgttcaaagcattgcaggatcaggtgtctccggagcttaaacggccgggcnnnnnnnnnngctggcctccaccatcaacccatcgagtgtttttcatgttcaaatcattgcaggtgcaggtgtctccggagcttaaacggccgggcaacatcctggatatgactgggctcccccactcgggatctgaagggagcggcgctggcctggctgtctgcatgcccacactccgcgcaacccttgtgccatatggcagtcgttcgaggactcggaagtcatgatccgcttgcttgctgtacagccgttttggtgtgacagagcagcgtcaaggggcacagtgcaggcctgcccctgcgtcagggcaaggnnnnnnnnnntgcaacccttgtgccatatggtattcgttcgaggactcggaagtcatgatcctcttgcttgctgtacagccgttttgatgtgacagagcagcgtcaaggggcactgtgcaggcctgcccctgcgtcagggcaagggaccagtcggtagactgcgcccgcgctttcttcccaggtcaacgcagcttgcaaactctcgatcggccagaccgcggtcacgcagtcttcgattaacattgcgctgtggaacttgcttgatagaagcacctcgggacctgcgtgtgggcgtcggatcgtgggaggctcaggagctcgtgnnnnnnnnnncaacattgcgctgtggaacttgattgatagaagcacctctggacctgcgtgtgggtgtcggatcgtgggaggctcaggagctcgtggccccgggagtccgccatgtcgacctacgtcggcaacaagtttggccagccggacactgacaagctggtgagggtgtgcctgatgggcagtgcagcattataatatgatttcaggagcagagacgggccttctgtctccctgccgcagaaagagtttgaaaagcggacggaccccaacgacaagaatgctcaggccctactggaggagatgcggcagcacatcaagaaggtgagccgcctcccacacccagggccctctgtctagcagatctgccgtgtttccatcggagagctgccccatctcagctgaccccccaaccccacctcgtgctgcagttggaggacatgaggaagaacgaggaccccaggctgtccttctccacgccggagttcaaggaggcacagcggattttcacggacggcttcaaggtgagaacgccagctcgtgttgggaggtgtctgaagcgaagcagagctgggggcctggcgagtcgctgccagcctctcgtgtcgtggagcgctccctgtcaattggttatctttagcatgcatctcaacacagcagcacaatagaattctcctgacaccctcccactcccccttctgccctcctcacacaccgtccatcctcccataattttcagaaaaactttggcaagccagtggaatgggcccttgtcaaggattatgcctggtccacgccccagctccgcaagctggacaaacctgtgagatggaatctggtctgacacatggcccgacatggcagccttgtcccgagcgatgcagcactagcctgcagaggacctgccctccatccctccaaccgtactgccaaccacccatgcccacctttctacgcaggtggatgtcgacggcaatccctggcnnnnnnnnnngtgccaaggccccatgctcacctttctgcgcaggtggatgtcgacggcaatccctggccactggaccccagcggcaaccccatcctgaagtaggctcgacccggtccagggtcgtatgggaggcggttgctgctgattggtggctccagtcggtcttgttggccggcttgtcacccgaaccccacggcggccagtcgcaagggcctggcctagggcgggagttggcatcaccatgtcttgcccaacactgcccnnnnnnnnnntgacccggtccagggccgtatgggaggcggtgctgatgattggtggctccagtcggtcttgttggccggcttgtcacccgacccccacggcggccaggcgcaagggtctggcctagggcgggagtcggcatcaccatgtcttgcccaacactgcccccgtgtcgtggttcagtcttgtacaggatgtattgattcgaccatacaaaggaatcataccagggacaagcaaagggcgtgtttgcagctggagtaatcgcccagaagcatgtgcatgtgtcacagccctcacgacgctgagtccaagccctcaactacgactttacctnnnnnnnnnngaatcgcccagaagcatgtgcatctgtcacagccctcacgacgctcgagtccaagccctcaactacgactttacctgcagaggtcagcgtgcgaccctgctcgctatgcgcagtggcaagccaccgcagacagcaaaccannnnnnnnnnaatgcgaccctgctcgccatgcacagtggcaagccaccgcagacagcaaaccagcccccctttggtcctgcctgcctcctcagggtgcagcactatctacagacaggtctcctcgtctgacacagggggctgcattcttcgagagagacagattccactgggattcttgttgcatggtgtggtgatattatagatgtgcagggtgccgtggctccgttctgggaccgtgcagcgcacggtgccgagggccagaagcgctagaatggtgaaccagtggacctagtgaggttgcttgagggcctgcaaccctgggtgacatttgcactcaatggnnnnnnnnnngtatagatgtgcggggtgccgtggctccattctgggaccgtgcggcgcgcggtgccaggggcctgaagcgctagaatggtgaaccaatggacctagtgaggttgcttgagggccagcaaccctgggtgacatttgcactcaatggtcgggtcaaaaaaagaaagggatgggggcgctctcccaggtggaaggctcacccaaaattgcccgcctgtgcgccccgatggacagacccaggggaggggtgtccagtggggctgcagagggctgtgcttggagaagggatgaggtgaaaaacccgtcatgggacaggtcaagggatggtagagttaacaaggaggggagagatcccttttaattaaatgggtgcatgcttgtgcagcagaaaatnnnnnnnnnntgctctcccgggtggaaggctcacccaaaattgcccgcatgcgcgccccaatggacagacccaggggaggggtgtccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatgggagagagggtctccggggtcaggcgagcaggctaggtgggggcaaaagaatggcttctttctctcagtgattccggcgtgatcatgactggggcggggaggcagcaacagcgctggcagcggcggcggcggggtacgaggtggttgtcccttgaccttcagggcccgcagccggcacagactcctccagggttaggtgttcgaggtccaggtcggtgcgtttcnnnnnnnnnngacagcgctggcagcggcggcagcgggggacgcggtggttgtcccttgaccttctgggcccgcagccggcacagactcctccagagtcaggtgttcgaggtccaggtcggtgcgtttcacaaatctccccttcacacgctggagggggcaagagtggggaaggttgagtcggcttgccttggtcacagcagcatcgactctcgcgagcgtgcctgtgcgtttcgcgcaggccgccctcacacaggcccacgcttaagccccgactggacggacatgcagcaggccaccgcacatgttgcatccatccnnnnnnnnnngattggctctcgcaagcgtgcctgtgcgttttttcgcacaggccgccctcgcacaagcccaggctgaagccccgactggacggacatggagcaggccaccgcacatgttgcatccatccnnnnnnnnnntatggttgaaacaatgaaaccgtagatcgtcatggacaggcaagtggcctactctgcgccctgtttactcctggagggaagnnnnnnnnnnactcctcaccagtcttttatccgcattggcacggcgagcgtcgtggcgggccctgcggccggcaggggccgctctggcacgagatcttccggatcccttgttggatttgttcgagttctttgccattatgggtttgattttccctggaggatgggggaggccgtgagcatggttgaaacaatgaaaacgtagattgtcatggacaggcaagtggcctgctctgcgccctgtttactcctggagggaagcctcgattggtctggcacagaaccaagaccactgtatgcaaggatctgacacattctcatgtccaacccacaaacaagcacctgccatgctgaggtgagagcagccgccgtcactgtgagagaagcttgtgttcctgacggacaactgggataggagtggcaggtccatgccagggggcgccgaggcagaggaggagagcacatcgcagcggatgctgccgatccccgacgcctgccacatcctgcgatggccagcaagttgaattgtacgttggactgctgccttgccgtctgctccccggagcaagctgtaatccttgatggagtgtaataattctctcaacagacacgattcaagctcggatcactgcaggctcccgtccgcaccccaggtcctacatcaagccctgnnnnnnnnnnaccccggagcaagctgtaaacctcgatggagtgcaataattctctcaacagacacgatgcaagctcggatcactgcaggctcccatccgcaccccaggtcctacatcaagccctgcagacagtcaaaccccacctcaggacttgatccttgtcgagttgtagtcccagagggctcacagggacctgggaatcactgcaggttgactgcaatgcagaatcgtgaggtgcacgaaggtcagacggagcagtggtgttaccctgacacagcgctgttgctcaagacacggcgcagcaacgcaggccctgacactcaattgcagatgatcaaaggcgaagcaatcgtttgtaatctcaccttgtcaaagtgagatgcaaatttgcgcagttcggcttccagagagaaaatcctgtagacaccgagaaacgaggggaacgaagcagcttcatgagcgataggacccgacacattgcacgacagcaatctctcggcagggccagcgtgtgtgagtgtgcatacctgtgctccagtccttttgctgaggatgtgggttcttcaggtgtcagctggctctgcggggtgggccaagcgggggggggggagcggcggtgagcgatccaagccgacacctggaaccccgggcaaacctcgtagcaatcacctcgcgcaccccttccctttgtttacctctggctccacatcgagcacggtgggtgcgctgctggataaagcgagcccgtcggcgtcggaggacaggcctcccatatctgcatgggagatacgggttgggatgtgagacgtgacgcccgaccgccactcgacagattctcgacgcacaggagcgctcctgaacgcgtcacattggcctccagaccttccattatgctctcatgaggccatctcaccgtcgaagaagagccaatcatcgctctgctcatcgaagggcgtcgtcgcttcatggcgaccgacgccagcgggatgcatcgcttggcccgagcgggaacaggttgatccagcaaagcaaccgggatgcacttcgaggcaggccatcgacaaaactggttgtgtgagacctggtccgagacccgcatgggctcgcctagacgtggtggggtcgtgtggtgcatgtatggcaaatttcatttgtccccggacggggtgccgcaccgctggcaacccacgggtgctggggcgcaacacccctcagcacgcagtcccctcccccgatccccgatcctctggacctcctcataagcctggccgatagccggagttgggagagtctcgtgtacggtacaaagggatcaccatggcggctcgtttgtttgaaatcacggaggaagactccttcctggtggtcgcgacgtacctcggcgagctgctcgatggtggcgaggtgcgcgactgtgccggtccgagggtgcacatccaaacgatcccatgatgctgccgggacccaggattggtatgcaatccgtgtcctcgctccttacacctccgcaggcgcccgcaggggagcaggcagagaccccaggctctcgctttgcaacagagagcagggagctgtacaccagcgaccgcacggcggagctgctggacaagtacgtatctcagctagacaccgtgtttgccagcgctggggaggacacaggtgcgggtggtgtgaagtgggggtgggggagctcgtcgactgtggggcatgcacaacctgcccctgctcccgcgcaccactggcgactgtcccacccctggcacttctcccctccctccaccaggcaatctcgagagcgtgctggacatcctgtgccacctggtcccacgcaccgccctgtccagcccccagcaagtcctgcccgcagccaccaagctggccgccgccctcgcagcagacgtgcgtgggcgggaggatggacgtggggccagagggcggcgagggtgatgcaccccatacctgcaccgctgcctctaaccccgggcccctgtgctgacccatttctccttccttccctccccatnnnnnnnnnngagtgggggtggggcagctcgtcgaccgtggggcttgcacaacctgccccctgctcccgtacaccactggcgcccgtcccacccctggcacttctcccctccctcnnnnnnnnnnccaaacgtaccacagggtggcagccacgtgcaggtgcggctgcaggccctgaccacgctgtacaacgtgctggagtcgggggaggcgcggcacgcagtcctgctgcgcacgctgggcttcgctcgcaccacaggctccgccgacgcgctgctgccggtgatccgcgcctccgccgcctcctgggcccgcgacctcggtctggaccgggcgagggagcgggagctgctgtcagccgcggccgatgcgctggaaggcccctcctccacgccgcgggaaagcgcggcggaggtgcagcgcctgctggcccgcatcctggccagctacgagggcgtggccggcaaggagctggccgggggtaggcccgtcgccgcgcgcgtcgtcgccgacttcctgcgctccggcgaggccttcacctttgacctgctgggcaacccggcggtggcctcgctggccgccgcctccgacaccgcccccctgcacttcctgctcaagaccatgctggtgggcggcgttcgtgacttccgtgccacgctggccgagtacccggacctcctgccctccctgggcatcgcgccggaggccgcactggccaagatgcaggtcatggcccttgcggggctggcccacgtcaaccccgtcctcacctttgagcaaatacaggtgggtcctgtgtgttttctttttgtgtgtgggtggggagagggggctgggggtggaggaagaggaggctggggnnnnnnnnnntgtcctcacctttgagcaaatacaggtaggacccgtgtgttatctttgtgtgtgtgggggggaagaggaggctgggggtggaggaggaagaggaggctggggcgggaggaagaggaggctgggacggaaggagaggctggaggggatgcagaagccccagcggttgtgtgctgtatgcaggggacccccccagttcccccccaagagcgtccacccacccacccacc

SEQ ID NO: 33713 - DNA, 92 bp, Chlorella protothecoides
caaagaactcaacaccttccaatgtgctggctcatatgattcaatacaatgcccatgtcagcacatcgtgacgccctgcattttcagaacag

SEQ ID NO: 33714 - DNA, 119 bp, Chlorella protothecoides
gcctcgccgtcgagcactgcgggcaggtcttcggcaccggtgctgggtctctcgccgaactgcggctccgctccatttccgtcgtcagattcctgcaggactcccctggcctcgggccc

SEQ ID NO: 33715 - DNA, 77 bp, Chlorella protothecoides
gtgaggcctgtggtgggagagggtgggtgtattacccaggaagatcagggatgggtggccaaaatcctgggagccag

SEQ ID NO: 33716 - DNA, 132 bp, Chlorella protothecoides
ggtgtgctccttgggatcctgtgccggcccaagtgggcgagatgaagaatctgttgcggtcttgtaccacccgctgcgaagcacctctgcgtccctgttcacccctcttgttcgccctggcttgtgcgtcat

SEQ ID NO: 33717 - DNA, 62 bp, Chlorella protothecoides
cttgctctccagcaccttccaccttgcttgcccccccaggccgctcatggcaactggcaaga

SEQ ID NO: 33718 - DNA, 79 bp, Chlorella protothecoides
gagggctggatggcgtgggtgtgagctcgagggagcgatggacggaaccgtctggcgcagtgctttccgcagcgcctgt

SEQ ID NO: 33719 - DNA, 76 bp, Chlorella protothecoides
cccgccaagtcaatccaagcttccctctactgtttgggtgaagagtctgaactgcttgagacaggcttgacaagct

SEQ ID NO: 33720 - DNA, 77 bp, Chlorella protothecoides
ccgcggtcccctcctccggcgtaaggatcactctagttctgccccttccccgctttccactctcaccagaccaatgc

SEQ ID NO: 33721 - DNA, 61 bp, Chlorella protothecoides
cctcgtactggcgacaatgcgataatcttagtatcatatgacagacttcagagatactgct

SEQ ID NO: 33722 - DNA, 117 bp, Chlorella protothecoides
gtgggatcaagaatcaggatgttgatcgagactctggcaagcggatgcccagacaccaatcctgctccaaaacggcttgacacaccagcccaccacacacctctgcagggaggcagc

SEQ ID NO: 33723 - DNA, 235 bp, Chlorella protothecoides
atccggggctcgccgcgcagcgcctggcaggcccgacatgcgagtcgtcgtcatgggcatcccctccgggggatcggcgtggacattccccgtccatcccgcgtggggcacgaagaaccccccccccctattcatcgacgtattcaaaatcacactggtttgcgccgtgcatcacgcatatccatgcgcgcatgccaccccatgcacccgcaccgtgtgtcctgtggcgtggtct

SEQ ID NO: 33724 - DNA, 343 bp, Chlorella protothecoides
tgagctccacctccctcttccaaaaacacccccccccccaacacacccacccacctggacaacatccgacgcacttgcaggtggagacccagctgcgggaggtgagcgcgtcgttcgcccggctcaacggcatggccggcgcccatgcgctggacctgtacggccgcaccacggctgacgagggcgcggcccctgcgcggcgcaccgacctggtccgccgcgccagcaagcgcgtgccgctgtccagcgtgcagcaggccgcggtgcgcgcggcgcagtcgcgatccgcagccgtctccttctcggccggccaccgccggtcgctggaggggctgccggacct

SEQ ID NO: 33725 - DNA, 61 bp, Chlorella protothecoides
tggcccacccactcggagtcacggcgggcccagtagtcattcaccgtcactacgtgcacac

SEQ ID NO: 33726 - DNA, 61 bp, Chlorella protothecoides
atggcgccgacctggtccgctggtgaggggtctgttggggtcgtgtgtcaacgtgagggca

SEQ ID NO: 33727 - DNA, 61 bp, Chlorella protothecoides
cctcgccatggatgaggcggagagtgctgggtcaggcgaacaaccatcgctgcgccttgga

SEQ ID NO: 33728 - DNA, 68 bp, Chlorella protothecoides
gcacgatcatcgcagcagcagcaaggagcctttcacacttgtaatgcacatacctccgtgtcccatag

SEQ ID NO: 33729 - DNA, 77 bp, Chlorella protothecoides
gcccgcctgctccctcaggtgacagcggatggttgtaatggatgtaagccatggttcctcagggcggatggtcacct

SEQ ID NO: 33730 - DNA, 1524 bp, Chlorella protothecoides
  modified_base (127)..(136): a, c, t, g, unknown or other
  modified_base (385)..(394): a, c, t, g, unknown or other
  modified_base (831)..(840): a, c, t, g, unknown or other
gtggacgacgaggtggtgaggatggtttccagactcttcctgctctccgacgctgctgccctgatcgaccatgcccgcaccgtctggggaggcgttgcgccgaggtccagcgccgccagctcgtcgnnnnnnnnnncgactcttcctgctctccggcgctgctgccctggtcgaccatgcgcgcaccgtctggggaggcgtggcgccgaggtccagcgccgccagctcgtcggcaatccaggtcacacgcggctcggccgcgttctggaagtagaagctggtggcgtcctgcacctcggtcaccaccacctccagcgtctcaccctgtgcaagttttcaggggggaggtttgggaaggtgtgagaggtggagtagggaggcaggnnnnnnnnnngccctgtgcaagtttttggggggaggtttggcaaggtgtgagaggtggagtagggaggcagggaggtgtatggaagacctggggtgctgggctgtacggccgtttgtattcctgatgttgaaagctcgtcgacccaaccctccagtggacgggatctggagcagtccaagcttccgatgcacaatggccacgagagtgctctgctgggcttcctgtgcacgacccaccaccactttctcgggcagaacgacattgtgccacgaaaacgcagcgcaccatcatgtcggtccctgcgtgaatcctgccccgctcctgtccggccacgagattctccctcccctccccagatcccccggccccaccctcgtacacacccatccacccaccctcgcccacctgcccccctgcgccagcctcgtcggcctccgccgcccccnnnnnnnnnngcatgccacgtaaacgcagcaccccatcatgtcggtccctgcgtcaatcctcccccgctcctgcccagcaacgagattctccctcccctctccagatccctcgcccccaccctcatacacacacacacacacaccctcgcccacctgcccccccgcgccagcctcgtcggcctccgccgcccccgcgacgggtgcctcgtacttctcccagaccttgagcttcttggagcgcgcggcctcctcggcggcggccagctccgggtggcgcgaggcgtcgaagctggggtgcagcttggccaggccggcggccagcagcgcggcgcccaggtccagcttgcccgccggcacgtgcagcgtgcccaggaaggtgccgatgcggtccacgccctccacctccagcacgacatcgcgctggagcacgcggtcgcgcacgaacgccagggcctcggcccagtagggctcctccggcaccgcggcgcggcccgccgaggcggcctgcccgcgcgccgggcagcgcacgccgctggggctgaaggccagggtcacgccctccttggccacgctgaccttcagccggttggccgacagcacgtgctccaccacgccgcgcaccttgcccgcgcgctggaggaagggcaggtgcgcgcgcgcgcgctgcgcggcgccgggggccgacaggtcgtt

SEQ ID NO: 33731 - DNA, 74 bp, Chlorella protothecoides
gcagctttgcctggagaagaattggggggggaagtgaaggtgccggccagggtgtgcttcatacacttcttggc

SEQ ID NO: 33732 - DNA, 178 bp, Chlorella protothecoides
aagttgaggttgcacagggttggaatgccttgcacaagacatctgcaactttgggcacatggtgaggaccaacggcgaagacttcagtgatcgagatgcatgcagaccacggaccagacggactcagctactctcattcctgtacacacaccctcgctccagcatcctcatggggctg

SEQ ID NO: 33733 - DNA, 298 bp, Chlorella protothecoides
tggtggagactccgtcggcggaggtggtggagacttcattggcggagggggtggggattctgtgggcggagggggtgaagacttcatcggtgaaggaggcggtggcaacatgaatggagggggggtggactcagtaggcggagggctgagagacttcttgggtggaggaggtggtgattcggtgggcggagggggtgggaactcagtcgatgaaaaatatggcgacatcagtggtgggatctgttcgtgtgaggtaggtattggctttctcaatggagaggaaggtgcctgctgtgcc

SEQ ID NO: 33734 - DNA, 61 bp, Chlorella protothecoides
ccacctccgccgacggagtcgccaccaccttcgccgacggagtctccaccaccttccccaa

SEQ ID NO: 33735 - DNA, 62 bp, Chlorella protothecoides
tcggtgggcatccatgcaaggcgcatggcaacccctttacccccccaacccctttgcaccat

SEQ ID NO: 33736 - DNA, 12287 bp, Chlorella protothecoides
  modified_base (418)..(427): a, c, t, g, unknown or other
  modified_base (884)..(893): a, c, t, g, unknown or other
  modified_base (1329)..(1338): a, c, t, g, unknown or other
  modified_base (2538)..(2547): a, c, t, g, unknown or other
  modified_base (3122)..(3131): a, c, t, g, unknown or other
  modified_base (3560)..(3569): a, c, t, g, unknown or other
  modified_base (4493)..(4502): a, c, t, g, unknown or other
  modified_base (4602)..(4611): a, c, t, g, unknown or other
  modified_base (4768)..(4777): a, c, t, g, unknown or other
  modified_base (6422)..(6431): a, c, t, g, unknown or other
  modified_base (7043)..(7052): a, c, t, g, unknown or other
  modified_base (8223)..(8232): a, c, t, g, unknown or other
  modified_base (9812)..(9884): a, c, t, g, unknown or other
  modified_base (11282)..(11291): a, c, t, g, unknown or other
gccgcggagaaggagcgcggtggggcccgcgggcgcgccgagccggaccccgggtcgccgggtgcgggccgggtggcggagctggccgcagagctgaagggcctgcgggcggtgcaggccagccgcgacgccatggtggccgagtgggctgccgaggccgcgcggtcatgcgccctggcgcagcaggccgccgccgagcacgctttgatcctggagcggctggagacgcgcgaggccgagctggcggaagccagacggcggctgaccgaggctgccgaggcgcagggtgccgcagcgtctggtggtgtggggccggggtcgggcgttgctgagccgatcggcgacaacaacgcatctggtgttgagggcggcgatgcggagctcaggctggccgctgcgctggcagccctggaggagnnnnnnnnnnaaccggcgacaacaacgcatctggagtcgagggcggcgatgcggagctcagactggccgctgcgctggcagccctggaggagacggaggaggaggtggatgcgcaggcggccctgatcgcccggctccaggcggaggccgtggaggccgcggagaggttggcctccgtccagaggtgggcgcggtgtagtccccgggggcctgggcgtggtgtggccgggtggtggatgtggctgccgatgtatgaggagagggagggaggtggaggaaggtgaagaaagaggacactggtggtgtcagagaagcatcacatggggtttaaagcacaggccccctcggccgacagtctttgcgcatgagaccggggtgtttgcggtgacatcaggaccaagtacctgatcctgatcagaaggccagcaggcattgcacattcaccgcaactcagcccgccctcatcnnnnnnnnnntcctcggccaacagtctttgcgcatgaggccggggtgtttgcggtggcatcaggaccaagtacctgatcctgaccagaaggccagcagccattgtacattcaccgcaactcagcccgccctcatctccctcgcccagttctgctgcggctgatgtggaggccggcaacgagctgctggcggccgctgaagccgccctccaatccatgggcacccgcctgcgggctctggaagagggcagggcagagggtgatgcgggggcagaggccgggctcagggccgagctggcgtttttccaggccgagctggaagccgaaatgaaggtggggcccacgatgtctcggtgccatttcaggggccagggggagaggaccgggcccccagatgcatcgcatgtgtgcatcttcatggcgtcctggcagctgtgacatgctggcnnnnnnnnnntgaggaccagggccccagatgcattgcatgtgtgcatttttatggcgtcctggcagctgtgacatgctggctttggactcaccgacccataagatatctcgcctccacgatccagttttgcgagcaggcggcacagcgagccgctgcggctgaagcggaggtggagcgcctgaggaaagaggtgggtggttgcggtggtggctggctggcatggagattgatcagcagtggaaattgtgtccaacaaagcagaccaggccatggaccaagctctgatcacgatgcacccggtaagcacagacgctctcctcaccgctgccactccaccgcacccagacccctgctgaggtgccgaaggacctgtcagagctggagggcctgatcgagcggcaagccaaggtgcggatgcgctgtatggagtctaaataggtgctgttgttaccgatgttgctgcgctctgcaatgtggcatggggtccaaggatgtcttccaatagatcctatgcaatgtcttgaagcagctgcatccctgtgttcacatctcaatgacaggctttggcggatgcacgggcagaggctgctcgtgcggcggctgaggtcgagcggctgacgtcgcaactggagcgtgcaagccccgacggcatggcggcggaggccgcgaagcctgccccttcaaagggccacggttcctggtccctgggaggtaagtcatggttgcatgagtgcggaggagcagactgagggggttcatggcctgaggccgccctgtccccaggtgccagtgaaactttcgccggttggggacccctcaaccgtgctgggcattgccgggtatcgtgcacagcctggtctgctgcacagtcaggtggcgcatattcacatcgccccctgctgtaccacccctcggtccgcccttcctgcaggtcaaaacggcgccactaagaaggcagccgtgtccctggaggccgcgctgcagcgcattgctcagctggaaagcgagaatgaggacctgaggagcgacgccctggagcgggacgccatcctggcgcagtcgcgggagttcatcgctagcaccctggcgggcttcaagctcggatccagcgctcaggcggggccctgaccctaagtttgagagtgctgtgtgggtgccggaggatgcctccctcgtcccttgctccccttgtgagtgctctggtgtagnnnnnnnnnnacaggcggggccctgaccctaagtttgagtgtgctgtgcgggtggcggaggatgcctccctcgtctcttgctccccttgtgagtgctctggtgtagcgacgcaagtgtgcaatgaaagagggaaaggtgcggttcaagtgcttaggttgccgactctgggaccactggtacgttgcagagccccgtcgccggcggcacacagcctcgcttgcaatgaggttgcagccatctcaagcctcgcatccgtcggtctgtttggtgagtcatgcatcggtccccacgtcgccaaggtctgaggcatgcaccgtctcatcaccgggagcttcaacacccactgcatcgctgcctgtgccagaggctggggtgccaaccacatcgtcagccccagctccctctggaagtcgcagcacgatctgaaggttggggggtgcccacaaggggagagcgcgtgagaaactaactggctcacagctggtaagtggtgattatgcagctcgaggcttgccagaggctggctgccttcgcatcgtcagccatccggccccacccctctctcatcgacaccccctcccatnnnnnnnnnntgaggcttgccagaggctggatgccttcgcatcgtcagccacccggccgcacccctctctcatcgacaccccctcccattctgccatcccgcctgccttttctggttggaggaaggactcgccctccagcgcgcctcgtttccttttccgcagcgccagcttggtgttgaggtcgtggtacccgaccctgtcgtgggtccgcctgaacaggaaggtgctctctgcatgacgattggtatgggattgggcaggagggtgatgggcaggagggtcatgtttggttaagactgctgccttgatccggcgatgcccccctctgacagcttgtccagcgtcgggcacactgagtcttgatggaccatcacccgacccacatgtcccccaccgcagccctatgtcctcctctttccgctgtcataactctgcgcnnnnnnnnnntgtcttgatggaccatcacccaacccacatttcccccaccgcagcccgcagccctcctctttccgctgtcataactctgcgcccctctgctcacgtttgtcgtcgtatcgtacgctgctgtcgtactcccgcacccactcgtagtcgccctggagctgccgcgccgacagcgccccggagtctggcccagcgggcagcgtcccactgggcaccagcagcgccacgaatctgtccagctgcccgtctgacttccgttgcgcaaaggacttgagctggaccgcctgcgtggtatgggcggtgaagtgcgggtgtgtttgatctttaggaaggtggtaatgtgaagcccagtctgggattggaagaccgaggaccacgcgatggcgccatactccttacatccaggcctctctgcgcacacggcagcctgcccgccatctacaggctcgccaggccacagcccatggcctgagaccgacctgcttgaccctggagagctgcccctgctccagccgcgacaggcgatcgatgtctgccactgggtctgtatcgaagagcgccagcacgtaattcctgcccgcgagggagtcatcagggaggactgcgggggcaggggcgagggttgggaaggcagcatgagcccatcaaccaggtggatgcagcaatatctcctgccagggtgccttgatgccttgggcagccacataccacgctggctggagcggcgtcacgcgcacagcagcagctggttttggcgcagaggtgatctcattcacaccgcctaccctcgccccaggaagcagtacacgacaccgagactcccacccccacctcacctggaagcacttccacagccgtgagctcgggcttggtcgcatgcacaggcggcagctccgcggcagcaaaggattcctgggcgagcggcgnnnnnnnnnnctagcagctggtttttgcgcagaggtgatctcattcaccccgcctaccctcgctccaggaagcagtgcgcgacaccgagactcccacccccacctcaccnnnnnnnnnngggtgcatggctgatgtattctgccaggtgtctgtccaagcgaccaggccttatgcgcctgcctggcgtgtcagccgctgcatgacgcacccagagatctgatggcggtcacaacccccccttcaatcttctccaggccagcctgggcccagtctgnnnnnnnnnntgggtgcatggctgctgtattctgccaggtgtctgtccaggcgaccaggcctcatgcgcctgcctggcgtgtcagccgatgcatgacgcgcccagaggtctgatggcggtcacaacccccccttcagtcttctccaggccagcctgggcccagtctgtgtgatgcaaaactaccagctggcgccactgccaccaacctcccagccaccccatacctctatggtggcaatgcgtgctgcgacgtcttcgcccagctcctcgtcagcggccgcatcggcgcctcgagaggcacgcgagtcggggcgctggctgcccttgtccgcgccgtgcccgctggtgaggtaggaggtgcggaggagccaggagacctctgaggcggaagcgtgcttgcccttcttcccgtttgcggtgtcccccgtctgcagagatgatgggagggccagagccgggtgagaggcccgggggggggcgggattgccaacgacagagtcctgaccactgggccccaagaacagggcgaaaatgatacgtggccctggccccaatgggaacccagtccctgccacgccaacagtacctcgaggagggctgcatctgcagggtccaaggggacgcttccctccgggatggcatagcgctggatggaaagcggggcgagggggatgcccagatccggctcgaagagcatgtcgcgcttgaggcccttctccagggtggtcaaggagaatgcggccagttcgcgggcattgacgacggggagcaggagcttggggtcgcacgggatctgacacagggcagagttggagggagaggggagtgaactggtatggcggacccttgctacagggcgtcctgtattctgaagccatccggttgatgtttgcctccagctgatcactcgaaaaccgagccttacctcaggcaggtcattccggaactggatcctgcagttgaaaggcgtttccctcgtcaacctgttgggctcccgactcagccgaatggtcggcaccttgctcggctgtgaagagaagggagaagatagtttggcaaagggatggacattcggcatcgcttgagcttcgagtaataagaacctgtatatcgtgcagcacacccaagtttcactcaccggggctgccggcatccttgccagtgggtggggaggagggacccctcccacgcccgctccaggtctggtgtttcactacagatcgccggccacgaggatgaatgaaagccgtggaacttaagtttagccgatgaggtcttaaagtgtagcgtctctccctgtggtcttggcagagggccccgagtatttcatgcgctcgctcagactggcatgtcgggggagctgcgcccgcagcacgcacttcttggatcatattacttacagcagtccatgcaggtgatcgctgacaggcctacaaaggtcttggcggtgacccattcatcaaggagtgtgcttggctggctcgcaggggctgtgagtcgttcctgtcctgtgggtcttgtcccagggatagcatccctgctggtcactgggcacccctccacgccgtgcgctgcgaacatcgcgaggccgtgcgattcgatcctttcaatatatagtctttaaccacaatgagcctgcagtgctgcaggcatgnnnnnnnnnntgattcgatcctttcaatatatagtcttcacccacaatgagcctgcagtgctgcaggcatgtgcgttgcggtgccgtggctgggtactccagcgagcgagcagctggacctcgccggccacagaagtttcggtcaacacttgcccagcctcgccctgaggcccgggcgcggcctcacaatgctttgatacatggcccatacagaagcacaaccgccatttccagagaagcgacgaggtgcccggcatcgacgtgtgaaggcggggcccaggccaacccaacctcccttccccccaatcgtggccttttgatcgcgctgggcgtggcagcgtgcctggcgtgccggcacctccctgtgaccgctgcagcactcccctttgcgtcgtccacggtggcatggggcaaggcgactgccggcgcaggtgtgatggctggctggggcgaggggggtggatgaccatggacaccctcctctgatggctcagtcgaggaccgccagggtggactgcgagggttttcgtattcaccccatcattcattttcaaagtaccaggattgaactccctggcaccccgccacccacacagggctcacagcgagcgccggttccgcnnnnnnnnnnccaggtgtgatggctggctgtggcgatgggggtggatgaccaaggacaccctcctctgatggctctgccgaggaccgccagggtggactgcgagattttccgtattcaccccatcattcatgttcaaagtaccaggattgaactccttggcaccccgccacccgcacagggctcacagcgagcgccggttccgcgtgggccggcatggcggccggcttcctgcacacgctggcgggcgctgaccacctcgccgcgttgacaccgctcacggtgggccgccaccccgtcgcctcctccgccctgggcgccctgtggggcgccggccactgcactggccagctcatcctcggcctgtgcatggtgctgctgaaggagcgcttcgaccaggtactgcctttccaggggccttggctgcgctgggatgccgtctcacgggccgcgggctgcccagtcgacgatcgtttccactcacacacatgaagaatgcatcccccccctcctcttcacccctccagctagtgcctcttctggatcgctggggcggcgcctcggtgggcatcaccctcctcatcatcggcgtgctgggcctgcgcgactccttggcccagccggagccggcggcccctgccctggcaggcgcggggccgggggtgggggcggggccgcccccgcacgccgcgcggggcctcaccgccgaggaaaccgaggcgcaggaggtggcggtggcagtggcgacgcggagcaagagcctgggctcgctgctggcaacctatgtgacgggcatcgtgtatggcctgcagccagacgccttgttcgttgtcatcccggcgctgaccctgcccagccgcctggccgcagctgcctacatgctttctttcctcgtgggcacggtcaccgccatgggggcctacgccgggatcataggtgcgttgtgaggatctggcagagcctggctgcagggagtgcttctgtgtctctgggttggagggtttgtgaaagacgtgtgccaccatggcatgcctctctgctcccatgacacaatgactgtcagaggttgacccagtccctgacacatagtctcctgttcatcggatcctatcatcggcgctcacattcacatgcatgtccgacacccaactattgcaggggcgacctctcgtgccatctcggnnnnnnnnnngtcctatcatcggcactcacattcacatgcatgtcggacatccaactcttgcaggggcgacctctcgtgccatctcgggaacaaacgccgccctcaacaggaagctggcggccgcggcctccctacttgcggccggggtggggatgaccatcctcgtgccctgcgtgggaccactgcttgggtgacagcgtggacgccacccagacaggcccctcgccgaccttgacgtcaggctggctgtcatgtacccttcccctcccctgacaccctttgcttgctccgacgcttggcgtccgcccctttcgcacttcgcacacccctcatctgtttctcgtgcagttcaatgtattgcaagagagttttcaggctgccagccctgcaaggcatgcagagctgtctggctgcagggaaggagggagcctgacacagaggggaggaatagggtgcatagggtggcccgctccatcagctgctgaaatcagtctgcaccgagtccacaccaagaattcaggcctgacgcggctggaacgaaactgttcccatgtcgcgctcgcggtttccaccagagttccaagtgctgatgactttctgaccgtccaagcctgctgccttgagcctctaggtgcgggatgggagtgggggaggtgtcgggatgctgactattaccatgcaggcaaagggactggcaggtgggccttgggcgagtgagatgtgaagagtgtcagctcaccaatggcaggggcatgagaaagcatacctagcacacatcccagttgcccaagtggcatgtacctcttgcatgtccatatcctcggcgacgccgttgatgcggctcatgatgtcgtctatcttgaggtccttggttgagattcgcaccacctgcttgctggcgtacgtcacctcgacgaagttctccccatttaatctgtatacatgtgggcaagagttgcactgtgaggcgcttttgcagctgtggcatcacgcatggctgggctgtgtgatcccagttgcctaggagccctttacctagctgggcaactagccgagccctgaaggtcactccttatgggcataggaggccaagccacccgagtgcatattcgatgctttactccaataaaacgtagtctcacctgattgctcgtgatacctcgcaggctgggttggactccagtgctttgcgggaggtggcacgagccaggaactctctggccgatctggcctcaccggacagtggactgagctgcacgaatattttagcaatgtgcttcaattgcatggccatctcgggccaaggctggggatcgtcctcagcgtgcactaggggacgacacggagacccggccagctcgggtgtcgaggctacagtgcaaggaatatccttcgatcgagggccagaagtggtctatgagacatacgtcttcaaactggagtatgctgctgcgatgtcgaggggaatggaccttcagagaatactccaccaccgggccatgcatgccagcgcgccatgcaggatgcacaagcccatttggcagattgccgatcgctctcgatccacgagggccaacagtattcaaggnnnnnnnnnnnnnnnnnnnnnnnnnnnnnnnnnnnnnnnnnnnnnnnnnnnnnnnnnnnnnnnnnnnnnnnnnatttgacgatccacgtcactgagggacttgctgtgcatcacccactccccaggatcgtgatgtcgcagctcttcaagacgttcggcaaggagggacacaaggcttcgggtcactcgcagctaaaatcatcggtgcagagatcgatccgaggtgtgtggtagggggcggcgcctggtgcggttgcacagcccttggtgttggtcttgggcaccctgcggcaatggttgcagccatcagacacccgcccaaccgcgctacctttcattccatgtaggcaagattgcggagcagtacccgtggctagagacgacgggagtgctggaggtcatcctgcccaagaagcaggagctgaccctcatcaaactgtgagttgaacttggccaatgggcggtggtgctggttggagacgacgcatgcctggcgcctgtgagcagcgcgtcaccctaatcctaatctttgtgctcgacccctcccgcgccccaggcccgagcatgtgcagctgctggtggcggatcgggtggtcctcttcttctccacgcgcgatggcggctggtttcccacgctgcgcctcctgcacaaatacccggacatgatgccgcggctgcgggcggaccagggcgccatcaagtttgtgctgagcggggccaacatcatgtgcccgggcctgacctcgccgggcgcaacgatgcacgacgaggtggaggcgggcaccccagtggccctgtatggagagggccgggaacatgccatggccatcggctacaccacaatgtcgacagccgaggtgagaggggggtaataaagggctgtctgggaggggggaatgggcagggagagggagggatggaatgaataggctgcgtgctgcgcgattcgccagcaacaactgggagggaacggtggtttcgagttgatgctggcggcgccaaacgtatgctactttggagctagctggaccggcttgcccgccagcctcacaaagtcccaaaggcgaccaaacctcagcatgcaccccccttcactcactcagtccacccctcgccccttcatccgcacagatgcgagcgcagaacaaggggattggagtggagaatctgcactacctaaacgatgggctctggaagaccctcaagattgattgagcgtagaggcaaggcagcacgggcttagaggaaggcgagcatcctctgcctgaatgcagagggtgacacaggccctgatctctcatggaggcaaaacctggcggtgactccgaggtcgtctcggtgacgcccgacagagaacgagacccgacctggccggggggggtgcatgcctcgactccccacccacggaattggcgcaaatggcagctagagcctcgccacggctaatcatcaggagctggcttccacatgnnnnnnnnnnaacagagaacgagacccgacctggcgggggaagtggatgtctcgactccccacccatggaacttgcgcaaacggcagctagagcctcgccaaggctaatcatcaggagctggcttccacatgccatcctgccaggctggtccgtgctgcatcgctttgcgttccctaactgctgccaccctgctcgctgtggctttcattctgagagtatcaggcaaacacaccctgagcttcattaacaggcaatgagatacttccagagcacgaattacagtgactcttgcccatacccgcacccctcacgaccccggcagcctctccaaccgcgcggcaaaggcgccatcggtgccgtgtcggtggggccaggcctccaggaagccgcgctcgttgagcaggccccggggtaccaggcgcgccgcctcggcgggggggcaggcggcgaagcgccggccctccgccgtctcggtcaggaaccagtccacggcctcgccattctcctccgcctccagcgagcaggtggagtagaccaggacccccccgggcttcaccagggaggccgcggcgatgagcagcttgcgctgcggacgaggaagaacgcgggggtgaccggcgcagcgatgagaatggatcttgtggggaggagacgcttgccggccggtgtacctgggtgcctgctcggcagcgccccaccagaagaggagcccagtcccagactagcatccctagcccttccctctctctaacagtgaagcaaaagcaaaccaacaactacacacctgcagagagaccagctccgccacgtcccccggcttcctcctccagcgaatgtcgggcttgtgcgccagcacgcccgtgcccgagcacggcgcgtccagcagcacgcggtcgaagccggcacgcagcttcccgtcggccgccagcgcctccagcccctcggcacgggtggagaagaagggcggcaccagcccgcgcgcggcggcggcggcctccaccagcc

SEQ ID NO: 33737 - DNA, 61 bp, Chlorella protothecoides
ctgacatggtctgggctggaggctggcagggccttccctggtgagacactgccatctctga

SEQ ID NO: 33738 - DNA, 117 bp, Chlorella protothecoides
ggatgactgatgtgcagcagatgtactagacaaacagcatgccgaggatttatctggcatttagtaggatagtgggttgggacatgtttctcaccctttcgaaaggccaaggcggtc

SEQ ID NO: 33739 - DNA, 79 bp, Chlorella protothecoides
acgatcgacgttctgatgggccatgtaaacctgtccaccttataccctcaccgcggttgactcgacctccccccccccc

SEQ ID NO: 33740 - DNA, 79 bp, Chlorella protothecoides
aagtgtgtcattttcatttcagtcaaagtctactatttccagttgtaacctcgccaccctcctcaggtaccactgcggt

SEQ ID NO: 33741 - DNA, 138 bp, Chlorella protothecoides
ccccacaccttcttcctccgacccctcgtcacccatgccccgcccccccctcgccctccaccagacccacttcgcggccaagaacaacgtgggcgacgtgtccgcgcgggaggaggtctggggcgtgggcgcccagct

SEQ ID NO: 33742 - DNA, 61 bp, Chlorella protothecoides
cgctggagactgcccatgggccgagcgccacggtgctccacactacaacactcccctctct

SEQ ID NO: 33743 - DNA, 1009 bp, Chlorella protothecoides
  modified_base (923)..(932): a, c, t, g, unknown or other
ccgccgcgccgccgccgccgctgccctgcgcgcgcgcggcggcggcggcgtgctcggccttgagctgcctcatcagcgcggcgcgctgatcctccggtaggcgcgcggtgcggcgctggaagtccagagcgcgctgcttggagacatactgcttcaccggcgcgcacaccgggcactccgggctggagcacttctggtggtgcttgagcagctcgcgcgagggcaggcagcgcgggtacgcgcatgctgcgtccttgcagtggatcaggtggtgccacagctgcttggccaccgtgcagctgggcccgtactggcactcgcgctccggcacctggcacttggcgcagtggcgcaggaacagcagccagcgctgctgcttcaggatctgctggcgccgcacctcgccgcgccccgcgccggggggcagcgcgccgccgggggcaagcaggcccagcccctcgccgaccaggggggcgtcgggaagctgggccgcgccgggaacggggcctccggcctgggcgtcggagtagagcgacgtggaggaccctgttggttgttcattgggtggggggggagggttgcttgggagggatgatacgggagggatgggtgttcgcaggggatgaactgggcggagggcagggaggcaggaggacggaggagtgcccttgcgaggcatgctcgggcggggacgaacgaggtttgagttgcacaatgggggcccagcccatcgacgcaccgaccacacccccacccaccgaaaacccccactcaaagtcacctgggtgggagaacgggaggccgacgccgttggcgctgggcaggcgcgccacgcccagcggctccgcggcctcctccttaaccccggcgccgacggagcccgggcgctgcggcggcgcggaggcggggcggtgcgcgcccgnnnnnnnnnnaaggtttgagttgcacaatcaaggcccagcccatcgacgcaccgaccacgcccccacccaccgaccccccccccact

SEQ ID NO: 33744 - DNA, 65 bp, Chlorella protothecoides
acaatgccagaagcttctgggcaagcagggtcgcaaagactcttcccaggctgttcaccggtctc

SEQ ID NO: 33745 - DNA, 255 bp, Chlorella protothecoides
tgggcgacggcgtgggcagcgtgccggcaggtgcatcagggtgtccgcctcccagcaaagcagtggcatgctgtgccggtgtggcacggcgcgtcctgtgctggcccagattcgtccttccctcgtccagcccccagcccttggcgctgcagcttcgcacaacctcctctccccacatcgaccccacctcgcagctggagccagacgccgtccccctcgcggtataccgggcacccccagcgcagcttcttggcc

SEQ ID NO: 33746 - DNA, 61 bp, Chlorella protothecoides
ggaagcatgttgatccactcagcaatgaaggatactccatcccgccttaccccgtcacggg

SEQ ID NO: 33747 - DNA, 874 bp, Chlorella protothecoides
ggacatcgccgcgccccccggcggcgccggtgcggcgccggggcccgcgtcctgcaggctgccgggcgctgggccgcgcggcggcaggccgacgatggagtaggccccgccccagctgccctccgtgggcagcagcgaggggaagaggttggacatctgcgcgcgagtgtggggtgggtgcgggcggtgattggaggtgcagcggaccgggaagcgtctgggctgggccacggcgcgtgtggcacagccgggcaggggcgcggcgggagcacccagtctcgcagaccccccgcggccccgcgccggactcgcacctgggccaggttggggggcagggacaggtccacgtccagcgacttgtgcatcgccatccacgcctccagcgaggtgtctgcacggggagcgcgtgggctcgggtgggcagcgagcggcgtgtcacgaggggccaccggccaatcgccgtgagcacctcaccggcgcggatggcacctggacggcgccccgcacaccggtctccgctccgaatccccgtcgatcacacgcacacaaccacaccgcacccgctttgcgcttggtgttgccgggcatctggggcatgcccgggtggccctgcgcgaagccctggtgcgggagggcccggggcgcggcgccgccggccccgcccatcgcgccgccgcggggggaggtgccgtccgacagcggcgcctgcatgccccccggggtcaagcccagcgcggcctccacgccgtggcccgaccctggggcctggccgctgttggcggccaccagcgccatcaggctctggaagctggggtcctcgaagggcgagggcgtgaagtcggcgggcgaggcctcgccgttgctggcgccgccg

SEQ ID NO: 33748 - DNA, 466 bp, Chlorella protothecoides
  modified_base (122)..(345): a, c, t, g, unknown or other
agccgccttttgcggagaggggcgggtatggttgtggtccgccgccagatcacggccagcctctgcactgccgcgaggccagtcagcagctttcgagtgccacccgtcgaccccaacaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgaacggaggcacgggcggcgacccacccccgcgcttgagagcgactggtagaaacaaacagtcggccgggctgaaacagccctggcccggccttgaaacccatctggcaccccaaccc

SEQ ID NO: 33749 - DNA, 101 bp, Chlorella protothecoides
cggccgccgcgcgcaccgcgcgcatcgacggtgcgctagcacagtatcggaggaacgtggggctggacgtcgatcctgacgctgcggctgccgcacagaag

SEQ ID NO: 33750 - DNA, 170 bp, Chlorella protothecoides
gttggaagggcgggggagtgaggcagttggataggtgtccgcgggtgaggcggtgcacggctaggcagtctggaatttcaaacccagggtgtgagcagctgcggatctactcctgtatgtatgcgtaattaacaacaacgatgcccccccaattgagcttcaggtcgggc

SEQ ID NO: 33751 - DNA, 124 bp, Chlorella protothecoides
agcggtgggttgggggcggggcagccatgattagtgtggaagtgcctcgcgatgggaccctgccctctccttccccgcaatccactggtcctgctcctgtgatgagtctcaagactgttacctc

SEQ ID NO: 33752 - DNA, 74 bp, Chlorella protothecoides
catgcccctgcccaccaaactggggcgcaaaccctgtgcacgcacacacctcctcacctcgcctcctcacctcc

SEQ ID NO: 33753 - DNA, 88 bp, Chlorella protothecoides
cccccccccccccccccccccctaacacacacaagcacctgtgctgagctggaagttggcacgcgctgtctgctccggcatggggatg

SEQ ID NO: 33754 - DNA, 78 bp, Chlorella protothecoides
tggccttcatcaaaacgcacacacgcgcgcgcacccaaacaccccaccccccctggcccggccagggtggcggtggtg

SEQ ID NO: 33755 - DNA, 79 bp, Chlorella protothecoides
gcggtgttcttttgtgcggcactggcgctggccatgctttgcccgtctcaagccaccagcgccccaggtgaggacaaaa

SEQ ID NO: 33756 - DNA, 61 bp, Chlorella protothecoides
gctgttttgtgggttctgctggccgcccggccagtcaggaataacaagcctgctgtccaca

SEQ ID NO: 33757 - DNA, 81 bp, Chlorella protothecoides
tcaacggtacggcgggtgcatttagggacccaaggtgggggtgaaaccaaagcagccacgggtctgttctgtacacagctg

SEQ ID NO: 33758 - DNA, 67 bp, Chlorella protothecoides
cgcgctgaaggacgtaagacttgactgcggtgtaaaaggtccaaatctcgagcgccagatctcaact

SEQ ID NO: 33759 - DNA, 122 bp, Chlorella protothecoides
gctggtgtgcgcgaaaatccaggaggtggttttcccgtcccatgagcaggccgagcgcatcaactgtacccccacacatgcaggaccggcgacccatcgtggaatttgccatcgacaatgtc

SEQ ID NO: 33760 - DNA, 66 bp, Chlorella protothecoides
agagcaggagcgtagcgcttgaaggcctggcgctgcagcttctggctcacattttgagctcccaca

SEQ ID NO: 33761 - DNA, 68 bp, Chlorella protothecoides
aatcgcacggatgtccaagccgatgagcttcgagcagtggaaagtttctggattcaaacacccctccc

SEQ ID NO: 33762 - DNA, 80 bp, Chlorella protothecoides
tcgtgctgacgtatgccgcgacagattggagcttctataacgaggagccattgaatgcactgaacgagggcctgtcattc

SEQ ID NO: 33763 - DNA, 99 bp, Chlorella protothecoides
aatgcccacaccgcccatgaacttcatcagacattattcgcgaatcggactttgcatcgctcgtgcctcgcgtaacaacggatgcagggcgaggcgctt

SEQ ID NO: 33764 - DNA, 131 bp, Chlorella protothecoides
ccagccagacagggtgtacaggtggtaggctggtaggaaaacctcgaacccaagcatacagcacgctgctcttcaaaagatttgcttccctgccacgaccgcccaaaacctcacctcccattgcagtccca

SEQ ID NO: 33765 - DNA, 76 bp, Chlorella protothecoides
cacctcctgtaccagggccctcagtattcctttcctcctctgggaaaagtcaaaaaaggtctcctccaccgtcctc

SEQ ID NO: 33766 - DNA, 77 bp, Chlorella protothecoides
gctacgtgagctcgcctgttgagtgatgagattgtcgctggtgcctcggataagctcctgaacaaacatgagcaagt

SEQ ID NO: 33767 - DNA, 76 bp, Chlorella protothecoides
cccccatcaggaccgagccccggcccgaggcgcggcaggggtcggagcacagctccggcctcaccccgcgcatcgc

SEQ ID NO: 33768 - DNA, 75 bp, Chlorella protothecoides
gtttgggtgcttcggcaaggtgacctcaccaataggtcaggggtgtttcctcccctacccgatacccatgcgcaa

SEQ ID NO: 33769 - DNA, 76 bp, Chlorella protothecoides
tggcatgcctggcaggacggcgcaaaggctccctgcagagtacctgccttcaacattggcctccctttccagcatc

SEQ ID NO: 33770 - DNA, 171 bp, Chlorella protothecoides
gcagtctgcctggtgtgcgtctgggaagccaccagcttagcctggcacattgtcgcgggaggttgcacttagtcaccgcatggcagccgctcaataaaactactgccgctggcagtgacgcggctgcagtcaagtgcgcattactgtgcagtctccatgacactcctcgcc

SEQ ID NO: 33771 - DNA, 64 bp, Chlorella protothecoides
tggtataccatgcgcttcaaaacttcgtactgcactcgtgcctgcggcgtgtgcatagggccat

SEQ ID NO: 33772 - DNA, 61 bp, Chlorella protothecoides
cctgaggagagagggcatggccacaatgctcgcctcgcctgttcccactgcagtgccatgg

SEQ ID NO: 33773 - DNA, 105 bp, Chlorella protothecoides
tgttcgtgtaggatcatgcagagcaatgccaacatgaggcaagcgccttggtcgggtccgcgcaccttgccgactgtcagcttgcgcaggaactcgcgggcatcc

SEQ ID NO: 33774 - DNA, 62 bp, Chlorella protothecoides
aaagaactggaaccactgtgattgaatgtatcgaggtggcgggggaaagatgtgtggatgtg

SEQ ID NO: 33775 - DNA, 150 bp, Chlorella protothecoides
ctggcacagctgtcggacttcacttcctcccctctccccctctccccacagtaaccctgccaaacccctcccccccaacactactgtaaaccaagtcgatccacactcaccccagcaaggtgtgtagcgtgggttccacatccaggtgca

SEQ ID NO: 33776 - DNA, 76 bp, Chlorella protothecoides
ggagcagcgtgctgtacgcatctcggggaatgccgacgtaaaactgcagcaatcttcggccccggcgccctctggc

SEQ ID NO: 33777 - DNA, 169 bp, Chlorella protothecoides
cctgccacatcgcatgcctcgtccagagggccaactactggaagcacaggtgcaggcattcacagaggtgcactgcactccgtgacaggtcctccacaaggccatcgaggcaggatgcatgctggacaccagtgacgtctatggccccttcactaacgaggaactcatc

SEQ ID NO: 33778 - DNA, 3748 bp, Chlorella protothecoides
  modified_base (113)..(122): a, c, t, g, unknown or other
  modified_base (547)..(556): a, c, t, g, unknown or other
  modified_base (1348)..(1357): a, c, t, g, unknown or other
  modified_base (1421)..(1430): a, c, t, g, unknown or other
  modified_base (1531)..(1540): a, c, t, g, unknown or other
  modified_base (1898)..(1907): a, c, t, g, unknown or other
gtcctcggcgaaggcctggaaggtggcctcggccagctcggcgcaacgcaagttggccaccatcaccctgtgggccggtaggttgaggtccttgttggcgcggattacctccnnnnnnnnnncgtgatctggtccgacacgcgccagccgaagccagggaccaggtccgcctcccctgccacctcctgccaggccgggtcctcggcgaaggcctggaaggtggcctcagccagctcggcgcagcgcaggttggccaccatcaccctgtgggccggcagattgaggtccttgttggcgcggattacctcccacaccttggccatgctcaggcctagggcggcaccgggcagcttggtggggtaggagcgcagcagcgtctccggatctaggattgtgtgggatggggtgaggatgggaggacgctaaggagcagcgaagcgggtaatggtacctacctacgtatcctttctgcagtgaggctattcagacggtgcgtccttgcccgcttgcagcggagtcttcacccatgcaggtggccactcgcggnnnnnnnnnnatgtgtgggatggggcgaggaggacgctgaggagcagcgaagcgggtaatggtacctgcctacgtatcctttctgcagtgaggctactcagacggtgcgtccttgcacgcttgcagcggggtcttcacccatgcaggtggccactcgcggggttttacttccaccacataaacgcccccggcccccaggacagaacatcccccccacacacacacgcacgcaccttcctgcgtaaacctgcggcggaggaggtgggtctcggccctgaagtcctccgcccggtcctcgtagttggccagcgcggcatactgcacctcaaagaagtcggtgaggggcaggccctcgtaggccgggggcttggcgatgccctcccacatgcgcaccaggtccacctcccacgtgctgcgcagcaggtccaggggggtgcgagtgcggtcccggaagacgaagaggaggacggtgcggcgctgccccgcggcgggctggaacagcttgaggttgacctggaagatggtcttcagcaggggcttgccggccccggattcgcgccccacatccttggcccacatgttgaccaccaccacgtcggccaccgccagggcaaacagcgccgactggcgctcgaaggaggtgtcgtcctcgccgcgctcgcggccatccgacccctccagatccatgaccagggtcaggggctcggagatgcggggggcgggggccagccagacgccgcgcgtggtctgcgatcgcccgctcaacgcgtccatctcggtgaagctggtgccaaactggggnnnnnnnnnngaagcggcactgcgatcgccaggcagcacgcgggggcgcacagggctgtcctgaccgaggggcnnnnnnnnnnagtaggggaatggggagagaagggggtgtgggtgtagagggcgagcacaaagagcgggagcggcaggcatgatgaaaggcgtcgagtggaacgcatgcctnnnnnnnnnnggtgggggaatggggtgagaaggggctgtgggtgttgagggcgagcacgaagagcgggagcggcaggcacgatgaaaggcgtcgagtggaacgcatgcctccatcctggctaaagcggcaatgcgatcgccaggcagcacgccgggcgcacagggctgtcctgaccgaggggcgctgcgtgtggcatcttcatggcaaacccctttcgtgggtgccatggcatccccattgcatgcaatgggagcggtaaggttgcagggcctcctgtacggcaaccaggtcaaccccccccccaccaccaccaccctgcagcgcaccagtgcattgagcagtgtgctcttgccagagctctggggtnnnnnnnnnncaccccaccctgcagcgcaccagtgcattcagcagtgtgctcttgccagagctctggggtcccataatggccacgacggtgtagtctatgccggtagactctactcccgaggagtgcatgtaggcctggacagcaggctcgtcaaaggtgccatccccctgcaccacctggaggatgcgtggagctaggctggaggggtccagcgcccccgagttgttgggctccgaggaactcatgctgatcagtctaggatttacttggggttcaggcggacatgacaggtttcaagggttcacagcatggcaggagggctccgtaacacccgtgcgtcgtgctgagtagatccccaggcacccacgcgcgggaaatgtccatgggccaccaccgtggcggagagtgccgccggtggcgcccccagtgttccaccctcccactcccaggcccgagtggcatataagattaccacagggtggaaaattatcatacctgaacaagtagtaggatctccctttccacgccagctccaagtgctggtcccgcgagtgccactccaccccctcgtggctgcgccaccctcgcgtttgggaccaccatggtgctgctcctcttcgagtccgctgcggggtttgccttgttcaaggttctggatgagggcaagctgaaggaggccgagacacaggtacgcactccccggcatgccactgcacgctgcgcgccaggccctggtgactgccaagctcatgaccacgcgcgcacgcttcgatgaacaggatgtgtggagcagctttgagaccctggatgccgcaaagaaggtgggctggggtcttgcagtgcgcacgatgtatcccctgatgctggttgtgcagactggtgggtggttatggggcccagaccgacagccgcgtgcctccccagccagcctgcctctgatcaccgctggcggtgcactccctccaacgtcgagatcctcgccatcaaacacctggtgctgccatgcacccctgcaggttgtgaagctgaaggccttcagcaagtttgagaacacagcggatgccctccaggctgccgcgtccctggtggactctaaagtcagcaagagtgagtgattgtggagggaaggtggggggggaatgggaggtgaggagggggaaggtggacggacgcccttgggtggtggggattcgcctgcatgacccagtctgcagtacacaggtggcttgatacatagtcgacaggcctgggccattgctaggggcccctcgcttccgaggcacacagaaactcaggcccacccctctccccacccacccctcccatcatcgccaggcctgaagaagttcctgaagaagcatgccggctccgacacgctggcggtgctggatgccaagctgggcaacgtgatcaaggagaagctggagatcccctgcgtgtactccacgggcgtgtcggagctgacgcgcggcgtgcgcaaccagctgggcggcctgctggcggggctgggccacgaggcggacctgcgccccatgtccctgggactgtcccactccctgtcccgctacaagctcaagttctcccccgacaaggtggacaccatgatcatccaggccatcggcctgctggacgacctggacaaggagctgaacacctacgccatgcgcgtgcgcgagtggtacggctggcacttcccggagatgaccaagatcgtgggcgacaacatcgcctacgccaagaccgtgaagctgatgggcacgcgcgagaaggccgccgacctcgacttctccgacttcctggaggaggaggtggagtccgccctcaaggaagcaggtgggggggggtggggg

SEQ ID NO: 33779 - DNA, 109 bp, Chlorella protothecoides
ctttcagcagtaccctgcagatctgacgtgtcatgaccacgccgcacgcctgccatcacactgatggtataagcccagaaatcccctcaccttgactgcacactcttgc

SEQ ID NO: 33780 - DNA, 80 bp, Chlorella protothecoides
tgcaggtgccctgaagacttccctccggcgacgcggttcacacatccaaactcccactccccaccctcaaaccaatcgca

SEQ ID NO: 33781 - DNA, 149 bp, Chlorella protothecoides
gccctccatggacgcagtctggcgcaccgtcggccgctgctaccctgccttctgcccgcgaccaagtcatttggtacagagtgcagtgcgtgagtgctcaggggtagatggtgtcaggcaaggcctccacgtcaggggaagagtatttg

SEQ ID NO: 33782 - DNA, 64 bp, Chlorella protothecoides
atggatccagcgattgatgtgacccttctcacaacccctcacccgtctcgaagaggccaacagg

SEQ ID NO: 33783 - DNA, 78 bp, Chlorella protothecoides
acatggcgaggcgtgttgtgcaatgagattccttctatggccacatacctcctcagagcttcgtatgttcacgccgca

SEQ ID NO: 33784 - DNA, 120 bp, Chlorella protothecoides
atgccacagctacgcagagctgggcgaggcgggcctgaggggtcaggttgccccccccttgctttccaaaccccttgtgctgcactcatcgtgtcacccactcggtgtgccgacacgctc

SEQ ID NO: 33785 - DNA, 116 bp, Chlorella protothecoides
tgtgccccttgcacctcgctggcaggccaaggaatggggccagaacagtgcttgcgtgttttccggggtgggcgttcccactccttggcacccagtcctcgcctaagcggcgagaa

SEQ ID NO: 33786 - DNA, 211 bp, Chlorella protothecoides
gactgtgggtgtgggttgggcagctgggaccgatggggggaaacaaggaaggcctgccgcccttcggccctgtctgcttcagaccaaggccccacgaagcgacgctgccaccccagggctctgtataggccacctgcctccgctgctccaccaatcccaccttgacacctccccccataagtcccatccccccactcccaacccaaccagc

SEQ ID NO: 33787 - DNA, 65 bp, Chlorella protothecoides
gggagcgcattctgctgtgcctgctcacaggggcccagaactccctccccacaccgtcgtatccc

SEQ ID NO: 33788 - DNA, 64 bp, Chlorella protothecoides
caccctgcacacctagccaccctgcacaccaagtcaccctgcacaccttgccaccagcgagctc

SEQ ID NO: 33789 - DNA, 14408 bp, Chlorella protothecoides
  modified_base (412)..(421): a, c, t, g, unknown or other
  modified_base (839)..(848): a, c, t, g, unknown or other
  modified_base (1562)..(1571): a, c, t, g, unknown or other
  modified_base (1934)..(1943): a, c, t, g, unknown or other
  modified_base (3007)..(3016): a, c, t, g, unknown or other
  modified_base (4140)..(4149): a, c, t, g, unknown or other
  modified_base (4596)..(4605): a, c, t, g, unknown or other
  modified_base (4939)..(4948): a, c, t, g, unknown or other
  modified_base (5455)..(5464): a, c, t, g, unknown or other
  modified_base (7091)..(7100): a, c, t, g, unknown or other
  modified_base (7458)..(7467): a, c, t, g, unknown or other
  modified_base (7755)..(7764): a, c, t, g, unknown or other
  modified_base (8439)..(8448): a, c, t, g, unknown or other
  modified_base (8890)..(8899): a, c, t, g, unknown or other
  modified_base (8997)..(9006): a, c, t, g, unknown or other
  modified_base (9096)..(9105): a, c, t, g, unknown or other
  modified_base (10992)..(11001): a, c, t, g, unknown or other
  modified_base (12341)..(12350): a, c, t, g, unknown or other
  modified_base (13110)..(13119): a, c, t, g, unknown or other
  modified_base (13724)..(13733): a, c, t, g, unknown or other
gcgcgggggccgcgcggggggcgcgggtgtccacggccatgcggggtcgggcgggcgcccggggcgcggaggcatgcccctgggccgcacgcccatgctgtgcgcgctgggcagcgtgcccacccaggtcctggagccggcggcgctggatgtgctgggccttggcgccggcgagctggcggtcgcggtggcgggcaggggcctggagctgctgacgtggcggcccgcctgaggggtcgtgggccctccttccctctgtgatggtgggctcacggcgccgctgggccaggggtgcaacaccccttgcccacccagccgcagacccctgctcgcccgcttgactaccccaggtgactcccaaggtgccccgcgacacacggcgggacgcagcacagaagtaaaggggagaacnnnnnnnnnncacccaggggtgcgaccccccttgcccacccagccgcagatccctgctcgcccgcttgacgaccccaggtgactcccaaggtgccccacgacacacggtgggacgcagcacagaagtaaaggggagaacaaggcggggtttgagtcaggcagagacgacctcggggcaggcaggagggggtaagacaggcaggagggggtgagacgggcatgcgggaagggcccaggtgggtgggggacgtcctgggtatggtgccgcaaagtacaaagggccgggcgggcctgcacctcacaccacccgcgggcctgccgcagaaaactggactggcggatctctcgctggcgcaagggcacattgcagcgcagtgcagccggggagcaccccgaaaggggtcagtagaggcccttggcacccgcgnnnnnnnnnngttgcagcgcggtgcagccggggagcaccccgggaggggtcagtagaggcccttggcacccgcgtcaaaggtcgtcactgcggcggggcccttctcggacgtcaccaggctcacgatcttgtcggcagacagcagcccctctgtccgcagggcaggcttggaggtgtcggtggggacgatgatgacggtgggcaggcccatgatctggcgtgggatgggggatacgagagggagtgtgggcaagttgggtgaatgcagcgatccagcactggagtgagtgtgaacagtgccgctgatgcgtttctctcgcccagcgtcatgcagaggccatgttgagagccggagggtgggacttgggccccaaacccctgaccccgatgactagacgcaggcacttgctcaccgaccacacattcccacctgcagctggttgctgatgtcagggttctcgtctgtgtcaatcttgaggatccgcacactgtcccctagccgctctgccacctgggagcatgaaaggggcacgcagagggccgtgcttgttttaacattgtgaaaaagatcaacagtgcacattcgtgccggccaatccacatacgatcatgggtgtcgcttgtgtggttctgtgggttcagggatcaaacccctcccaccccatttccctgcaccctccacccccagaacataccttgacgagctccttggactggaggacgnnnnnnnnnncttgacgttgtgaaaaagatcaacagtgcacacccgtgccggccaatccacataagatcataggtgtcgcttgtgtgattctgtggtttcagggatccaccccctcccaccccatttccctgcacctttcacccccgaacacaccttgacgagctccttggactggaggacgcagggtccgcaccaggtggcataaaagtcgatgatgagcggtttggccctgctctgcaccgcatcctccagctccctggcgctcacctcctgaatctggaggcgtttggaaaaacaacggatgctatgcttgccaaccaggggcgcgtaggtctcacggtggggccaaacacatgtaccaaccctgtcgcnnnnnnnnnnaggatgctatgcttgccaaccaggggcgcttaggtctcacggcggtgccaaacacatgtaccaaccctgtcgcgacatgttgcaccacaacgaggcgtggccgctcaccacatcgctcgccgcagccagcacggcgagaggccggcgatgctgtctttggaaccacggaagagattggggccgtgtatgacgggagaagaggggctgggaggagggcaccgggccacggccgggtccaggaccgggaagatattgcctgctcccagttacgagggacgcgcaagccctcatactactagatgcttttcggctggagaataaatgttttaattctgtgaccgctacctcctcgggggtgcatgtctgtgctcgctcggcgtcggggcagattgccagcacgcctgggcgcgggcgcacggtgacaaccggattccgaaccaggagcgtgaccagcattccccagacggtctttaaatataagcgattagaaaggaactgccgcatgagacactactttttgcatatcacgatccaaaaaggaggattcaaacgggagccaagagatgttctgagcatacaaggtatcttcatacataacgcctcatgctgttaatgtcccccctgtttgggagggatggcgggacaccaccagcccaccaaactggccagtcagcgtccctggccctgccaggcgcagcttacgctggcgcacgccacgcgtcgtcagcacctcatacgcagcagggaggatggaaagcaccacgatcgccagcatgaccagggagaagttgttccgcacaaggggcacgtttccaaagacgtaacccccacctgtgggattggagttttgatgcaagcggtttgagccagaggtgagaggccagggtgtgtgctggatttggtggatagaaactcctcgcatgctagaggtggactgagaggagcatgagccgatttagaccacgccaaaccctccccacatggccaccattgtatcaagatggctgcgtatgcaattcccacatctccaccttcccacgcaccgcagcacaggcaggtccagnnnnnnnnnngtgaggcaatttggaccacgccaaacccctcccacatggccaccattgtatcaagaaggctgcgtatgcaattcccaaatctccaccctcccacgcaccgcagcacaggcagggccagagggcagctcccaggacgttgaagtaagcaaaggcagaccctggcatggcgctcatccccgctacgaatggggcaaacgttcgaacgatagggaggaaacggcccagcaccactgcagaagcgtggttgatggggatgaaagtcatcaggaaggcgagatgtggggtgggatagtattgccacgagccgcaggccctccttcatggaagcgcaggtaggcaggagcacctggcgaatttccagccccttcacctgctcttccgccgtgcttggcaaagaagtgctgtgtcttcacgaggtgctccttctttaccagcctggactgctgcacatgagcgcccaggtactttccagctgcaccaagcaattggaagcgggaagacatcaaggcaggtagcaagagcaaacgcctgacaggcacacacataccgcatccacccaatttctacgcccctcacatatccctttgcccctgcagctatatctgctttactccgaaatcccacctgtgtaattcacaaggtcacccagcacagcagctgccatgtaggtgagaagtagaaggtagatgttcagtttgtcgctcgctgccagtgcgcccgtggcaaagaggagggagtcgcctgtgcgcagcgagggatggcacgtggcagtgaggcgctggagctgctggcactctgagaacgttcaagcaagagacatgatacggtgcctcgccaacaatgccgctccccacacctggcaggaaaggggctatcacaagtcccgtctcggcaaacacgatcgcaaagaggatggtgtagctggcacgtccatggattgctaccaattctccaaggtggacgtccaagtggagcaggtaatcaagcagacccctgagccctgacaccactgcaaggtttcagggcgaattcatgtgcctgagagcgggttttgagctttctaaaagaggattatgtgtgctctgaactcaatgacttgcttggttcaaatcagtgcagcacannnnnnnnnngttcagggcggatttatgtgcctgagagcgggttttaagtgttctaaatgaggattatatgtgctctgaactcaacgacttgcttggttcaaatcagtgcagcacacgactcgaccagccagcagccacaaggctgcaagtgtggcccagtgcaagatacttaccagcagaggaaacttctggtgatgcggaattggccacatcttgagcttgggcaggacaattgaagtagggcagaaggaggatggcacttatgaggaggcttggcaatcgtggtgaggctggacgctgccaggtacttgagtgcagacggtagacaacttcctcgttgctcgacgtaaaggacacagaattggtggatggcatatctctgagatattctacagttgagtcatgctcaggattgcaaccaggcaaccgagattctgaacgacagcgggtttgagnnnnnnnnnncaaaggacacagaattggtggatggcatatcgctgagatattctacagttgagtcatgctcgggactgcaatcaggcgaccgagattctgaacgacagcgggtttgaggggcctctcccgagcagctatatctacgctgcattcttggctttaggtgcgaggtgaactcccttattcgttgttcaatgcctcgttggctactcggagcattctttgcggatcgaggggaatcgcctggaggtcctcacggctgtgcgagagtatcggtcatcagttacgtgtcctgtcgagccggctgcccgaccggaagctggtgccaaaagcagcacactgnnnnnnnnnngcgtgtcctgtcgagccggctgcccgtccggaagctggtgccaaaagcagcacactgcctccatgccagccttgcatacatcttgcctgaacccgcaaggggtgcccagatcactccacagggacacgttccagacgctcgtatcttcgcagacgcagtccaagacattgaagcattggacagtgggcgccttctgtcctcccctctccattccttgcatctgccccgagagaagctgcaccacctgtctcatgagtcaggaggtgtaatgtacatcagagggttgcacgcagcaaattatcttagttggttgagttggcgttgtggggcttgggagcaactcattgggggactgtgtgctgctgcgctggaggggcccctacaagggccgagaccaggtgtggcctggccgccagggtttgtaccaagcccgctagctgctgccgctccgctgacccctggtcaccaaataatgcgcgcactggccatgtaaaatcttcaggacgnnnnnnnnnnaaccagaggtggcctggccgccagggtttggatcaagcccgctagctgctgccgctccactgatccatggtcaccgaataatgtgcgcactggccatgtaaaatcttcaggacgagtcaagcttgccctctccgatggagcacaggccacgccgcgcctcactccgacttgttgtcggcgtcgctgcccttccctccgtcgatggccgtcggcggcgggtcccccggggcgaggggtccgcgctcctcgtcccccacgggcatgaagcgcttccagagccagtgggtgtagaagacggcctgcaggcgctccacgggcacgtgggaggtctccggcaccaggaagatggtgtagaggaggagcagccccgccacgccggcagagaagaggtagagcccccacttcatggcgcagagcatgaggaggaaggtgtaggtggacaccgtcccccaggtggcggtgaggagggtgatgagcacccagaccacgggccggatctccaggggcgggaactcgcccatgaagaccgtcaccgtggtgttctgggtgcccatgaaggccagctcgtagacgaccatggtgaccaggatgccaatgccctgcgcgttggtggccaccgccccggggacgtcggccaggaactggttgaacaggatggcggaggtgacctgggctgcgatcatgacgccgcagccccagaagaggaccgaccggcgcttgaagcggtccaggaggagcatgcccatgagcacgcccgcgatcttggagcagccaatgaccacggcattgatgagcgcggtgctgtgcccaaaccccaggatggtgaagacgttgggagcatagaaggtggcggccgaattcccgctccaccagttgaaggtgacccccaggaggacgatgaccaggggggggacatagcgccgctgcgtcagcacggcgtgccaggcggcgcgcagcgtgggtgcccgccccgccgcccaggagatgtcgtccagctcggcgccgacgtcctcgcggccgcgcaggcggcgcagcgcgcgcagcgcgtcctcgcgccgtcccaggctgttcagcgccgagggcgactccggcatgaacagcgacccggccagcaggatgccggcggggaccatgaccaggcccagcgcccactgccagttgttccccaggtcgcgcacgccgtagttgatgacctgggccacgaaaacgccaaagccgccgaagaagatggtgccggagatgaacttgccgcgcagctgggccggcgcgatctccgccaggtagatggccgacacgtgctcgttgaagccgtcgccgaagccgagcaagacacggcccgccaggattgcggcgcggttgggcgcggtcacctgcaccaccgcggcgacgatggtcagcaccgcgcagcagcgcagggaggacagccgcccgtaccatcggctggtgaaggaggaggcgatggccccaaccagcaccccggggtagaacagcgcagtgtataggttgagcgtatcgttggcgtacttgcagtagggcgtcaccgtcgggctggtggtggttgtcaccagttcggggtagaacttctccaggaaagtggtggagctgaacacgccgccggtgatgccgnnnnnnnnnntgcagtgtataggttgagcgtgtcgttggcgtacttgcagtagggcgtcacggtcgggctggtggtggtcgtcagcagttcggggtagaacttctccaggaaagtagtggagctgaacacgccgccggtgatgccggagtcatacctggtgagtatgatgtgtttgtggtgggggtgggggaggttctaaggaaagggactgtgtgtaggtgtgtagagtgcacaaggtggcgcgggcagtactgcaactgagagagcgcctgtccccttcactggaatgttgtgctagaaaccgcgcagcaggggcccccccccaaaaaactcaacccccagcgcctcacccgccaatgatgtggannnnnnnnnngcttcactggagtgttgtgctagaaaccgtgcagcaggggccccccacaaaaaattctaaaaccccagcgcctcacccgccaatgatgtggaggagggagcccaggaacccgctgtacaggagcgtccatgtcagtctgcggcggagagagatttgtcggaacaggggtccaccagggacgtggtggggaagggcagatctcccaggccacaaccacaatgctgcatatgcctcgtcccatgcagagccgggtgccctccccccctcgatgcaagccgcgccgcttgnnnnnnnnnnatggagggcagatctcccaggccacaacccacaatgctgcatgtgcctcgtcccatgcagagccgggtgccttccccccctcgatgcaagccgcgccgcttgcctgtaattgtagccggcgggttccaagcccctcggcgcgaggttctcggccaccaggacccccatgccggaagatgacgggctttgtccagccaagagcggttggacagaggtgatggagagagcatctggagccgtcctgccgctcccaggcatctatcaaagatctctaggtttcttttagcaatgcatttgctggcaaaacgatcacgcggacctgccccgcgactaccccgcaggtcaggtccatgatcttggtccgctcgagaccagcttgctcggcatcttccgtcttgaaggttcccattaatgtcgttatgaagcgccgcaggacagtcagacagtcgggtaccagcaaagggggtcccggatctgcaaccctgctccgaagctccgcccgtgtctaggacgcacctgggatgccaccgtccaagccggtgttttcctggttacaggacacttcctcgcagtaataccccaaatctttgcaacggatataatacttggatggctggaagctgacgcctccgctaaggcagcttaaatcctgcgaagctctaagcacaccatgcnnnnnnnnnncaggacgcacccgggatgccaccgtccaagccagtggtttcctggtcacaggacatttcctcgcagaaatacccaaaatctttgcaacgaatataatgcttggatggctggaggctgacgcctccgctaaagcagcttcaaatcctgcgaagctctaagcacaccatgcagtcagtgccctcccaacatgaggccctcgagagaaattgatggtgaataacatctggaaagagctgcctccgccggcaaaatacccagggacagactcatgtcattcccggccatacttcgccggcgacactcaccagtgatgcgctgcgcggcattatgggcccctctcaatttacatgcaaggggtacatcagacaccaactccgtgtgcgttcacatggggccacggcgcagggaattgtcagtgctttgaatcttacacaatcttcgnnnnnnnnnngcttcaccggcggcaatcaccagtaatgcgctgcgcggcattaagggcccctctcaatttacatgcgaggggtacatcagacaccaactccgtgtgcnnnnnnnnnntctcacgcacgctagcttccccgatcgttatgcttaggggtaacgcatcgcctctgcacacacacatatatgcatgggtaaagatcatgnnnnnnnnnncctcacgcacgccagcttccccgatcgttatgcttaggggtatcgcatcgcctgcacatacacacatatatgcatgggtaaagatcatgcttgattctgacagactgttggatgtggttggaagcttgctcgaaatttcgaccacctccgcgtcagaccgatgggattcgctcccaagcctctcggaaacatcaggtaggtcaggtagcttcatgtgcctgcttcgtgcaggccccccgagaattcctcgtctgccactaaatacgaccgaacagatgtttggggcatcagatcgccctccaaactcgcgagtttatcagcttttcaacctcccaaggctgtcgggaggacgaaaggcctcgtcttccggagggccgattcgacaagaagccagagtgtggccgggaatcaacccatagtccatccctgaaatggctcaaatgacccccgtcatgatagaggacgagtgttccaaggccgtccatcacttgcatgagcttactgcggcgaagcgacacttgtggacaaatgagagcgtggctgtgacggatagcctggagcaggtgagaggtcggcccatgcgcatgcagaagtcccacctccgggaccatgatcacttcatggcatcacgaatgatccaggctcgccgctggtcagtgagactgccgcgctgtggattgtgctctcgactcggagtcgcctgaatgtaacccctcccgaggaggatcccctcgacggcgcaaagggtcatccctggccgccaacccctcccccccccaccgcccctcatgcaggagctcgacgcagccctggccctcttcgctgccctactcgagcatcttgctccagggagaccccttgccccggagctgagcctgggcatcagggactcctggcgcgccctggtggatctaacatatttccagctgcacacccgccgtgacgacctactgcagagcctcttctccccaaagcacctcgccccctcagccgtccatctcctgcgcgtgctgtcgcatgcggacggcctgatgctcaccgccctggctgagttggatgtggcaaggatgaggacgctattccaggctacccaggtgagggcccccccgcctctgcactaacgaaacacagaccgcctgccagaccatcggcctactgagctcaccagctgtgctggcttcttgtctcgcttgcattgcctctgcaagctttgtggcgtcgcctcacctcatttctccccagcatctccccccccctctttcccttctctccacaggcccagctgactcagctccgcgccgactacctctgccgcacccagatgcaggccatcgtcagggccaccgcggtccagtttgcacagggcaacgccaaggatccgcagctatattgcgcggtacgcagcgtgcgcgcccagcatgccccccgcggcgaccccacgtgtgccaccttcatggtgcagtgaagtttcactgcagttttccttctttccaaggaccccctccccttcagcgttgatctctttgcagtgtcactcccactcatcacataggtatcagaacgcaggttgcagactttatttgggatgggtcgcgttcccccctttcataccctcccctctatcgatgtaccctttgtctggttgagggtgcccgctcagcgggaagtttcccttctgccagagcccctaggcctgagccttcccacctaccccccttcatgacttcaccatcccaccctgggatccaatagaagatcctgcttcctctttctaatattgcacggcaggcgtgtgcctggccggagcacaaacctcaagcgagtctgtaataggataggtccaggtggcatgattgtcttggcaaggcatcaggggcactgctgggnnnnnnnnnnaagccttcccacctaacccccttcatgacttcaccatcccaccccgggatcaatagaagatcctgctccctctttctaatattgcatggcaggcgtgtgtctggccggagcacaaaccccaagcgagtctgtaataggatagatccatgtggcatgagtatcttggcaaggcatcaggggcactgctgggatggtgccaaagaggcttgcggtctcagtacacggccctgcggccaggtttcagattcattcgatggcaccccacagcttcctcccagggtgttcagcaagccccatgcctgggatcagggctccgacgcaaagggcatgaacacggccggcccttccaccgtggtgaacaccgtctcccggacgtgcgtcagtccaggcgccgtccactccgcacctgccaggcgcatggtccatgcgtcgcaggcggccgcgatgcgcgccgcggcgtcggcgcccatctcctccccgcccagaacccggcccaggctgcagtgcacgatggtactctgacgcggcggcgcaccggggaatgcccgacgcagccgccggcgcagcgcggccaggccgccgctcacgtccacactgcacagcagcagcgtgccggagtcggccagcagcaggcgctgggcgcgcagacggggcggtggctcggcggccgcggcggcggccatggcgcgcagctcgcgggccagggccgccggcgccggcgccgcccagtcggcgggcggggcgtcgccagacggcggtgcccagccggggtcaaaggggtctgggcgcagggtgtggggctggctggtcatgaatacggtgacatgatagtgtgagggctcgttcaggtgcagcaggtagcctgctgggtgggaatatttggggtgttaggaggtggctggagatgatgggggagtctgattcctgcgacatactggccatgaaagctcccggcacctgggtcgcggatcaggcccaggagcctgatgccccaagtcaggggatcctcaatcagagagtgcacccgcccaccctcaccaggcggaatatggcgggcaatgtccagcgccgcctggtgggcgaggctcgccagcgtgggattgcacttctgcatgaagagcacgcccagccgcacagcggcctctggcagcggggaggggaagcgggcgtactccagaggcctgggtaatgtgcctgtgaccggagtgcgattagaacgagctgaaggagacggggaacaggtgtagggaggagaatgctgcgtgcgtttgaaggtttcgcatactatggacgacatacaaccattggaccacactggtggactggagggtgacgagaannnnnnnnnncttcgcatactatggccgacatacaccattgggccacactggtggactggagggtgacgagaaagcactcagctggctgccgggggatctgccatacatctctgtcacagatcctgcaagactccaccgccagtcacctcaaccgcctggctcctcaccctgggagaggtcaaagtactggcgggtggcctgcacggcctcgatgttgaggccatgctgcaggaacttggcagccatggcgtcgtagcaggccgccagctgggcggggtccgcctgctgatcatccgacacgaccaccttggcgttcaggctggcagtcatgtctgggatggtgaccgagctggccccaggctggatgctggccggagtgttgtcggccatgacggacgccgatgctctattcagatgaattcacgagatgatctggtggaagtgtctaactccgataaacttgcagcggacggccccggcacggcatgcgatcatctcctgatcagggttcggtgggtgcccgccaactcgcccatcgatcggggttccctggcaagtgtgcaggtacctcctttggttatgactcgttgtaaaccgtgaataatgatttgagacgcccggggtacatatacgaggccctttcctgctcgggcacaggtaggtggttgcgatgctggtggcgagcgcgcgcgagaggccccatgatctgagagggtccaatggtggaccagctttactttgacacggactgcatacgttgagctgattnnnnnnnnnntgtgatctgagagggtccaatgctggaccagctttacttgacacggactgcatacgttgagctgattacaggcatcaggaagtacgagcgtgaatgatgaaggaaagagcaatggaatttaggttgatgcagcgtcattactttgcggctggttggcagcataggtcgcccacgtccgggccaccgctccctccagccggtctagcatcgcctccaggctggcacgagtcttcggcggcagagcgcccccgcctgcgccgacgccactcaccagctccctcagcctgcggctcagcgagtccaggtctcggatgggcggctcctgcgcccggccctcccggtgcaccatgctgtgctggccggccagcgcgcacagcgcgcccagcatggcccgcagcgcccgtccggcgtccaggcccccatgagcgctgccgaggcaggagcacgcgagctggtgcagccaggccagcaggcctgtgagcgtgcgtttttggagggggcggggggagagtgtgagtggtgtggatgcatggtgtcactggtagagggaatgtgtatgtgaacacaagtgccggagcctcaaagggctatggtgggtttccacnnnnnnnnnngatatgtatgtgaacacaattgccagagcctcaaagggctatggtgggtttccacacgaaaggccccggatgccggcttcctcggcgacaggcagacgcctctgccgccgtcaaacccgacgtgccttcttcccttccccctcaaacccaacgcaccgccctcctccaggagctggcgggcggcgcgcggcacgcgcgcggcgtggcacaccaggcgcagcgctgcgtcgcgctcccgtgcatccagggcggccgcgtcggccaggcccatggcgcgctcgagggcgtgctgggaggaaagcacgcgcgcgtcggcggggcccctcaaccccgcgcgcatcaggcgcagcagccagcgccgcggctcgccggcgtcggggtagccggagaggaggacggagcggcacagcgggacatgcctcaggtccagcacgggcgcgcgcaggacctccttgcacacggggccgtacatcttcgtccccggcctcagggccgccgtggccgcctcggccaggaacagggcgtgcagcgcgggcaggcgggcaaagggccgctccagcgccccgcgcagcgcgcccagcaggacggcgagctggcggcgctcccgcgtgtcctccgcgtccaggcccccgcacgccagcgcgaccgcctcgtgggccgcggcgcgcagcggcg

SEQ ID NO: 33790 - DNA, 61 bp, Chlorella protothecoides
gccccacccccagaagtctgtgccaaagccatcgacacggctgatctgctgctggctgatg

SEQ ID NO: 33791 - DNA, 68 bp, Chlorella protothecoides
gtggctgctcttgccttgattcctgcatggatgagccgtgcaagcacagcatgaagggctgggtacat

SEQ ID NO: 33792 - DNA, 112 bp, Chlorella protothecoides
gggaggtggtgggcatgggcgctcgtggccagcgcctggtgccgatagtttgacgcattcatggcgccgccggccctccctcctggtgattagcctgctgacataggagttc

SEQ ID NO: 33793 - DNA, 76 bp, Chlorella protothecoides
atactttctaaaaaattctcaatgttcgaccaccctgtgaggggagtgccagaaccctcgcctgccttcacaacat

SEQ ID NO: 33794 - DNA, 75 bp, Chlorella protothecoides
aggttggtgactggattgatctgatcagaccatggtgtcccctctcagagggatgtccgcccatgcgcccgttcg

SEQ ID NO: 33795 - DNA, 64 bp, Chlorella protothecoides
ggcgcggcggtgggctccgcgctcgccctgtgggcgtgccgcggactcgcccaccagcgctgag

SEQ ID NO: 33796 - DNA, 140 bp, Chlorella protothecoides
cttaggaatgcggtgacctggcggggaagaccccttcccactgggcccactcgatgcagacagcatcaggagcatgggaggaatctgaccggtcgcccgtcctcccgaccctccacacacaagcagcacgcaccacagtg

SEQ ID NO: 33797 - DNA, 115 bp, Chlorella protothecoides
ctgtgggtgccgggcttgcaacgatggcagacgcttatgtggggaggcattgcctgtgatgtggcgggcatgagcacgtgagctgtgcacttgagttgcatggactgccacaccg

SEQ ID NO: 33798 - DNA, 77 bp, Chlorella protothecoides
ctaattttcaagcttctccatcaacattatattgcatggtattgtgaaattgcatatcacttcggtaattgggatga

SEQ ID NO: 33799 - DNA, 79 bp, Chlorella protothecoides
cccgaaagtcgggcgccagaacctgcgaatatcacttgagggactgtgtctcgtgcagaacttttcgaaggatgattcc

SEQ ID NO: 33800 - DNA, 69 bp, Chlorella protothecoides
gccgcagaccggcatccaggatctgcatgcgtagtgtatggagggggaggggggtcctgtctgcaagat

SEQ ID NO: 33801 - DNA, 117 bp, Chlorella protothecoides
gcaagatctgtacgcccttgtcggcactttcggtatgtttacatcgcacggtaccatcccttgaccaccttctgggagccttaccatcctcgtctctctccacccctttcaggcatt

SEQ ID NO: 33802 - DNA, 68 bp, Chlorella protothecoides
aggggcggctgtcacaggtgagggagcatgtttttttccgggccagcgctgcacgtggcagtgaaggg

SEQ ID NO: 33803 - DNA, 96 bp, Chlorella protothecoides
ggggacagtgtgcggggaggtgggccagatggcgcatcgagcgttaccggcctctcccctgcacaaccctctccaccccaagtggatcaacggaag

SEQ ID NO: 33804 - DNA, 7042 bp, Chlorella protothecoides
  modified_base (170)..(240): a, c, t, g, unknown or other
  modified_base (1771)..(1780): a, c, t, g, unknown or other
  modified_base (2897)..(2987): a, c, t, g, unknown or other
  modified_base (4723)..(4732): a, c, t, g, unknown or other
  modified_base (5335)..(5344): a, c, t, g, unknown or other
  modified_base (5571)..(5580): a, c, t, g, unknown or other
  modified_base (5654)..(5663): a, c, t, g, unknown or other
  modified_base (5737)..(5902): a, c, t, g, unknown or other
ggcgccgaggccgagcgccgcgcgcagcaggagcggctgtatgcgctggacgtggcgcgcatcgcggcgggggaagaccgccgcaccacgctcatgatccgcaacatccccaacaagtacacccagaagatgctgctggcggtgagcggcgaccgggctggggtcgggtnnnnnnnnnnnnnnnnnnnnnnnnnnnnnnnnnnnnnnnnnnnnnnnnnnnnnnnnnnnnnnnnnnnnnnntgggtgggtcggcctgacatggcagggccggggggtcgcgactctgtgccgtgccgggagtcctcctgtggccgcgggcctggacttgttcggccacgctgccctgcgccagcgccgctgacctgcaagcgcggtgcggccgagctgcatggccgctggtcgatgcgcatggcagcctccctggacctcggagcgtcggccctgtcgagcgaggcggagggcctcacctaagcgggccaaagcctcacagatctcaccactcaccatcctgccccccctcccccacaacacacacacacacaccaaccacctgcagctgatcgaggagcagttcaggggggcgttcgacttcttctacctgcccatcgacttcaagaacaagtgcaacgtgggctacgccttcatcaacatggtacgcccttcctccatcccggggctggtggcggagctgcacggcaagcgctggcccaagttcaactcggagaaggtctgctgcattacctacggccgcatccaggtgtgtgtgggtttggtggggggcgcggggacggtgtggggggtttacgttgaccgtcagggagggggactctggtgtcagccctctggcgcagggtggggcgagggagggcagggtgggccgcggccgcgatgagctggtgaggccctgcaccggccccaccgctccgtggctgggccaggcttggacgtctcatccgtctgagctctgggcgctctgctttctggctcgaccctgcgcatcacctccctcaagacccatgccccaagtctctcgaccaatcacatcctgcagggcaaggcggcgctggtgcagcacttccagaactccagtctgttgcacgaggacaagcgctgcaggcccatcctgttccacaccgagggcgagctggctggggagccagagaccttcccccccgagccctgacccccctttttaccagcagccgggttttccgggggcatcccggagggactggggaggacggcgttcgtcacccaccctctccccttcccctcccggcccccctcttcgcacttgatctctgaaatcgtgtttgcaccctgggtgccctccagctctttgttccgtgagggagagccacacccgtttcccagagccctgctggggggtcacagtgcagcacactcctgtttttgatcggtgggagagtctctttcctgccccaccacctttgtcctgagcgcaaggcgagagtgctccaggtcttccggcacggtccaagcctttgtggtgcacacaccacagaggcaggcgcgatcgccatggattagcacccgcgtcctggagtccattcctcccaacctagttgcaccgtcctctggcagctgatggcccttgtctcagcacgttctcgtgaactgtgcccccatgtttctccctcctagttactcaaatgaaatccgtctagtcagttcgtacagtatggtttaagagtatgtttgcgtgggggactgcagggttcaccctggtcagggcccgtcacaaggagannnnnnnnnnatctagtcagttcgtacaatatgggttaagagtatgtttgcatggggggctgcgggggtcaccctggtcagggcccgtcacaaggagaagtttcctccttctcctgtcgactcgggggcctggcagggtcctgcaggagcagggccacctcccttccaggaggggttgggtgtgtgaagctcgttcccaatattctggactgagggaaggctgtttggaagtggtgccattgggagaaaacccaccgtgcacccaacaccctcacctgaggcccaggtgcttgggctccgagctggaggttgcctgggaggtcagccctcgagcgcagttcaggcggtgaaggttctgctcgatggtgtcgttcatcacaaacctgggcgtggctcagggcagggtgcaaggggatgagggggggcgggtggcaagggatgtggcccagaggccccagcagggtccctggttcagtcccctccagtcagctttatcgcggcaaattcatcaagctcgtcgccatctggccctcaacacagccatgcacatgtccaactcagggttgatcacccgcatggctgaccagtctgcggcacgaaagtaactcactggcagcctgctgtgctgcacatcgcatcccaggtccagcctccccccggtcgatgccagaggcaggctggcccctccccctcgccgcctccccctccggtccccctttgtaaaatcaaccccactgtcccacctgtacacgtgcgtctctcgcagctggcccacgcgatctacgcgccccacggcctgagcctccagccccggcgagcgcagcggctccaccaggatcacgtgctgggcggcggtcaggttcagcccgttcccaccctgcttcaccagcagcaggagcacgcgcggcgtggcagagcctgcgccggcgccaggccccacctggaaggccgcgaaggccggggccagggccttgcgggtctgggggtgggcgtgcgggacggcgttgcggccgaaggcgtgctccagcaggcgcagcacgtcgcgccaggtggagaagacgatgatgcgctcatcgggaccgcattccaggatgtcctggacgcagcgcagcaccgcctccagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcgtggcatgctgtgcgcgcttcgtgactggcgtcgagtctgcggctgcaagcggttgtgctgtgcccactcatttctgctgctgttggcgtcatggactcggccgcatgggggccgtgccctggcggctagagaacctggcgtgagcagtacttgcacgagaggttttgttcccagccgtgcaagcttcccctttgcttccattttggtggcctgcagtgtgatagtatgagaatggcgtcatgatgtgcacgttggagtgggtgggtttgccactggtgtgcccatgcaacccccggacacgtctggcagcttccggacagttccaggggtcacgggatggttccaggtgcacgatgcgtgccccttggcgagggaaacccaaaccccgggccactgcacgccccccctagatacacatatataattaagcgcttcgataattactcgtaattcccattcattgacgatcacaacgcacacacacgtacggcatggaccccaacaagatcacgtccaaggtggcggagatggtgaatgcggcccgggacctggccctcgagtcctcccaccagcagataacgccctcccacctggccatagcgatgctggatgacaggcagggcgttcctgcccaggccctggcccgcgtcgggggcgaggaggccgtggcctccgtcctccgggtgctgaagaagggcctggtgcggcagccggctgtcgacccgccccccgacgaggcgtacctcagcaacgacctcaagaaggtgtttgccaccgccaccaagctacaaaaagccaagggcgacggattcctaggtgagtgcttttggtgggggtgggtgcttatggtctctggaagattccatcgtgcaggggagggtgggagcacagtgcaggcggtggggcaggtgtttgcccgacgtgtcatccaccatcacctcatgccaatccaatcaccccgcgccgccctcactcctcccttccattcacctcactcgctccaggcatcgacgtcgtgttcgaggcactgctgggcaacaaggtcgtggccgccgcgctggccgagtccggcgtgggcaaggcccaggtggagacggcgctggccgactcgcgctgcggcgccaccgtggattcggagacggcggacacccagtttgacgcgctgggaaagtacggcatggacctcaccgcgcgcgccgcggagttggaccccgtgatcgggcgtgacgacgagatccggcgcaccatccgcgtgctgtgccgccgcaccaagaacaacccggtgctgattggggagccgggcgtgggcaagaccgccatcgtggagggcctggcccagcgcatcgtgcgcggcgacatccccgagaccctcaaggtacttattatggggtgggggggtgggggggtgtttggtgggtggggtttggggtttcctggaaaagggggggggcgcacaaatggatgccggcacccatcgcccacacgttcccgccctcagaggtccatacacacaacccttccccctttccaatcctcaccagggcgtgaggctgatctcgctggacatgggctcgctggtggcgggggccaaataccgcggcgagttcgaggagcggctcaaggcggtgctgaaggaggtgcaggacgctgcggggcgcgtcatcctgtttgtcgacgagctgcacaccgtgctgggcgcaggcaagaccgagggcgccatggacgcggccnnnnnnnnnntgccgcggggcgcgtcatcctgtttgttgacgagctgcacaccgtgctgggcgcgggcaagaccgagggcgccatggacgcggccaacctgatgaagccgctgctggcgcgcggcgagctgcgcatgatcggcgccaccacgctggccgagtaccgggagggggtggagaaggacgcggccttcgagcgccgcttccagcaggtcatggtgggcgagccctccgtggccgacaccgtgcagatgctgcgcgggttgaaggagcgctacgccagccaccacggcgtgcagatcgcggaccgcgcgctcgtggccgccgccactctggcggaccgctacatcaccaaccgcttcctgccggacaaggccatcgacctggtggacgaggcctgcagcgacctgcaggtgcagctggagtccaagcccgaggccctggaccgcatggagcgcgcgctgatcgggctgcaggtggaggccaaggcgctggagaaggagaaggacaagcagagcgtggcccgcagcgcggaggtggccgccgagatcgcggccctgcgcgacgagctgcagcccctgcagatgcgctaccagaaggtgagagctggggnnnnnnnnnnagaggtgtgtgcatgaaacagatatctctcacccttgcgtcaaccagaggccagcggcggcttgcatggcactggcctatcccctatgccggtggccatttccatcccgaccatcccagcccaccctcattccacctacttccacccaaccaggccaaccccacctctcaccaacaaccccccccaccacacacaccaactcaccaggaaaaggcgcggctggaggnnnnnnnnnnggcgaagtgtgtgtggggaagggtgttctgagtttggagcgttcctgagtgacactggtctggtgtctgtggcnnnnnnnnnnagcgaggtgtgtgtggggaagggtgttctgagcctggagcgtgcctgagtgacactggtctggtgtctgtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccaacctcacctctcaccaacaacccccccaccacacacaacaactcaccaggaaaaggcgcggctggaggagatcaaggcgctgcagaagaaaaaggaggagctgagcatccggctggagcaggccgaggcgcgcatggacctggccatggtggccgacatccgctacggcgcgctgcaggaagtgggcgaggccctgcgcgccaagctggaggccgcggcctcgggcgacagcatgttgtcggatgtggttgggcccgagcaggtggccgccgtggtctccaagtggaccggcatccccgtcaccaagctgcaggtgggtgttgtcattggtggtgccttggttttgggacaagcttgctgggcatgcgagcgcaaggcctggcgcaaatcgggcggccaacagcgtcgagcatccatcggtcgatgggcttggcgccgcctctcctcccaacatgctgttggctcgcacgttcttgcccatctcgcagtcctctcacgccgcgcctcgagcccagacgcgcctgctccacctctccaaactcccaactcactcactcactcaccgctcacccccccgcagtccaccgaccgggagcggctgctgaacctggaggcggagctgcacggacgggtggtcggccaggacgaggcggtcaaggcggtggcggcggcggtgctgcgctcgcgcgcgggcctgggcgcgcgcggccgcggctccagcttcctcttcctggggcccaccggcgtgggcaagacggagctggccaaggcgctggcggccgcactcttcgacagcgagcgcgagatggtgcgcctggacatgagcgagtacggcgagcggcacagcgtgtcgcgcttggtcggcgcgccgcccggctacgtgggccacgacgcgggcgggcagctgaccgaggcggtgcggcgccggccttactgcgtggtcctgctggacgaggtggagaaggcccaccccgacgtcatgaacctgctgctccaggtgctggacgacgggcggctgaccgactccaagggccgcaccgtctcctttgccaacacgctgctggtcatgacctccaacctgggcgcggcggcgctgctggccggcggcggcggccccgccgcgcgcgccgcggtg

SEQ ID NO: 33805 - DNA, 61 bp, Chlorella protothecoides
cctcactgcggcatcggcccggacaacccctgcgggccccttcaagcgtcggagcatcgga

SEQ ID NO: 33806 - DNA, 97 bp, Chlorella protothecoides
gggccgacggggcagctgcgcccgcgccctccttcctttcccttggcgccgcgaccgacgccgcgactggcgccggctggggcctctcggctggcgc

SEQ ID NO: 33807 - DNA, 76 bp, Chlorella protothecoides
tggcttgtcgactggcactacctgcacctcgcgcgcctcctacagggtagattgatcttaaggaaagctatcagaa

SEQ ID NO: 33808 - DNA, 61 bp, Chlorella protothecoides
cgcctgttgcattcatgatcagaacgggacgctcagtacccgctccttgcaccccactctg

SEQ ID NO: 33809 - DNA, 73 bp, Chlorella protothecoides
tgggcgcggcgagcatgtatcttttgggggtgggggcggggttaagctgccaggcagcatgggccggcatcag

SEQ ID NO: 33810 - DNA, 61 bp, Chlorella protothecoides
tgacatggatgctctccagatgagggtccacgccctgcccgagcctacacaatgcgccctg

SEQ ID NO: 33811 - DNA, 79 bp, Chlorella protothecoides
attcagggtgatgtctgatcattccgctgcctgtgagcatggctgccatggaggggctgcaacagccatccgcatcagg

SEQ ID NO: 33812 - DNA, 61 bp, Chlorella protothecoides
ggagacacttggcgatgggccgggcctccgtagcgggggtggtttcccgccacggatcccg

SEQ ID NO: 33813 - DNA, 253 bp, Chlorella protothecoides
caggccaatgattgttggagtgctgggtacgtggctccctgacagtaatccagccacgctttgggggcatcgggcaggagtggcagggaggctgaacgcatccatgccgtctctggtcgtgttctggaccctgcacacggctgggtgctcgttcggtgacaactcgatgtatggaaacccccattccatgcttcatcagccagccatcccggagagagctttgtgtccatgcaaccccaaggatctacaccac

SEQ ID NO: 33814 - DNA, 61 bp, Chlorella protothecoides
cactccgcggcgctgaccaacaacggcttcctgttcacctggggcgccaactgccagggcc

SEQ ID NO: 33815 - DNA, 80 bp, Chlorella protothecoides
cctactttaggtcatatacagcggtccacggtgtggggtctagcccggtgccaggcggcgtagagggatgcaggtggaat

SEQ ID NO: 33816 - DNA, 61 bp, Chlorella protothecoides
agagcctgcgaggggggtgcagagggtggttgagtgggtgggggtgcggggaggtgagtgc

SEQ ID NO: 33817 - DNA, 61 bp, Chlorella protothecoides
cgcatcccagggcacaaggttgtaggggacgagggagcggtgcataccatgactacatgtc

SEQ ID NO: 33818 - DNA, 3255 bp, Chlorella protothecoides
  modified_base (185)..(194): a, c, t, g, unknown or other
  modified_base (700)..(709): a, c, t, g, unknown or other
  modified_base (899)..(908): a, c, t, g, unknown or other
  modified_base (1167)..(1176): a, c, t, g, unknown or other
  modified_base (1398)..(1407): a, c, t, g, unknown or other
tggcgcaccatatgcccagaccttgtcgataataaacacatttcattcttaaggggattaaagtgggagctgtcgaggagggccccgactgcatgtgggcagatgtgcaggaggacaaggaggctggagccagcagatcgagttccgtgagatgcatgattttcttgttgcagcagactgcatcnnnnnnnnnngcatttcatttttgaggaatttaagtgggagctgtttaggaggtccccgactgcatgtgggtagctgtgcaggaggacaaggaggctgcagcgagcagatcggagttccgtgaggtacatgattttcttgttgcagcagactgcatctgtacattcattctattaccacccatgcacccaatcatgtctggtccaagccagcattctgatttatttaggcattcgaaaccaggtgcaacgggcccgccctggggttgagagaggtagcgatttctggggcacacagcctgcacacacagacgtcgggctcatcgcgatgtcccatttcagcaccaagaggaggcgcagcaaggggcggaggccaatgccagacccgaaactcacaggttaaaccggtactgacctggctccaacacggttggagcctaaaccctttggacaggacagtgccactggcctatcctttgtggacagtaacagcgcaccaacattactgctgagagcannnnnnnnnnatggacaggacagtgccactggcctatccctcgtggacagcaacagcgcaccaacattactgctgagagcattccacgcaacccccgcccaccagatgtcaatgcagacgtcgaccagaatcataagaggctggcgccatgggtagcttatatcgtagggaagggtgtgggaggagcgtaatgctctgtnnnnnnnnnngggcgatgcagaggttgaccagaatcataagaggctggcgccaagggtagcttatatcgtagagaagggtgtgggaggagcgtaatgctctgtacatggccctgacggaagctgtgacgctcatgctactgaattggccaacagagaccattccttgtgaatggcgcatcgaggacagagcagggcatgcatccgctccaacgtggagggcgaggggggagggagaaggggcggtacacagcttcagcaggcaaatgannnnnnnnnnccgacgacagagcagggcatgcatccgctcccacgtcgagggtgaggggggagggagaaagggcggtacacagcttcagcaggcaaatgaaggccaaggtgaccttgttcctgctgtaagtaccatactcgtcaacagctggaccatgatctaagcaggtggggagggcgaagaatgtgggatgcgccatgttgggcttgaaggggcccgacgggcgacagnnnnnnnnnnaaacgatactcgtcaacagctggaccatgatctacgcaggtggggatggcgaaggatgtgggatgcgccattttgggcttgaaggggcccgacgggcgacagcggtcatggccaaggtgtgccatcttaattctataacccctgcattcgatgcaatattatttcttatattgacggactactgctattcgcccggtgttgggcatatgcatccctccggtgggcaacggcaagaccgtggaaaattgcctcaacgggagctaaattctgggctatcttcgaactatctgaaagcacttgataagaatgatttgcaatgctctaacatgagccggctggggtggcggacgagcctcgtcctgaggatggcctatctgagcaacacgactcctccgtccggacggccgctgcaagtacagccttccgaggcctccaccccccacacccccaaatgctggattgagtgattacgacagtgtgaaccatgccaattgcatgttgatgtaccatacacgagtgttagccacgctcgacgcccctgctgggatgctgaggacgggatcctgaggggagggtcccgctgtttccgacgggtctgacactggagcccgggggatgggctggtcgacagctgcgctcgtcgcctgtgggctcaccctcactctcggcgccgtgtgtgcatctgctgtgagtggcgtgagcgacgtgggtgccgtctgctgatcgggcctttccccctcctcttctagacccctccccgcatcgccctgccccgcccacccccgcaggacaacgcacccatcgtgctgaactacatcatgtgcatcagacccatggtggatggcaagtgggctagctacgtcacctgcacggccagtgtgaccctggcggcgctcaccccccatggcgtcaacgtggcctacaccctagggggcctgagcgccgacgtggcctactccccctcccagctcacctcctacaccacctggacggtacagcagcacacgatcgccagcgggcacgcatatgcctggtgcaagtccgccgcgggcgacaccctggactccgccaccatccccgtctcccctttcccctccccgccacccccctctccgcccggccagggcaggccgccgccctcgccgcctcccgccccgtcccctccccccggacccccgatctcccttctcgccgcgcagtgctcttgggcctctaaggacgccgtggagtgcaccgccacggcggccaccgtccagctcccggccgccgtgtacctgcagtggaccctgggcggcgtccgcttcgccaccagctacgcgcccaccgccctgcagaccaccgtgcgggagggcttcggggcggcttccgccgccggcacctgcttcgcctacatctacgacgccgacggggtgtaccacgagtctgacctgctcgccctaaccgacctctcccctccgcccccgacctcgccgccctcgccgccgaccccgccctcccccccaccgcccacgccgacggtgtacctgagcttcgctacctgccagcgggcgacgggcgaggcggtggagtgccgggtgcaggttgtcaccgagatgctcatggcactcgtcaccgtcgtctacgagctcgggaactcgaccctggccatgtcgtacgcgcccaccggcctggtcaccacccaggtcgccagcctggcagccgcctcggtggagggcactgccgtggccctcgcacaagacaatgagggccatcagtaccagtcgagcacggtgcccatcaccgccccttcgccacccccagaaccccctcctagtcccccgccaccggcaccctccccaccgccccccc

SEQ ID NO: 33819 - DNA, 61 bp, Chlorella protothecoides
gccgccctcctgcgcctcgggggtgacatggccgatcacgaagccgtgggagccgccggag

SEQ ID NO: 33820 - DNA, 75 bp, Chlorella protothecoides
atcatccgcgcacgagacccacctgtagaaaaaattcctgtcaaatggttgcagcgccgcatccgcgtccgcccg

SEQ ID NO: 33821 - DNA, 74 bp, Chlorella protothecoides
gctcagcggagagacctgtggattcaggggaggaacagtggagttgaagtgatggagcagcggcagaatctggc

SEQ ID NO: 33822 - DNA, 61 bp, Chlorella protothecoides
attctgctcaccgacacccttactgaccgtgaattgtctcagaatggtgcgcttcgatgtc

SEQ ID NO: 33823 - DNA, 5282 bp, Chlorella protothecoides
  modified_base (962)..(971): a, c, t, g, unknown or other
  modified_base (2007)..(2016): a, c, t, g, unknown or other
  modified_base (2516)..(2525): a, c, t, g, unknown or other
  modified_base (2801)..(2845): a, c, t, g, unknown or other
catgctggaccagctgcagaaggtgcggtgatggtcgaggttgcttcgcgggagggggggggaagggtgtccgtggggctggtcatggccggggggagggtgcagcccagcgtgggcatgcatggcgggaggtggcgctgtgaggggcggtgtgcgtctgagggcccgaggtggggggttggggcgcacctggtgcgcccgggcgcagggacggcgggtcgcagacttccacgtctcgaccgcgcctgggaggccccttcggggggcgtgtgcatcgcatcgctcgatggacaggatgatcgcaggtcggtgaagcccccgtcagacccgacccgagtcctcacccgccgcggcgcctgcaatccccaccccttgcgcaggaggccagcatcatggcgcggttgcggcaccccaactgctgccagtacctgggcctgtgcctggacccaccctccctcctcatggagtactgctcgcagcggtcggtggacaccatcctctccgcggggcgcaccgacaccaaggtacatgcgcgggcgggggcgtggcggggggtggcgctgtggggtttggaagggagccgagcaggccggcgatccctccatgctcactcaaccccttcctcctcgtcccaccaggttgccaagtcgctgtcctggccgcgcctgctcagcatggcattcgacgctgccaaggtgagcggtgggcgcaggggtggacgcgaatgggtgtggagggaggtggtgactgaggcgctcaggcaagcacctgtgcattggcaacgatcgcttggcggcgtgccgggagccgatgggggagcgctcccagatgggaaccgagacttcacagcttcggcgccagtggtagcactttgcgccaccccgagccaccccgagccaccctcaccagcccatgcccccacccaaaccctttccagggcatgctgtacctgcacacgcggnnnnnnnnnnccgcaccgactccaaggcacatgcgcgggccggggggtggcgtggggtggcgctgtgcagcttggaaagaagccaagcaggccggcgattcctccatacctgctcaccccttccttcctcgacccatcaggttgccaagtcgctgtcctggccgcgcctgctcagcatggcattcgacgccgccaaggtgagcagcaggcgcatgggggggggcgagcgggtgtggagggagggggtgactgaggctcccaggcaagcacctgacaatcagtgcttggcggcgcgccggcagccaatgggcgagcgcctccagaggggaaccgacgccttggagcttcggcgtcgacggtagcactccgcgccaccctgagccaccccgagccaccctcacccgcccgcgcgcccacccaaaccccttccagggcatgctgtacctgcacacgcggcagcctgccatcatccatcgcgacctcaagtctgcaaatctgctggtggactcccagtggcacgtcaaggtgcgagggtccagtgggaggggatgggggggagtaggatgggggggagtaggatggggggagggggggtccattggggcatggattgcatgagtaggtgaggtgcagttctctgtcggcacttgcattgtcacatggggcgcagcaaccagagggtctcgcatgcatcccgccgctcgctttggggaggcgtctcctgcagcccctgtccttctttccttctgcggaaccacccaaccctgaccccacggccacgcccctgcagatcgcggacttcaaccttagcagggccatggagagtgaggtgatgatgagcaccatctgcataaccaaccccaggtagggtcgctgggtcgtcgcactccctgccggcgctggactccgtgaaatccttgacacatggtcggcttgagtttatcaactcactgcccctcaccaccgagcaagctgtctgcaggccagctcacgcaccaagtccaccacactctcatgcaggtggctgtcccccgagatcctgaagnnnnnnnnnnggctgggccgtcgcgctccctgccggcggtggactctgtgaagaaactgaatcgtggccggcggcttgagtttgtcgactcactgcccctcgccaccgagcaagctgtctgcgggcctgctcacgcaccgcgtccgccacacacgcgtgcaggtggctgtcccccgagatcctgaagggcggccaggccacgttgcagtccgacgtgtgggcctttgggacggtgatgtgggagctcatgacgtggcagctcccctttgagagcatgaacccgtaccaggtggggcatgtggctgggattctgtaggcagggcgggcgtggggctggggccaatggcttccatgcgccaggcatgccgacccccgtctgaccggggcactcgaatcgccacggcctgcctcgaccgggtgcttgggcgcgccaacccatgctgcacccctcgctcaccctcatcccctccctccccatcaccccctccgcatttcccctgctcacccccnnnnnnnnnngatgacgtggcagctcccctttgagaacatgaacccgtaccaggtggggcatttgggtgggattctgtagggagggagggcatggggctggggcaaatggcctccatgtgccagggatgccgcctcctgtctgagcagcgcactcgaatcgtcacggcctgcctcgaccaggtgcatcggcgcgccgacccatgcggtacccctctcgcaccctcatcccctccctccccctcatcccctccgcatctccccttctcaaccccccccccccccccnnnnnnnnnnnnnnnnnnnnnnnnnnnnnnnnnnnnnnnnnnnnntcgcagatcatcaacctggtgcagagcagcggcgcgagcctcgccgttcccgagcccagtgccatgcccgccggcagcttccgggggtacgagccgtacgtggcgctgatgacgcggtgctgggagatcgagcctgccgcgcggcccgagatggccgaggtcgcggcccgcctgcgcgacatcctgcgctcggagctgctggcggcacgctcccggcgcttgcgctccgggcagctgccgggcggaggcgtgccggagccgcagcagcgctacgcacgcgtgcgcagcgctgcgcccagccctttctcccaggggccctcctccgccgaggggtcgctggtgagcgagggcgggctgtcgccgggcatcggcttcacgtcgggcaccgcgtcggggacgccgccgggcaccgcctcgaccacgctcagcggcagcctcgaggtggggcgggggccggcgggcgcgccggcccccgccgcgcccgctgccgtcgacgacgccgagctggcggagaggctgggcagcaacgagcccgcgtttctctgaaccatcgaccccggctcccccggcgggtgtccccggcccacgtgatcgcgacagcgcgcagagttgttccctccgcacctgtctgtaccccttcctgtgtaagaacaccttcttcgagtgtcccagggtcagggtcaattcccatctgtgggacgcccatcaggagcagggcccggcgaggtgtgggaccatggccgcactgatgattcgccgggcttgctggggctcaagcaggccctgcaaggatgccgccctcgggtggaggtggtagccacaaggaccatgtgggggtgatgcagggggcaggagggaacgagatccaagggtgggcccgcaccaaccgcccgtcggatgcgctgcatcagtcgggtgcacctgggataacatcaacatgtgcacggctccgttgctgtcgcggttcatgacagggaccatgaggtccctgctgctactctgctccatcccccaagcgtccgccagcctctccacgcaatgccacacctgactgtactggtgggtgtgccgagtggtgcgaggggcgcggcacagcttgggagtcctgcgctcgttcacgaccacaacactgcacacccctctgcaggtggcgcaggaagctcattaatgggcctggcggatgccctcgcatgaacaaccctcggagccctccactcatgcccatgccgtccagttgccgacgcccacaatcgtcatcttcttgcgggggccccggaaagaccctgcaagcgtcatgattgctcgctgtcggcgggcatgcgcctggaagtgcagctggcggaatggcttctccataccccactcctgcccaggtgcaatggcagccgacgtgcctgccactcctcagctccaagcgggcttcgtggacgatgcaccacagcatactccagctgatcaacgcttttggcagccatctccatctggtctgtcatctcgtcgaggagatgacggaagtgcttcaagtttggcagctgatgagttctggcctcctcctcgcacgctcgttggaagacagctatagactcagccagaagccaacttttaagagggaaaggggatactgctggcaatgtaggggacaggacccttgaccttagggtctgagcaaaccttactctgtcaatgtcccacgtgacccacatattgtccaggaagagatccatacaatgacacaccatggcagcttgtgcaagatccacgagggcaggatgacctagctctggcagcaggtcaagggatgggggatgtaagctttgcatgaagggggggcaatcggtatcacaaattgaaaatatgcactatcaatgccacaagaacccctgctggacttacaccagctgcatgggggcttctgcagataccagcccatgcgcaattagttttggtcagccctgatggctgactaatgggaggaaggaagggggcaagagggggaggggaagacgaggatgggtgcccaccaaaaattgcggggcaaggcgcgccagtcagatagagcttgagcagcatcaggacgtcgatcgcaccattgacatcccggttgacgaccctgacgttgcacgcccggttgtcgcagcgtttggtgccccaggcctcctccgtctcctccacgcccttctgcacctgcctgtagcggtgggcactcaaggcggtgtggcagccgcagcacatcttgacgtcatgtgctcgtcaaccaccaccacctcgcaaaccctccgcaggcggcgagggaagcgcatccaggggcgccggcaagtgtccccgcatcacccctccacggtcctgggcggaccagttgcccactctgacgacgtcgaccgtaccgggagggaccctgaagtgctcggcgagctgttggatggcccgctcgcgctgg

SEQ ID NO: 33824 - DNA, 146 bp, Chlorella protothecoides
cggtgggcgtgcatgctttcttagatactaatagtagagaggtggaggggggtgtgcgcgtgctgggggtgtcgcagggaaggaggggaaggatcctcaccggtcgcgcttggaaaatcataaaaccgtcccagcccgtgctggca

SEQ ID NO: 33825 - DNA, 79 bp, Chlorella protothecoides
agaatgcatgtataccttctgccagccaaaatctcctccacctgcgtcgttgatggccagcatctcgatgcgctggcag

SEQ ID NO: 33826 - DNA, 61 bp, Chlorella protothecoides
tggttgcggacgaatgctcggctggcgggggaactggggacgacacgcttggtccgtacct

SEQ ID NO: 33827 - DNA, 67 bp, Chlorella protothecoides
ttcctcacattcacatcattggtgccatgcgtgctgccgatccacacagggcggccatgcgcacagt

SEQ ID NO: 33828 - DNA, 62 bp, Chlorella protothecoides
ggataagagagcgagcgacatgacaatacaagataccaaacagtgcacgacactgattgcaa

SEQ ID NO: 33829 - DNA, 34187 bp, Chlorella protothecoides
  modified_base (384)..(393): a, c, t, g, unknown or other
  modified_base (1615)..(1624): a, c, t, g, unknown or other
  modified_base (1851)..(1860): a, c, t, g, unknown or other
  modified_base (2168)..(2339): a, c, t, g, unknown or other
  modified_base (2815)..(2824): a, c, t, g, unknown or other
  modified_base (3060)..(3069): a, c, t, g, unknown or other
  modified_base (3523)..(3532): a, c, t, g, unknown or other
  modified_base (4049)..(4058): a, c, t, g, unknown or other
  modified_base (5401)..(5410): a, c, t, g, unknown or other
  modified_base (7336)..(7345): a, c, t, g, unknown or other
  modified_base (7430)..(7439): a, c, t, g, unknown or other
  modified_base (7586)..(7595): a, c, t, g, unknown or other
  modified_base (8215)..(8224): a, c, t, g, unknown or other
  modified_base (8626)..(8635): a, c, t, g, unknown or other
  modified_base (9116)..(9125): a, c, t, g, unknown or other
  modified_base (9608)..(9617): a, c, t, g, unknown or other
  modified_base (9788)..(9846): a, c, t, g, unknown or other
  modified_base (9950)..(9959): a, c, t, g, unknown or other
  modified_base (11255)..(11264): a, c, t, g, unknown or other
  modified_base (11515)..(11524): a, c, t, g, unknown or other
  modified_base (12195)..(12204): a, c, t, g, unknown or other
  modified_base (12752)..(12761): a, c, t, g, unknown or other
  modified_base (13590)..(13599): a, c, t, g, unknown or other
  modified_base (14240)..(14249): a, c, t, g, unknown or other
  modified_base (15012)..(15021): a, c, t, g, unknown or other
  modified_base (15553)..(15562): a, c, t, g, unknown or other
  modified_base (15979)..(15988): a, c, t, g, unknown or other
  modified_base (16420)..(16429): a, c, t, g, unknown or other
  modified_base (16942)..(16951): a, c, t, g, unknown or other
  modified_base (17714)..(17809): a, c, t, g, unknown or other
  modified_base (17954)..(17963): a, c, t, g, unknown or other
  modified_base (18153)..(18409): a, c, t, g, unknown or other
  modified_base (18537)..(18546): a, c, t, g, unknown or other
  modified_base (19488)..(19497): a, c, t, g, unknown or other
  modified_base (20211)..(20220): a, c, t, g, unknown or other
  modified_base (20462)..(20471): a, c, t, g, unknown or other
  modified_base (20869)..(20878): a, c, t, g, unknown or other
  modified_base (21513)..(21522): a, c, t, g, unknown or other
  modified_base (21718)..(21727): a, c, t, g, unknown or other
  modified_base (22197)..(22206): a, c, t, g, unknown or other
  modified_base (22875)..(22884): a, c, t, g, unknown or other
  modified_base (23551)..(23602): a, c, t, g, unknown or other
  modified_base (23931)..(23940): a, c, t, g, unknown or other
  modified_base (24251)..(24260): a, c, t, g, unknown or other
  modified_base (24334)..(24343): a, c, t, g, unknown or other
  modified_base (24406)..(24415): a, c, t, g, unknown or other
  modified_base (25327)..(25336): a, c, t, g, unknown or other
  modified_base (26163)..(26172): a, c, t, g, unknown or other
  modified_base (27569)..(27578): a, c, t, g, unknown or other
  modified_base (27758)..(27767): a, c, t, g, unknown or other
  modified_base (27880)..(27889): a, c, t, g, unknown or other
  modified_base (28652)..(28661): a, c, t, g, unknown or other
  modified_base (29897)..(30043): a, c, t, g, unknown or other
  modified_base (31065)..(31074): a, c, t, g, unknown or other
  modified_base (31698)..(31736): a, c, t, g, unknown or other
  modified_base (31907)..(31916): a, c, t, g, unknown or other
  modified_base (31979)..(31988): a, c, t, g, unknown or other
  modified_base (32048)..(32166): a, c, t, g, unknown or other
  modified_base (33049)..(33058): a, c, t, g, unknown or other
  modified_base (33490)..(33543): a, c, t, g, unknown or other
gggggtccagcgggaagccgtcgccgcggaagaagccgcgcgcgaggcgcgggcggccgcggcgcgagaggccgcggcggccgaggcgcagcgccagaaggcgctgcgcctctgggccatggtcaccgcggtgtgcaacaaggacaagctgccgccggcgcggtggaaggaggtgcaggccgccaaggaggtgcgcctggtggagctggagcagcgcctgggcgcgcaggccgcggagggggaggtgaggggggtggagatgcagggtttaaggggggttttcatgcggggagagggaaggggaggggaggcttcgcggccgcggagccgggcaaaaatcgtgtcgagtggcgttgtcctgaccccgcgcccctcgtccttttnnnnnnnnnnaggggtggagatgcagggttttaggggggctttcgtgcgcggagagggaaggggaggggaggcttcgcggccgtggagccgggcaaaaatcgtctcgagtggctttgtcctgaccccgcgcccctcgtccttttcccaccccatccccccgccctcgaaaccatccgacaggcgtcggccggcgcgcagcaggaggagctggcgcgggccaccgcgcgcgtcaaggagttggagatccggctggagagcgtggagcaggccgccgccgccgccaggagcgagctggccgctgccaaggcccgcttcatcgccaacagtgcgtgggaggttctgatggggcgagggggtggagggcctgttggttgagagctcgtggggcctcctcttggtgcccgagggtgtgtgatgagggggtgggggaacggtgcgtgctcagagctccatgaacggccttgtttggctcagatcagaccatgctcatcgactccagtgtcctgaggtcagggcaattttgtgcctcatcccggattcatgattcagcggcggggctgcgcgacagcagcgtcgaggcgcagagggctcgcccagccccgctcacacagccagctcatcccaccatggcaccgcccgtcttccccttactgcagccaagaacttcacaaaggcgagggaggccaaggacgaggcgatgcggcagcaggagcagcagctgcgcgagcaggtggccagcctcgacagccagctgcaggcggcggcgagggagaagagcgaggccgtgcggcacgcagaggtgggcgggggccggggtgataacggccggggtgcggcgagagcgcagacgaggggctccctgccgtggcgcctgtctcgtgtcttgccagcgagcgctggcgctttcattgaagcccctcacgtgcacgctttctcgacgccagggcctggaggcccggctcgtggcggcccaggcggcggcggcgggggcctcccccaccaaggccagcccagggacgagggccgccagggcaaaagccatggagggcattcgcgccggggcccaggccaagctggcggccgacctggagaagaggaagctgggcgggggtggcgcagagggcgccgacgtcgagggcgtgcaaggtggggcgtcgcgcttaaagggtggggtggccctacggtgactggcagtgggaacgttgggggaggttcattcctgcgaggaagnnnnnnnnnnggagggcgccgacgccgagggcgtgcaaggtggggcgtcgcgcttggagggtggggtggccgtacggtgactggcagtgggagcgttgggggaggttcattcctgcgaggaagttgcaagtgtgtctgccaccctgtacacccccgcagcaggcccccacctgtttatccaaccccagtttcgcctccgaccctctgcgcgcagaagctgcgccggctgggaagcgnnnnnnnnnncgcagcgggcccccacctgttcatccaaccccagtttcgcctccgaccctccgcgcgcagaagctgcgccggctgggaagcgggcgcgtgtcgacccggaggagcgggcgcccccggtcgccgagcctgctgccgcgccgggcgaggcggcgccgtctgtggaagtgcccgcggtggcggaggcagaggaggccgacggccaggcgggacccctggtccaggaggtggaaagggtggaggccgtgcaggtcgagcctgcctccgaagaggacgatggtgaggcgtgtgggttcacgaggggcagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagccatggcagatgcggaggccgcgccggaggaggagccctcctacctcgtggaagtcccccccagcgccgagccgtcggaggctggcccgcccgatgccatcgccgaggagtctggcggtgaagaggccgagggcagaggcgcaggggaggcggagatgcaaggagctgaggacgcagtagatggggagggttcggaggctgctgcacagccggaggggggtgtcggagaggagcatgaagtccttgagccatcggcgtccgcgcctgagggaccagtctccaccgtggaagacccagtctctgccgtcgaagaagagccgatgcctgtcgatgaggagccggaacatgccccggaggaccctgcccaggccgtagaggagccaggagctgccctcgaggcacatcaaggcgatgacaccccactgctcgccgatccgccagcggctcaggaggcagcggaggaagctctctnnnnnnnnnntcaggagcagccctcgaggcacatcaaggcgatgacacgccactgctcgccgatccgccatcggctcaggaggcagcggaggaagctctctctccagtagctcacaacgaagaagagcagggaggaggtgcgaaggagttgagagggcgattggggaccggccatggggttgccctttttcttcctttctgggttggggcctgcctaaggctgtggagaggtttctgctgcgagtnnnnnnnnnncgagagggcggttggggaccggccatggggttaccctttttctccctttctgggttggggcctgcataaggctgtggagaggtttctgctgcgagtgcgctagaagcctctgccctttggttgagctccaccactgggatctcatgttatcgcctccattgctgcactggccacaaagcctcctccctggcccaacccaccttcgcatgccacccctctcccagcagatgctggcgaggccgaggggctcgcagaggaagactttctcgagtatgagggtgagctcgagctgaccgacggcgaggccaccggggccgcggtcgccgccaccgagcccaccgctccggtgggccccgagccgagtgcagcgcagcagcctgcagtggaagctcccacgaaacccatggcagggagtcctgggctggcggccaaggctgctgacgcagggggtgcnnnnnnnnnntgacggcgaggccaccggagccgcggtcgccgccactgagcccaccgcaccggtgggccccgagccgagtgcagcgcagcagcctgctgtggaacctcccacaaaacccgtggcagggagtcctgggcgggcggccaaggctgctgacgcagggggtgccaatgtgcaggccagagcagaggacagcgtggccccggcctctgcggcggaggagcccgcgccagacactggcgccacgacccctcagcagcgacgggccggggacggcggcgagagcggtgcggagcgccgcaagaggcagcgcagcaagatcaagtggcaggcgccgccgctgggcgcgggcgccgccgcgagtccgggcgccttgcccagtgcgggaacgccggctgccgccgctgccgcacccaccccgccgcctgcggcgggccagtcgcccagtccccccctcagccacccaggaggtgcatgttttgttggtgtgatttcggggatgccgggctggtgcacagacctggtnnnnnnnnnntgccgccgcgagtccgggcgccctgcccggtgcgggaacgccggctgccgcagctgccgcacccaccccgccgcctgcggccggccagtcgtccagcccccccctcagccacccaggaggtgtgtgttttgctggtgtgagattggggatgccgggctggtgcacagacctggtggggcaggatcgtttctgagctcctcgcccaaccccagctcatgcgcattcctcttccttttcatgcaggcgggatccgtgggggccgcacggctgcggggcggcaggcgctcctgaggggccgcggcgggaggagcatacgaggccggggcggaccaccccacccgcccacgcccccaccctcctcatgatctgcaaggcactccagggactgccttgcgcatccctgcggtctactcttttccgatgcctgactccatgattgattcgttgttaagtgacaggcatcagtgcagacacattcaccaggctgcttgggcagggggggcagtggggggggcaaactgacgaccgagcctctctcaggctgtgtgctgcgtgatggatttctccttggccgccaccagggcatcgacctgggcaacaaaggaggatgtcacctcctgcacctccttctccagccggaagcgctcgtcctcggccgttactttcttcacctcgtccaaggccgcctagtgtttagatggaagagggatggccagtgcttgtgcctccacaggtttccgatacaagtgcagccccaggaacaatccatgcagggtgaatgacgggctatatgccttgcggttttccactagtctgggacatagattatctgagcacctcccaagtcctcttcccatgaaggcctaccttgcgacactgccgaatcgtcaccttggcctgctcaccctcggtcttgcacaccctcttcagtgctgtcagggtctctgcagtcggtctgcatgccggagaggaggggggaattcatgcaggcacgcttttgtccagaggtactgccccactcttgccctgccagggcagcttgagcaaaaccaggccaccatggaacttctaggactcgctgcccgcaccggggcacggggatgagcagatcctgtccctccacccgaggattcaggcccagtggggaatcacggatcgcattctcaacactgtgcagagtctgcaaatcaggggagggtgggaggtgctggtgtgaacgcaatcagcacattggaggggcttctggaggtctgcagccgacttcaaaggcccgccatcgccatttaaaatagcacgtcgcacattctaagaaaacggccaactcgcagagattccttcaagannnnnnnnnntaatgaggggagggtgggaggtgctggtgtgaatgcaagcagcacattggaggggcttttggaggtctgcaggcgacttcaaaggcacaccatcgccatccaagatagcacgttgcacattctaagagaacggccaactcgcagagattccttcaagagcgccaaaccccctcgcaatcacctaaacttgatccctcacccacctgggggtcgaacacattgaaaacaagcaactgtgggtcacgcacagtggccattccgcatgccttcatgggcatggagtccccgtacacctccaccttgaggtggtccagcatgcctgcagaccgggcggcgaccagagaacgcagcgggtgaggatgatatgtccccgccttgagaggggaagtgcaagagtgcacgggaagtagacctggagtcgcgccatgtggatcattggaacaccttcaatcctgccccctctcttcccccctctgtgaccaaggcaggcccaaccccttccatttgcctgcagtggctcgccccgtcctaatgctggacagctccttctgcagatgctgcaatgcatgctccatgcacctggtgttggcagtaggtgtgcatcagccatgtcaaccaataattgccctgatcgggtacattaccaactgctctgcgtccaaagcacactgctcaaccctcactgcttagtgctgcccatgtcaaagtcctctgtagagctgctagatgcggcaggaggcgttgcgaccttcttccctccttctgtatcatgaaggtagatttggcgactgatatccttccccctagcccaaatacccagaagcaagccgatgttatggcgataccacagggtctgccaccatgcagcctccacccctggacactcactcttggctgctttggagtattgtgcggtttgtaagactggtttgaatgcaacggggccccatgctgccaagctcaaaggctcggtggcagggtaccgagtggagatcgactcagaagctggctgggaagcactgcggcgaggaaggggaacagggtgacatcatgagcacgagaagctgagtttggaatcaattcattcctcttcagaaaacaccttctaaacctattaccatgcgatggccgcgatcaagtgtcgggatgcgcgctgagcacaccgcaacgtcagcatcgtctcggggctatgccaagggcaccgaaagggtatgcctcaatccagcaatgggtgagattaatagtatcaatgaacaatttcaaattatcgatttcatgcctgatgcattctctcgatccaagctgggccactcggaataagctgtgtcggtgccatgctgtgcctgctgtcgggccacacaaaggcagtcggccacatctcgcttctacttcccacatccaggtagcgcagatacccaatgatgccatggcacctcgtcactacaggccggtcatgttcccttgttcgcaagccaggcggtgtacttggcacaggcagcggggagcgagccttccacctcggtgtccgccacggtctcgtcgccatgcacaagcaggatgcgcatattcaggtccaccggtgagccaggggggatcctgggcccggcctccagtgcctccctgtaggccacctcttcctccgcaacctgaaggtgggcgacatgatgaccgcgtgtgaccaggagggctgtgtgtggcaaggggttgcaaataggggtggtcgcccttgtagaggttccatgagggcagcctcaaagtgtcaaagcagctcccagccccctgtacatccaacctcccaccttgacctccacggggacctgcagctccttcacccaggcatcggcggtgaggggcgcctccgtcaagcgctccaccagatccaggaaggggacgctgttcccaggctgcaggaatggagaggcacannnnnnnnnnccaggggcggtcgcccttgcagaggttccatgagggcagcctggaagtaacaatgcagctcccagccccctgtacatccaacctnnnnnnnnnntggaggagtcatgaactgatgccttgacacccgatcctgggtctactctgttctgcaaaatgcttcctgaagatggaccacattccgcttgtgacagagcaaagcacttcagtccccaacacacacccctctgcgcactggctgtcnnnnnnnnnnagcaggagtcatgaactgatgccttgacacccggtcctgggtctactctgttctggaaaatgcttccgggaaatggaccacattccgcttctgacagagcaaagcactccagtccccaacacacacacccctgcgcactggctgtcacctgccagtacaccctggtgagggcggcgccgacctccggctcatccacgatgcgccccagggtcttcaggaagtgggcccgcgcctggtgcacccccatctccgccaggacatacccatggctgtggtttgaagaccacagggatggagggagtgaggaaaagggggccaccagagccagggcatgtagggtgttgcatcaagggtcccagaaacaggctgaccgcctctccgagggcatccagggcacacgctcgcaccggtctctacaccacccctgcacccccaggacgccaaccaggcccactcactagtaggctgaggactcgtcgctcaggatgtggggcacgctgagcaggggccgaggtgccgggccgccctccaccccggcctccacttcgtcggccaggcccaggatgcgctcgggagttatctgtatgtacgaggggggttgacattcgcgttactggagnnnnnnnnnnaccctccaccctggcctccacttcgtcggccaggctcaggatgcgctcgggagttatctgtgtgtgcgaggggggttgacattcgcgttactggaggggaagaggcgggtcctgcaatcgagggagtggggtgaagcggagcggtgctcacagggctcctgtttgtagtgtcccatcccacactgtgttgcatcattcgtagtctgccagcaaccacggcccatcccgagagcctctccagttgctgctccaccctccccccccatcacaatccctcccaccccactctccacccacccacctggtcgtcgggcagatcgtacaacgccttttcaaagtaggggacggcgagcattgaccgcacggagaaggcggcgtaggggtgcccggcctcgattgccnnnnnnnnnngtcgtacaacgccttttcaaaatagggcacggcaagcattgaccgcacggtgaatgcggcgtaggggtgcccggcctcgattgcctcgcgcaccaggctccagggcacgggctgccccgcagcatctctggcgtaccgcgccagccaggcggcgtcccccgccaggctgtccagcagcatggactggttctccgcgtaggccacactggtgggcgcccgctcctgcgagcacagggggctggcctggtccacattggcgaaatgcgcggcatgcccgccctcgtgcagcagcgtgaccagcgcggtcttgcccgagcccacgctgccgggagtggccaggctggtgaagttggtctgtgcggggacccaggccccatccacctgggggttgtggaggtcgagggagtggggtgcaagggatggatgtgcatcgggagcgtgcgcaggggagagctcgccgctgaggagagggaagcaggcnnnnnnnnnnatccacctggggtttgtggaggtcgagggagtggggggcaagggatggatgtgcatcggatgcttgcgcaggggtgagctcgccgctgaggagagggaagcaggcgctgactgagcgcaaggaatgagccagtggagggtgcaaggtgatatgcatgcatggttcggggggaaaagccaacacagcatctcaacaccttaccttgcgataggccgggacgggccagtggcagaagccgttcgagtactgggggaaacatgggtgcaggacggctcgtgggcggaggggcatggaatgaatcacagcaggcagtgtctcataccccggtcagtggggaggtgtcagtctcattgtgcatgttcctccccttcgatccatttcaccttgccggggcggtcgcagaggtccaggcgcatgatggagccacggtagtcgatgcccagggcggcaaaggtgcgtgcccagacatccaccgcgttctgnnnnnnnnnntgagtactgggggaaatatgagtgcaggacggctcgtgggcggaggggcacggaatgaaacacagcaggcagtgtctcatgccccggtcagtggggaggtgtcagtctcattttgcatgttcctccccgtcaatccattccaccttgccggggcggtcgcagaggtccagnnnnnnnnnnnnnnnnnnnnnnnnnnnnnnnnnnnnnnnnnnnnnnnnnnnnnnnnnnntaatctggcgcaagcatcgccgtgccagggtttcccctctctgcaccgagccagagcaccaacatcttctgacgagtggcacaaacccatggcctacctgcagnnnnnnnnnncggaaagcgggaaggaacaggggccagggcatgcgtgagtgaccaaacccctgcagatcacaggggtgtgaaacacttggccccagaaccacatgcctcagccacaagcccacctcaaagggaaagtaggggtccatgcgcgtctcaatgtcccccgccagggcgttgctgatgttccatggctgcacggaatcaggtgcacggctgtgacgtcaggctctcgagggcatgggcccttccccactctggcgcagcatcaccgtgccagggtttcgcctctctgcaccgagccacagcaccaacatcttctgatgagtggcacaaacccatggcctacctgcagacgccctgggggcaccccaccagcatcccacccccacccccggctcccctcgcctacaatcgccttcccaccttgaggctgtctttgcccttggccgcagccagcctggcgcgggcgtcggtggcgagctggcgcgtcgcgctttccagcccgtccagcatctggaacaggcgggcctgggtgaatccctccgccgcctgcaccttcatgtcgtagtagttcgggaagcccgcccgccgagccagctcgttgcgcagcctcacgattgccgcaaagggcccggcgatggcggggccgatggagcgcagggcgtcgtaggcggcccgccgcgcgctttcctccccgctcatcttcatggcgttgcgcagctggacggagctggcgggcctgaactcgccggtggcggggtcggtggtgcccaggcgcatgcgattgcgcacccccgccagctccgcctccaggtcgttcaggcgggcgcggagggtcgccacgctctcctcctcggagacgtaggtggcaaaggtgcggcgcagcaccgccaggaccctgcgctgctcgggggagaggtcggggcgggcctccgcatcgcacaccgcccgcaggcggtcctgtgaggacaggaactcatccagggcgttcttggtgctgctgagagcggaggtgctggccccagacaaagccatcttggtggcccagaagttgtcctcgtacgcccggtgcacctccaggtacttgtcattgatgccttggatgaaggtgctgacgtcgggattgccgggcagggctgtagctgccatgacgatggaaggtcgaggcgtgggtggccgggcccggagagcactgatgtgaaggcggagaccggggaagccaaccgaatgagctctggatctcagcatgcgcctgtaaatggggagaataagttatgagatccagatgtcattcagccataccgnnnnnnnnnncctcagcatgcgcctgggaatggggagcacaagtcatgagatccagatgtcattcagccataccgcggaggacaagtgatccacatacactcccttcctcacctgcgtctcgccggaaggcaaggatctaagatagaaatatgcttccctttgctgtatgcagtaagtgttccgctggtcatagatggattgcttcgcgcgcacggggcatacgagatcacccgacatgccacgtcaccacacacactggnnnnnnnnnntgcgtacggggcgtacgagatcacgccgcaccccgacatgccacgtcaccacacacactggtgtcgctggatcacaagcatgcccaaggcagcgatggcctttggcattaaatcatctgttttaatcttaagcacaatctaaataaaggagtgctgcttgcacacatcaggactgactccgtcatcccaaacacccaggaagtgatcatgtcccgcgccgggagcgcggcagtgctggcaggtggcctggtcctcggggtggcgtccgtggcatcgtacctggtgaagagggcgtacgctcccgtgagccgctccatcgccttccaggccttccccgggaagcgataccggccagcggctgcagcagtgggtgcgtctgccaggggggtggaatgcagtgagtttcgttacgcaatcgtctagaagaagacatggtcaccatgccaccccccgccctggcctcacaggtgcaccctcggggcatctagaggtcctcccaagccagtaccctcgggtgcggcgggatgacaccgaagaaaccctgcatggcgtcatcatccaggacccctacagatggctggaggacgctgactctcccgatgttgcagaatgtgggtgcggcacgggccacgcggcttgtggtggggtgggcgtggcataacattggcggnnnnnnnnnncgcaaaatgtgggtgcggcacgggctacgcagcttgtggtggggtgggcgtggcatgacattggcggtcatgacattcctgggaagccggcaggctagtgcacccctccccaacttggcagaccgacgtcgtctcctgaatcccatcgttcctgtaccctcctcgcagtcgtggaggagcagaatgtgctgacgcagagcgtactggaccagtgcaccacccgccccgccttctccaagctgcttgagaaactgatggactacgaaaagtttgggacgccctttaagaagggccagcgatactactacacgcataataccggtgggctggggtagcttcatgaacagtgctggagtgcaggagagctcacggattttgcatgttgtttgggtgcccagaccagcaccgattctttcctatgcctcacctttgtgaggtgcgggcactattccccttcctccaactacccccggcttccccaaccaaacccctcacactcactcccacactcactcccacactcctcacccatcactcttcaacaggcnnnnnnnnnnagcttccccaaccaaacccctcacaatcactgccacactcactcctacactcctcacccatcactcttcaacaggcctgcaggcccagagcgtagtgtacagccagtcctcgctggatggcgagcccgtggtgctcatcgaccccaacaccctcagcgccgacggcacggtcgcgctcagctcctgggccttcagcgaggacggctcgacgctggcctacgccctctcctccggcggctccgactggcagaccgtgcacgtgctgggggttgaccccggcatgggggccacgacgcagcacccagacaccctgcgccacgtcaagttctcctgcctggcctggacgcacgacggccgcggtttcttctacaaccgcttcccgccgccgccggaggggggtggcgaggcggggaccgagaccgcgcgcgccgacaaccaggagctggcctaccacgtgctcggggatgaccaggcgcgggacgtgacgatcctggccctgccagagcaccccgactggatgattgggtgcgaggtgagcgacgatggggggcgcgccatcctctccatctcctccggctgcgagcccgtgaatcgcgtctggatcctggacctggatgcggtggggcggagggccgacggcgccctggacttttccccctttgcgcacggcgccgctggcagccgggagctgcccctgaacaagctcgtggacgacttcaaggtgagggagatttggggatgggaggagaagggcctgaagcagggctcgacgctggggcggtaagagataattggcgcgcagagggcggatgttgcgatgatgccgtgnnnnnnnnnnttcgacgctggggcggtaggagggtaattggcgtgcagagggcggatgttgcgatgatgccgtgcgctggaacccctgggtgcggctattgcactctttgctgataaagcccagcagcagccgggcctggtctgaggggagggccgggcctgcagaccccaataccgtagaaaccatcccgtccttctccccaagccctcccatccccgccctcctctcctcgaccgccacaggcgtcgtacgagtacgtgggctcgcgcggctcggagtggaccttcctgaccaacgccggggcgccgcggtatcgcgtggtacgcaccgacatctcggcgccggcgcccgcctggaccaacgtggtgccgcagcacgaggcagacttgctgcagtgggtcaggttactgggtggtgggaagctggtgtgcagctacctacgcaacgtgcaggtgattgggctgtggggaaagggggaacaggttttatgagggtggcaatggagtgaccgctttatataaggagagtacccccttgatgcccatgcaagggaacccttgctccttggcctgacgaatgtcttttaccctctttatccccaaacccgcaggcccacgtggagacccgcgactttgagacggggcggtggnnnnnnnnnnctgtgagggtggcaatggagtgaccgctttgtataagcagagcacccccttgatgcccgtgcaagggaacccttgctcctcggcctgacgaatgtctttatacccactttatccccaaacccgcaggcccacgtagagacccgcgactttgagacggggcggtggctggccgacgtgcagctgcctggcatcggcagcgtcaccggcttctccggcgaccacaaggccacggagttcttcctttcttttgccagcttcacggagcctggcgccaccttcaggcgcggcggcagcggcggcgggggtcaatagggctggcgtggggttttgagctatgagtcttgtcgatgagggtgccaggggtccctggagttccttgggttcttcgctcacgggtgcttggcaccactcttagtgtccgccctgacctctaccttcttgcaggggcgacgtggcggcgtcagactctgacatcaccctgcatcgccgcatcgccaccgccagcttctcccctgacgacttccagacccgccagatctttggcacgtccaaggatgggacccgggtgcccatgtttgtggtcagccagaagggtttgaccctggacggcacagcccccaccctgctgtatgggtgagaggcgtgacttgggagtggccgagtgtgtcttcattttgcttggtggcagtggggctgtggattgcggaaccagggcatgcatcgcataagggggatggtgttgatgcccgttcaagcctgtcannnnnnnnnntgtgacttgggagtggccgagtgtgccttcattttgcttggtggcagtgggactgtggactgcggaaccagggcatgcatcgcatgagggagatggtgttgatgcccgttcaagcctgtcatcgcctcagggaggtgagttcctgccgctgctgcagcctgagtggcggcacattgcaacgcagagtggtcctcccccttccccaggtacggcggcttcaacatcagcctgacgccctccttctctgcatcccggctcgcgtggatgctggcttacgggggcgtgacagtggtcgccaacttgcgcggcggtggcgagtgagtgggtttggctggcttttgtgaaggggcgtgtggggcttcagagccctaagtgcgagcttggcctttgtcacatcacattctcctggttagatgaagagggctctgtgcgcattcttcttgacgccctgtggcagatctggggtgtctcataacatcaaatcacagctgatgccgtatggtattcctttcccagaccttccttctgtcannnnnnnnnnggcttggcctttgtcacatcacattctcctgttaaagtgaagagggctctgtgcgcactcttcttgacgccctgtggcagatctgaggtgtctcatgacatctaatcacagctgatgccgcatagtattcctttcccagaccttccttctgtcactacccctactaatattctcaggtttggcaccggctggcgtgacgcggggtccctgtcgcacaagcagaacgtgtttgacgatttcgtggcctgcgcggaggaactcgttgcccagcgctactgctcgccggccagcctcgtcatccaggtactgcagctggtactacataggcagggtggggtcgtagaggggggcgcttgcatgggctgcacggggctgcgcggcgcccagcagcgctggccgtcgccgtcctcccgtctnnnnnnnnnntgaggggggcgcttgcatgggctgcacgggcccgcgcagcaccgcgcagcgctggccgtcgccgtcctcccgtctaccttcccgccgacacgccacccaccaaaggcccccctctaccaccccccttcctgcgcagggtggcagcaacggcggcctcctggtggctgcctgcgccgagcagcggccagacctgtttgccgcagtcctgggtcaagtgggggtcatggaccttcttcgcttccacaagttcaccattggtgcggtgctgtgagggtcagggcgtgtggccgtcggggactgatcccgaggatgcatactcgggaggctggaaaccccagggaaacccagtgcagaagcagctcccgctgacagagcggggagatatggtctgtgcccccaaacacgccgtgctcgccgcctcccgccgtcgannnnnnnnnntagggcgtgtgaccgttggggactgatcccgaggatgcatgatcgggaggctggaaacccagggaaacccagtgcagaagcagctcccgctgccggagcggggagatacggtctgtgccccaggcacgccgtgctcgccgcctcccgccgtcgaggcaccttgttcatgcaccgaccgagcgcagggcacgcctggatcaccgattacggcaaccccgacacggccgaggacttcaactggctcctgcccctgtcccccttgcacaacgtcgcccggtccaaggacaacggccagtaccccgcgttcttgctgaccaccggcgaccatgatgaccgcgtcgttcccctacacaccctcaagctggtggcgacgctgcagcacacgctggcaggtgggacgtttggtagcattagtgtatgatctgggcatgagggctgggtacagcttcctcaccggttgatgtcggcagaagggaggctggctttgctgtatgcttggcaaccaagctgctnnnnnnnnnnggtagcattggtgtatgatctgggcatgaggggccgggtacagcttcctccccggttgatgtcggcagaagggaggctgcctttgctgtatgcttggcaaccaagctgcttcctggttcatgcctcaccaagaactccctctcgacagccctgattccacaaaatgccgcacaggtgacctcaacccctcccagcgcaaccccttgctgacgcgtgtggaggtgagggctgggcacggcgccggcaagcccaccgccaaggtcatcgccgaggtgtctgacatgctggcctttgcagccggcgtgatcggcgcgccctgggtgcacagcagcgcctgactcccgatcccaggctgacatggcacgaatggcacacggtggcaaaaggggcttgttacggagcaaagtgtgtgctgtggcagtgagcatgcagcagacaggagaggagcatgtcgaagggaagatggtcgacgccactttgcatcagaggggtgtggaaaggggggtgtacatcaatcagccacatggcgggctggcgtggcgcctgtcacggggcgcggggcaaccaccgccgcagaccccggcactggggatgcccatgctcccttggggggcagagagtcttatggaatacaagggatacctagggtcggaaaacttggacagagcgccccacacaggtccggatcaatgctactggtgtattctagtgggtgaggggaactgccggaggttgctctcggcccctcagatcggcacgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccacgaggatgtcactgaatgtcggtcggtcgtcggggttgaaggccaggcaccttgtgcccagcacctgagtttgtttggaaaggagggagagggggtatactgatgtgcatggtcggggtcgccagctgatatctgcagannnnnnnnnnagcagaccccggcattggggatgcccatgctcccttagggggcagagacttatggaatacaagggatatctagggtcggaaaacttggacagagcgccccacacaggtcttgatcaatgctgctggtgtactctagtgggtgaggggatctgccggagcttgctctcggcccctcagatcggcacgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccttgagtctgtgcggggtgctggggggaaagaccaggctgcgcttggaggccacatggttgagcacctcggaggtcttcagcccgtcccaggcgcgcgtccccatgtacagctcccacagcaccnnnnnnnnnncgtgccaggaacttcctgaggatgtactgcgtatccttgagcaccgagtccacctccacgaggatgtcactgaatgtcggacggtcgtcggggttgaaggccaggcacctcgtgcccagcacctgagtgtgtttagaaaggagggagaggggggtattgatgtgcgtggtcggggtcgccagctgatatctgcagatgtagttgggccccaaaaatctggacactctgcacagggacccaacccccttttctcctcccagtgcaccaaaccaccttgagtctgtgcggggtgctgggaggaaagaccaggctgcgcttggaggccacgtggttgagcacctcggaggtcttcagcccttcccaggcacgcgtccccatgtacagctcccacagcaccacgccaaaggcatacacgtccccggccttggtcaacagcccatcgatgatgagctctggaggcctggagtggagggcagggaggttataagagggcaatgaggtagactgttgatgagacgagctgggacctgggtgtcgttgaagtttcatcgtgatcctgctgacgccagcaagggtcgggctggccaagccatgcacacttgcaagaattatatcctgccatagggctgagcccttgcttccttgggtggcccacacaaaactcaaccctggcaagcccctcacatgtactctgcgcagcccagggtccgcgtccgcaggtacgactcgctgccaatcaggcggctcagcccgaaatccacgacctgcggagttagatgaggtggcaggaggggttaccagaagggaggaaaaggccaccacgcagactattcatgacaagcggacctcccacgagcatgaagtgggcacactccccactcccctcgatccacttcatcaatggatcagcgcctcaccttggcggtgaagccgcggccgtcnnnnnnnnnngagagggcaacgaggtagactgttgatgagacgagctggggcctgggtgtcgttaaagattcatcataatcctgctgacgccagcaagggtcaggctggccaagccatgcgcacttgtaagaattacatcctgccatagggctgagaccttggttccttggatggcccacacaaaatacaaccctggcaagctcctcacatgtactctgcgcagcccagggtccgcgtccgcaggtacgactcgctgccaatcaggcggctcagcccaaaatccacgacctgcggagttggatgaggtggcaggaggggttgccaggagggaggaaaaggccaccacgccgactattcatgagaagcggacctcccacaagcatgaagtgggcacactccccactccaatcgatccacctcatcgatagatcaacccctcaccttggcggtgaagccgcggccgtccttgctgttggcagccaggagcacattgccgccggtcaggtcgccatgaaggatgtcgttggcgtgcaggtacgccagtgccgccgcgatttcttgcagcgtctgccagtgcacgagggcgtttcaggaggcgggtgtcctgagtggttggctgctggtacatcgcagggaaggtaacctgcgagcaggcagatcacgtggaagaactgcgtcagcgccctcccgttccccacctggaggatggacaccaggttgggnnnnnnnnnngtcacatgaaggaaccgcgtcagcgccctcccatcccccacctggaggatggacaccaggttgggctggccctgcgctgcaaaggattgcgtgaggaaagcgccgcgctcgatggccgtgagcagggggcccaggttgcagaactccgacacgatccacacctcatgcaggctgcaaggggccagggcggctggccctgaaatgcgttggatggagtgcattgtggggttgggttggcaggnnnnnnnnnngaaggggccagggcggctggccctgaagtgtgttgggtggagtgcattgtggggttgggttggcaggggcgactggggccactcgcaggatagccaaggtacaagggcttgcatgggccccattgcaggaccgcaggcttaatcgtagacataccccctaaacctctcctttatgcctcctttccaccttgatgcagcgctacggtgccgtccaggaccgcgtcgatgttggcgctggcactgcgactcgcaccctggacgccggcgggggcctagtgggggcaagaaggtggaaatgggtacaggtatgtctgcccgaaggtcgtgtgccgcgccaggcatggcctgaggggtgggtttgacgcgattggcctgcttggccaagaacaggtgtgcgnnnnnnnnnntgccggcgggggcctggtgggggcaagaaggtggaaatgggtacagatttgtctgcccgaaggtcgtttgctgcgccaggcgtagcctgaggggtgggtttgatgcgcttggcctgcttggccaagaacaggtgtgcgcctcgaaatagtttcaaagcacggcctttgctccatgcccatcccattacgccgacgctcgtcaggaacagcgcacgcagaccacccttccacaagcactccccccttcaaccacccccgccgacgcaccgcctgccggacggcatacatgtaggtgtgtgccacgttggggtgggagatgctgctggacagcgcggcctcgaacaggcctgctttcttcacggagccgttttccttgatcacctccacctcggggttgtcggtctccagcaccttcaccgccaccgtgtttccattccaggagccacggtatacctatgtgtgtgatgggtggatgtggttggggaatatggactgcaggtcctgccgttcctgtgtgaggcatagcgtgtagtccagagctcaagacgcatccccgaggggcccacggtgagggtgcatccccggaggcagcgacaggcagaccgagaacgcatggcgatcgagcaccatggcannnnnnnnnngggtgagggtgcatcccctgaggcagcgaccggcagactgagaacgcatggcgatcgagcaccatggcagaatcggcagcttgccgtatcatgcgcattggcaaagtgacgcagtggcccctgatgtttcccattccatgaagaaagagtgatcccacagccacgcaccctgccgtaggccccgcgccctatcagnnnnnnnnnnatggcccctgatgttccccattccatgaagaaagggtgatcgcacagccacacaccctgccgtaggccccgcgccctatcaggggccccagctggacgtccgagaagacggaggacttggcctggcgcaggctcggcaggccggccccgatgtccatggacatgggtcgcccagctgggcgccactgcgtcacgcgggcctcctccgaggagccctcgctgcccagcgccccaggcgtgccgtacccgtccgagtccctgagggggtgcacaatggcaaagttgtatcgaggaggtttcgcactcggctgggcagcagcgtctgggtttgggggcggcagggcttcgctcgctatcggtctgcgaggagggggttgatggcgtggtatgatgggtgagggaatgtggggcaggggccaggtgatgttgcgacaacagcaaaccagttttccccacctccaggcctgctcnnnnnnnnnnaatgatgggtgagggaatgtggggcaggaggccaggtgatattgcgacaaaagcgaaccagttttccccacctccaggcctgctcgccccgaagaagcagggaattgaactgaccacccagcacttgggcgcaccgaaactcgacactgacggtgcgcgtcccttcgccatgcttcagcgtgtagtagccggtgaagggctgggaccccgagggccgcgtctggtcggaccccgacccgcccggctcggagagcagggcgtcaaagtcgcgcggcggcagccagtcgccgccgcccatcaggccgcgcatggagccgttgaagtgcacgatgcgccagctggcgggctgggagacatccaccacgagggccgcctccttgaagcactccaccgcccgggccaggccctgcgcctccggggcttcgggcaccaggtcgtgcagaagcttgtcggaaactgcgaggcggccgggtggaaagggaggagaaggttggggaagggggaggaaaaggacctggcgtgagtatcagactggggtggggatgctgtgagggaagcctctccgccaaaagttacactgccattgtagtcttagatgcacggccttcaactgcgactgtatccttactgctgctcaaaaactgagaaagacccccgcaggttcgttcnnnnnnnnnngcattgaagtcttagatgcacagccttcaactgcgtctgtatccttattgctgctcagaaactgagaaagacccccgcaggcccgttccctccccttcttgccctggcttgcctgtcgtggccgagccagggatccggctggccccagaggcagcttggctcgtaggctccagcatctggtgctgggccaccacagtttgcatggtgctcaactggcgtagggggtggtaagagggagtctgtgtatcacccagtctaagaatagcacatgccctgatgcatgtctgagtcacggggacagaccgatggcaggctcgggccggcatcgacctcccccttgccacaggttgcgcctcggactgccactccatcggccgccccctcgacccgcaccaagtgatcattggcaggagcacaccttggattgctcaaggtccttcaacaccagatctgcaaactgggagagcatggtgatcttcaaggggctgaagtcgtcccgcgcctcgctgtcagccacacacctgcgttgtatggggagcaggcagcacctcaactccggcccaagcctgtgtacctggtcgccgagggcacagaggtcccaccgtggcactctgcaaggatctgcacctgcacaggcatacgggcatgaggtccctccgcccgagcnnnnnnnnnnnnnnnnnnnnnnnnnnnnnnnnnnnnnnnnnnnnnnnnnnnngttgccttcctggttgggtccggcagccagggcgcagcgggcatagaatctgacgccggggtgacccttcacgatgtctgcttctgcggtctcggcatcctcccgtgtgtcattccagacctggacatgcggcggtgggtgcaggtgaggggccgcagcgctcgagcccggctcgtggcatggtagggcctgaggcacggttcagcacacatagaagtccactgcaactacttggccaggcaggcacactccagtaacggggtgggatggttgaggagcgcaggggtagaaatggcagcgccaatcatgcttggctccacaccccaagnnnnnnnnnnagttcagcacacatagaagtccactgcgactgcctggccaggcaggcacactccagtaacagggtgggatggttgaggagcgcaggggaagaaacggtaacgccaatcatgcttggctccacaccccaagcttccgaatgcccaaccacaacatcccccctcacaccatgacccgctggccttgccgggatggcgccagcgcccagttctccagggaggccactccatcgtcttgttcgaacgcctggcccaggcccagcccagccatggtgttgtaccaggtgagctctgcaaggcagcgaggggggggnnnnnnnnnntgcccctcacaccatgacccgctggctttgccgggacggcgcaagcgcccagttctccagggaggccactccannnnnnnnnnggttggtgcatggcgccgagtcacatgatcggcacaccatgtccatgcagtgcgcgtggtgannnnnnnnnnaggagcaaacccttgcatgaccgaaccagcaagatcagctggacgggttacccactgggcatgaggctagttagtgcatggcgccaagtcacatgatcgccacaccatgtccatgcagtgcgcgtggtgacgctgctcctgcctgggcgcctggtcatttgcatccgcaccccaagatgtcctcgacggaccagctgctccccatggccccccccgtccttgcctgagggggacagggcaaccttgacccactgcgtcttgaacaccgcccggcagaggtccatctgggtctggaagcgagagggggggcgcgccgcggcctgcccgctgtgttcgtcgcacgacgatgctgccgtctggctgccctgggacgcggcgctgctcctgatcgcgcctgacctgtaggagttggcgctggtgcggggagcgccagacttgcggattgggaggggagcgggcaggtcggaaggcagggcggggacgtggtccttgccttcccctgaagactcgcggccggggtcggagacagccggctcgagggacttcttggtgggactttgagcttgtgaatgctgtaggatgggctcggagggggtgtccgacgcgacatgctgcgcattgcttgtttggcgggttccgttggccccatcggcaccctggggaaggaccaggggtgaggcatggtgcagatatctcagggatccaaccccaccccgcgaggacaatttaaattcatgctttcattaggacaatgtgagcctccaaacacaccttgacgggaacaggagcgcctccagccccgatgggttcctcctgtttagaggtgcatccccccatcttgacacgctcgcgttggacgcgaaacttactgtctccttaattgtaccgctctactagaagaacatgtgtcannnnnnnnnngtcgcgtttgacgcgaaatttactgtctccttaaatgtaccgctctactagaagaacatgtgtcaccttggtttgacatcgtatgtcgtccttgactctgctcgcaagcgcatggatgggacgagccggacagtggctggcgaaatccgtgcgtcttccggtgtgcgggcaccgaaagccgaacgcgcgccatgtcctccaacccaggccaggccaccagaggcaacgagcaggatgccgattgtgaataggtgcacgcctacagcgcagattctgatgaaagctttgctgactagtactggcagactgggtgctgtgtaccactcgccccactagggtgtcggtaatgctgcgggcgtattgcccctcctctcgagcacctcgaccacccgcaaacaggcctcatcgacagcgacagcactgcagaccataccgtcctgggatgcaggatcgatcctcgcccactgttgccagcagatcacatcctgaggggttgagcggcgctgcacccagcaaccccactcctcatcaggtgaacccatggttgagcttctgggttgtattgtgaagataaacccgggcggcattacgaaattaagctcgcaggcctgaggacaccatctgatgttgggatgtccctgcatgttcgtgccattggcggtgtcaatggtgggtcattgagctactgttgtttaaaggagaagtggttgcactaccagcctcaaaatcccctcacgattctccaaaccaggcgaccatgctgcaacgtctgggccaaaatgtgaacctcccgggtgcctccctcttcttccacatagcctgggtgnnnnnnnnnncgagctactgttgttaaaggagaagtggttgcagtaccagcctcaaaatcccctcacaattctccaaaccaggcgaccatgctgcagcgtctgggccaaaatgtgaaccttgcgggcgcctccctcttcttccacatagcctgggtgggtgatgcaggctggagttgtactggatactcgatacctggctctgagggaagctccctggcacattattcctccccctgccagtgctggccttatccaatcctcaaagcgtccctcctgcccaccctcgcagcgcgagcggggcctttgcctgccccacctcgacatcagcgacctgcgccaggtggactgggcggcgctgcacggagccggcttccgggctgccatcttcgacaaggacaacacgctgacggtgccctacgcgctggagctgcagcccagcgcggcggagtcgctggcgcgctgccgcagccactttggcgacgccatcgcgctgttcagcaactccgcgggactggcccagtttgacccagagggtgtgtgcctgtatgcatgggggtgtgtggtgtggaggtgtgggagtttcggtagtttttgatggggtgggcgagcaaggggcatgggcaaggcctgtgcctgccgcgagagtgacaggacgcctgcagagccaggcacaccatgcccgcgcctccctccctgccctccccaggggaggaggctgcggccctggaggccagcctgggggtcccggtgctgcgacacagcgagaagaagcccggcgggggggtggaggaccttgtgtctcactttgggtgaggcgcatgcatgcgtttgggataccggctggctggggcagaggttggctggttgcctccggccagctggacatgtgccaggctggcaggctgcttcttttctgcccccatcaacctgtcaacatccatcttgggccctgcctgccgatgcagtgacccttgcacgctgggtcatcttcagattcatgcctccccgtcatctactcaacgtcattgccagaacagtgcaccccctccagcctcgtcttcccaccccaaacacacaagcaggtgccagcctcatgagatgatcatggtgggcgaccgctacctcaccgacatcgtgtttggcaaccggcacggcatgctcacagtccggccccggcccttcacctccgagggggagcccgtcaccgtggctctggtgggtggctgtgcatccagggcctgagaggggcccgcgttgttgggtgcttggcaactggaggcccctgcgctgcgaaccctgggcgctcagggagggggcagggtggcctgcggccccgcgagcgcgcctggcgtaccctcgatagagaccccgcaatgtgccgcgaccccctgcccatcgcaggcgcnnnnnnnnnnagcatccagggcctgagaggggcccgtgctgttgagtgcttggcaactcgaggcccctgcgctgcaaaccccgggcgctcagggaggggggagggtggcctgcggccctgcgagcgcgcctggcgtaccctcgatggagaccccgcgacgtgccgcgaccccctgcccatcgcaggcgcnnnnnnnnnngccagtggcgctttcctcttgcaatgacatgcgtgtggagccaggacacctcatgcttccaagtcttgctcagggcctgctgtcccctttgtcctgcgtccgcctgtgacccnnnnnnnnnnggaggctggaggcggcctgcacggcgcggtggctggtgcagggccacgctgcgccctcccacccgtttttgaaaggccagaccagtggcgctttcctcttgcaatgacgtgcgtgtggagccaggacacctcatccttccaagtcttgctcagggcctgctctcccctttgtcctgcgtccgcctgtgaccctaggcagcaactcaacattcccctgagcaaggcctggatgcttgcaaggagacacgccaaggacatgcacagggtttggggggctgctggggcgcggggtgtgacctcccaaacccgaatcaggtgtcgatggggggcagggggatgctgggcaggacgagctcggtgccccgcggctgcagggcataatgcacgaccaggtcatcggagcgcttccagatccactgccgcacggcggccaggctgaagtcccagggcaccgccgtgccgccgcaggtgagcaccaggtccgggccggcgggggccccagcgggcggcggcctgccctccacggggctcgcacggccgttgggccgtggcgcggcgcccgccggggtctgcgcggccctgcccgcctcccaggccgcagcggcgcgcgtgttgtagaacaggggggcctcccccggggacaagcccgcgtcgcgcagccggcggcccacgtactccaccaccttgtccacggtgagcactcggggcgcatgcagccggctctgcagcagtgacggcagcccggagccctttgtgaaggtgnnnnnnnnnncctgggtgcatgcagccggctctgcagcagcgacggcagcccggagccctttgtgaaggtgcggtggaggggggggagagggatggtcttgaggtgcaaacttgtatccgagcttattcacgcccagcctgtgccgccgcccagcctgtgcctcgcgacaacatctgtttgtgcgctggggcatccgaacctgcctcgtgaccgaagtttcaagtaaagcctttttacacgccccccccctccaaagccccgcttccacaccccaactcacctccaggggcagcagagtaaagaccagcttcaggtcgcggctgacggggacctggccatccagcaccacgctcctgacccaggcgggcacggggctcagggcctccgcctcgccgccccgcgctgccagctcagccaggctgccgcgccacggcgcgtcgcccagcagcaggacctccgccgcctcggcgtccagcgagaagctggccgaggtcgcggagggtgcgacgccttgccccagcgcggccaccgcctgccggccctggcccgtgaggggtgtggactgcggaccaggcgcggtgctgaccgtttctgaggcggacgggcccggctccgcggccgatgcagggtctgagccctcgcccacagatccgggcgacgcctcccctccttgcggcgcgtcctcgaccgacgtttcagcaccagcctccccgccacccccccccgcagccgcccaggcgccaaacagcgcggacagcatgagcgcgccgcagctggccttggcgtcggcgggcgcggcgtgcgcgcccagctcccgcgcgtaggcctccacgccaaaggcggcgccggggtccagcacgccgcccaggctgcccaggcgcaggtcggctgagaaccaggcgcccacgctgtgcgtggggtcgaacagctcgcgccgcgccgcctggaatgcggccgcgccggggggcgcggaaccgttcccggcaccctcggcgcccgacgcctcccagtgccgcgtcacgcgcccgcgccccacgtcccacagttcgaccgcgccctccgcgtcccgcgtcagcacccgcagccggtccgtggtgacggccgccgccgttagcggggccacccctgccgtccaggccagcgccgcgtcgcacagcgcgggcgggtgggagcagtcgccgcggccgtcgccgccggcgtcccgcccttcggacaggattgtggcaggaacgtcggggtcgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcccctccctcccaccgcgccgctctggatagaacagaggaagccgtccagaaggtgccccgctcgccaaccgcgagcgccgagacgggggcgcccagcgcgcagaggcgccgggtctagccgccgacggtgtcggtgcggtacacgctgccgtcccgcccgccgctgtgcacgctgcccaggtcggcgtcacgggaggccaggctccacaccgaccccgcatgcggcgcccaggtgccgcagcaccgcccgccgccggccacgtcccagacgcgcagcgtgccgtccgaggaggcgctgaccagtcgccggccgtcgcgtgagagcagcaggccgcgcacgacgtcggtgtgcccgcgcagcgcgcgcagcgtggccgggccggcgcgggggtccagcaggcgaatgccgccgtcggcctggccggccgccgccaggccggcgccggcgtccaaggccagagcgtagaagctgggcgggggcacgccggggcatggcagggcgtcgtagggcgcaggctgcagggtggtgaggaaaggggggaacacgagggaggactgtgaggacgggcaggcgcagagggcggggagaacgcgcgctgcacttgcagggccactcaggcctgaaggagtgagaggctgaaatgtgagacgggatgcacagggggttgtgacatccaggaattgagcttcagacagcaatgctgatctccatgctagacaatccacacattcttgcaggtgtgaggtacacggcccccaccctttccctgacctggctgagggaggaggccgtcaggcgctccaggtcccagcgcaccaggcccccgcgcagtccggcgctgacgaggacgccggcgctgacggagcaggccagcgaggttatgtaatcatcgtgtgccgagaccatcccggcacacactcctgcagcagcaggggggaggggttgagggttctgagtgtaaagtcggcatgcagaccagcgtgattgcagcaggcggggactggcatgctggcgaggnnnnnnnnnnggagggttgaagattctgagtgtaaagtcggcatgcagacccgcgtgattacagcaggcggggactggcatgctggcgagggccccgcgctctggccctggcaggctcactggacacttgcaggccaccctcagggcttagtctgcgggagagccacacacaatcagtctgttgccctcacatgaccctgtgctcttcccctgacgagcattgccgcccctctccctcgtccactccctcgctcaccagctgtcccttcgtcgcaccgccacaggcgcagcgtgcgatccgccgacaccgacgccagtgcggcacccggcaggagggccaggtcattcacccagtcggtgtggcccttgcaagcgagggttggggcagccgtctcctggctccaccggatgaggcacccatccctggatgcagtccacaggctatgggtgtcatcacagagcgcgagggcattgatgcccgcgcagtgctgtcggtgggggggcagggagggtggggtgatgtgaagggaggggacaagggagctggggtcggccgctgaggcagcgcgcagacgcatgtatgccgtccaccccaccaggtctccagccctgccagcatgggcgatggcacaannnnnnnnnnnnnnnnnnnnnnnnnnnnnnnnnnnnnnnggccgagagccagccccattcaggttcattgcaagtgatccgggcaggggtcgctacacatggtccccagggtgacgatggcaatgttgaatccgcaccccagttctcaagcgaaagctgacgggaggctgcagatcggcagatcggcctggggtgctccaaggtgctcgnnnnnnnnnncccgccccaccttattccccttggacctagggaagaggaactggaccttggcctgctttttgnnnnnnnnnngccgcacctgattccccttggacctaggaaagaggaactggaccttggcctgctttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcactccagttctcaagctaaagctggcgggaggctgcagatcgggagatcggcctggggtgctccaaggtgctcgccctctcctcttcctgcacagactcttgggcgagtgcaaggctgatgcgactaacgacgcacactgttgcacttgatacaccaagcctcgttttgagagtaggccaattgaagggcatccgccgttttggggtcgggggctggggtatgccccatccacgcggtgcttccgtcatgaaaaaggggttccggcacccaggacgaggggggatgcggcacgctttccaccgggcccggcccctgcctggtgagctctgtaaggcgctcagccccatctattcaatcgatcgaggtcctgggctgcgatctggtcggggcctgcgacgaggacaggctcgagtgcagagtgcaccatctccctggccgcggacctgcacaacgggaggtttcggtggggggtccctactcgcacaaaggcctgcttcgtttccgcacaatgatagagagtcgctgagcagcccctgaaacacaattcctgtcccagcacacaatgtattggcgggtaggtgggaggagcggaactgcagtggcgggggggccgttgcaggcatacttgtaccagtggtgcggtggacgtggaacaggcgggtgtgagccctccttcaaagtccaaatcacgatccgccacaccacaaatccacgcacaggtcaccggactgtcccaaggtacatccacaactccacattctgtctgcctgctcagccctccaatagccctccagaatgaagtgggggttggggtgtgatgcgcatgccccatgccctccaagtcctcctcccacacccctcctcccctgcagcgagtnnnnnnnnnncagccctccagaatgaagtggggcttggggtgtgattcgcatgccccatgccctccaagtccttctcccacacccctcctcccctgcagcgagtcccgtggacagcatcctcgacaaggacaactacacgctcgaggagctgctcgatgaggacgagctcatccaggagtgcaaatcgctgaacaaccggctcatcatcttcctgaagcagcgcagctctgtggaggccttggtgggctggcttgcggggacgggggaggtctgagaagggctgggaaccagatgtgtgcaacagggcggactgtggaaagccggtctgtgcactgggcggcagcgggccgtgcctcgtgtgctggcgtgaagtcgtgctcccccagtatacacatgtatccacgtccctccccctctccatcctcgccccccccccccccnnnnnnnnnnnnnnnnnnnnnnnnnnnnnnnnnnnnnnnnnnnnnnnnnnnnnnaggtgcccgatgaggaggaggacgaccccaagcgccggttcaagtacccgtttgccgcctgcgaggtgttctgctgcgaggtggagggcatcttccagaccctgctggaggacgaggtcctcatggacctgctcttctccctgctggcctccccccctcccctcaactgcatgctggccggctacttcagccgtgtggtgggctgcctgctggcccggcacgtggaggaggtgggcgcctacctgcaggcccaccccgcgaccctgaatgcgctgtgcgcgcactgcggcaccacctcggtggccgaggtggtggtgcgcctggtgggcgcgggggaggtgggcggcggcggcgcgccgccgccccccgcgctggactggctgggcgagagccagctgctcccgctcctgctgcgcgcgttggggcccgaggcgccgcccgacgcggcggccaacgtggccgagatcctggccgccgtggcgcagtcgcccggatcgccgctggtggcgcccctggcggaacctgaggtcctggcgcgattggtgtcgggcgcgctgagctccggcacccccggcgccgcctcgcacgccctagacgtctgcctggcactgctggagccggtggcgggcgggctggcgcacgcc

SEQ ID NO: 33830 - DNA, 65 bp, Chlorella protothecoides
gctccgcgcctgcgccgccttcgccgacaagcgcatccaggcggtcccacagcagtgtctgccag

SEQ ID NO: 33831 - DNA, 77 bp, Chlorella protothecoides
accctgctcacgcagtccagctgcgcgtcgttctcgccttcccccgccccaggcttgagggcgctgggggtctcagc

SEQ ID NO: 33832 - DNA, 109 bp, Chlorella protothecoides
gtaggccgcgcggtgggtgcgcacctgatgtgtgggaggggggtggttggtgttaggggggtgtgttgggcgtgcgacgggatggggacgagccgagcagggacgaacc

SEQ ID NO: 33833 - DNA, 61 bp, Chlorella protothecoides
cgcatactcgtggctggcctcgctgctgggtgatgagtcatcctcggtgagggcagcggcg

SEQ ID NO: 33834 - DNA, 108 bp, Chlorella protothecoides
gggtgcagcggacgacatgctgcgctcctcacaccatgtccacctcacagatgtgtgctcatttcctgaaaaatatgctgacaaccctgctgcattccaaaactcgcc

SEQ ID NO: 33835 - DNA, 79 bp, Chlorella protothecoides
gtcaggaacgcaccttgcatcacattgatgtttgccttgcagtcgtgggcactgtcatgcagaaccatcatcagatctg

SEQ ID NO: 33836 - DNA, 61 bp, Chlorella protothecoides
ccgtgtgatgatgagggaagttcacttccacaggcaccgcatgacacgtccagggcatacc

SEQ ID NO: 33837 - DNA, 231 bp, Chlorella protothecoides
ttctggcaccagccggagcggctctgctggaccgcgcactgccgcttttgaaattcgtccgccagcgcatcggtcacaccgtcgtcggagcgctctgctgctgcaaataaggccttgcacaaccgcctgttgaagaggtattcaaatggtaaagcaaatgtggcacggtctcagcgacaactcccccttctgagtggctccagacacagcctccattccgttggagctatg

SEQ ID NO: 33838 - DNA, 154 bp, Chlorella protothecoides
ccagcaccgccacgcctgcgggttggattttgttttttggggggggcaatatgagcgtggtcatgatcgagagggacggtgaagtggaggtttggggtcgagagggcgtggagatatcctggggagatgctggcagcatggtggagcagtgcct

SEQ ID NO: 33839 - DNA, 63 bp, Chlorella protothecoides
aggggatgtttcgcctgccgggcaacactgtaacgattgggccaccctaggcaccgttcttct

SEQ ID NO: 33840 - DNA, 84 bp, Chlorella protothecoides
ggcgccgtggtagaagaagaggtcgttggcgtagggggtgaagggggggtccaggctgtgacgatgatggggcagtgggagggg

SEQ ID NO: 33841 - DNA, 74 bp, Chlorella protothecoides
ctgggtgtatgtgtgtggtaaactttttctctacaggagcaaagctcaggacaggcaatatgtaaggatctcca

SEQ ID NO: 33842 - DNA, 91 bp, Chlorella protothecoides
ggcgcgaactggtgcaccgtgtccgtcaccatgtccctggagggagggggtgggggcgagtgaggaggagctggcacatgcacggcatccc

SEQ ID NO: 33843 - DNA, 59177 bp, Chlorella protothecoides
  modified_base (868)..(877): a, c, t, g, unknown or other
  modified_base (1043)..(1052): a, c, t, g, unknown or other
  modified_base (1223)..(1232): a, c, t, g, unknown or other
  modified_base (1609)..(1618): a, c, t, g, unknown or other
  modified_base (1880)..(1889): a, c, t, g, unknown or other
  modified_base (2203)..(2212): a, c, t, g, unknown or other
  modified_base (2994)..(3003): a, c, t, g, unknown or other
  modified_base (4117)..(4126): a, c, t, g, unknown or other
  modified_base (5684)..(5693): a, c, t, g, unknown or other
  modified_base (6706)..(6715): a, c, t, g, unknown or other
  modified_base (7904)..(7913): a, c, t, g, unknown or other
  modified_base (10037)..(10046): a, c, t, g, unknown or other
  modified_base (10466)..(10475): a, c, t, g, unknown or other
  modified_base (11109)..(11118): a, c, t, g, unknown or other
  modified_base (11377)..(11386): a, c, t, g, unknown or other
  modified_base (11587)..(11596): a, c, t, g, unknown or other
  modified_base (12644)..(12653): a, c, t, g, unknown or other
  modified_base (13349)..(13358): a, c, t, g, unknown or other
  modified_base (16194)..(16203): a, c, t, g, unknown or other
  modified_base (16712)..(16721): a, c, t, g, unknown or other
  modified_base (17367)..(17376): a, c, t, g, unknown or other
  modified_base (17696)..(17705): a, c, t, g, unknown or other
  modified_base (19351)..(19360): a, c, t, g, unknown or other
  modified_base (22555)..(22564): a, c, t, g, unknown or other
  modified_base (23790)..(23799): a, c, t, g, unknown or other
  modified_base (24722)..(24830): a, c, t, g, unknown or other
  modified_base (24937)..(24946): a, c, t, g, unknown or other
  modified_base (25053)..(25062): a, c, t, g, unknown or other
  modified_base (25295)..(25333): a, c, t, g, unknown or other
  modified_base (28588)..(28597): a, c, t, g, unknown or other
  modified_base (29445)..(29454): a, c, t, g, unknown or other
  modified_base (31941)..(31950): a, c, t, g, unknown or other
  modified_base (32629)..(32638): a, c, t, g, unknown or other
  modified_base (32783)..(32792): a, c, t, g, unknown or other
  modified_base (32946)..(32955): a, c, t, g, unknown or other
  modified_base (34218)..(34227): a, c, t, g, unknown or other
  modified_base (34680)..(34689): a, c, t, g, unknown or other
  modified_base (35871)..(35880): a, c, t, g, unknown or other
  modified_base (36057)..(36066): a, c, t, g, unknown or other
  modified_base (36430)..(36439): a, c, t, g, unknown or other
  modified_base (39018)..(39027): a, c, t, g, unknown or other
  modified_base (41448)..(41457): a, c, t, g, unknown or other
  modified_base (42953)..(42962): a, c, t, g, unknown or other
  modified_base (45559)..(45568): a, c, t, g, unknown or other
  modified_base (46240)..(46249): a, c, t, g, unknown or other
  modified_base (46327)..(46351): a, c, t, g, unknown or other
  modified_base (46661)..(46670): a, c, t, g, unknown or other
  modified_base (47341)..(47350): a, c, t, g, unknown or other
  modified_base (48640)..(48649): a, c, t, g, unknown or other
  modified_base (48902)..(48911): a, c, t, g, unknown or other
  modified_base (49365)..(49374): a, c, t, g, unknown or other
  modified_base (50933)..(50942): a, c, t, g, unknown or other
  modified_base (51330)..(51339): a, c, t, g, unknown or other
  modified_base (51648)..(51657): a, c, t, g, unknown or other
  modified_base (51713)..(51722): a, c, t, g, unknown or other
  modified_base (51868)..(51877): a, c, t, g, unknown or other
  modified_base (52389)..(52398): a, c, t, g, unknown or other
  modified_base (53009)..(53018): a, c, t, g, unknown or other
  modified_base (53562)..(53571): a, c, t, g, unknown or other
  modified_base (54033)..(54042): a, c, t, g, unknown or other
  modified_base (54659)..(54668): a, c, t, g, unknown or other
  modified_base (54908)..(54917): a, c, t, g, unknown or other
  modified_base (55176)..(55185): a, c, t, g, unknown or other
  modified_base (55577)..(55586): a, c, t, g, unknown or other
  modified_base (57327)..(57336): a, c, t, g, unknown or other
gggcgtgagcgcggccgcacagggtccgcggcctgccacctggcacgccagcgccagcgtgtgggcggcgtgtgccgcgccgcggtcgttcacgccggccagccaggcggcgagcgtggcggccaggcccgcgccgtgctgggccaggaagctcggcccgcccaggagcagagcggaggtggcgatgcggcaacccaccgccacgtgctccgtgctgccgtccatggcggagggccaggcccgggcccagaggtcgctcagcaggggcgaggcgccgccgccgggcaggtcggggctgcaccgcagcgccaccagccaggtctgcagcccatcctcgtgcacgccgcagtcggcggaggggtccagcgcggcgtggagcgccggcagcagcgccgggtgtacggccggggagtcgaggcccagcgcgcacagcacgcgggacagcgtgcccagcgcctgcatgcacaggagggggggggcggcgccggggcccgaccagacggcgggcagcaggcgcatgaggccgggggcgtggggaacgacgccttcccgcagccggccaatcagggtgttcaagtagtcgaaggcctgcgaggcgggggggagggtatttgggggaagggatgaggcccttgcttgcgtgtggcagtgggtgaggcaacgtggtgcataaaggggggggcaggggggggggttcaccggccgagcgggtgcggagggaacggttgccaggagctggaccgcggcggcatcatgacatggcggcgggcatgccgcgacaggtcgcccctgccttcacccttctggcgggcccccatcgcccggaacgcactctggcaagcccttggtactccccctctccaacgannnnnnnnnnccgccctcctggcaggcccccatcgcccggaccgcactctgccaagcccttggtactccccctctccaacgacccctgtgtgtcacctgaagctgagtgtccagctcggtcgcgtcctggagcaaggcacccaccgcctcaaagctggaggccacaaagggcgtgnnnnnnnnnncagctgtgtgtccagctcggtcgcgtcctggagcatggcacccactgcctcaaagctggaggccacaaagggcgtgtattcggcatgttcaaagctcctgggcaggcgtgtgtgagtgtgatggttggctggggggcatgcggggcccttggagtcctgccccgacaggcnnnnnnnnnnggagtgtgatggttggctgggggcacccggggcccttggagtcctgccccgacaggcggggctcgctggcgtgcggggagcggggatccaggcatggccacagcaccttgcaggggcatgcaacaccagagccctggcacagcgcgagtcaaggactccagaggggctggatgcctttgccgcgtcccatacgagtccggttgtgggaggaatgggcgtgatcaggcagccagctgcatccacaccgccagcgtgcccgacagctcccttcctccctcctcccctcctccccccctcctctccacccaaccccccggcccctcggacagacacacacacaagcacgcaccagtcgtccacgagggcgcgcagggtgnnnnnnnnnnacacacacacacacacaagcacacaccagtcgtccacgagggcgcgcagggtgaccagcgccgccagacgcacggccatgtcgcactccctgcccagtgcacacagcatggtggtgtgcagagccatgcggtcctcgctcttcagctcccccagccagtggccgggcaggagcaaggccacgcggcgcagggggtttggcgacggccgtgccgcggccaggttcgcgccatgtgcctccggcagcagcgtggagtggagccnnnnnnnnnngcgcggcgcagggggtttggcgacggccgcgccgcggccaggttcgcgccgcgtgcctccggcagcagcgtggagtggagccaggcagggaagtcgagcgcgccgtgcagctcctcggcagccacggccaccagtcggtatgccgcctccctttccagcacgttgggcgaggcgcaggccgcgtgcagcagccctacggccacgggggccagctccttgcggtgcccctgcgggcatgatggggacggggggtccacggggaggaaggggaggggctgggtgtggggcgcggccgcgcatccacagggcgcgcnnnnnnnnnntatggggacagggggtccacggagaggaaggggaggggctggatgaggggcgcggccgcgcatccacagggcgcgcggtgtgcgaggaggcatcacgagcttgagagcgccgagccccggccagccaggacgagctggtgacggcgctgacgaccatcctctgcacatcatgacagcccacccgatgccagccctcccctccaccccacccacctcgaagagggccagggccaggttctcggcgcacccgcgcacgctctcctcccaggccacgttcatcagggcgtggtggaaggcctccggccccacggcccactcctccaggtcctccgaggtcagcgggatgtagcgcaggaccaggctgcggaggaggcgtgggcgccggtcctccgcgccccagaactcctccagcccggctcggacctcggccgccatggaggactgctgctccacctggcgccgcgccgacaggttcagggtcagggccgcgctggcgcctcggtaggacgggcagcgcagggtctggtgaagcaggagcatgggcaggcgcgcggcggcgccggcggccgcgccgcgcccagggcccgccagccagtccacacaccattccagcagcgggagcaggacgcaggagggccagaagctcctgcgagagggggaagctggacgtttgctctcggaattttgggggagatggagggagaccctatgcgagccccaagcatgggtgggaaggggaccctcctcccctgaaaccatcgcagggcgcagcgcgcaggagnnnnnnnnnnggggggaagctggacgtttgctctcggagttttgggggagatggagggagaccctgtgcgagccccaagcaggggtgggaaggggaccctcctcccccgaaaccatcgcagggcgcagcgcgcaggaggatggcgcgccgtgccctttcccccctcccgcacccctcaccaagggtgcagctcctggaggtggagcagggccttgagcagcttcagggtgccttcctgggcctcgtcccgctgcagcaagcccagcgcgcgcagtgcgctcagcagcgctggcagcgccgccaccacctcgctcgagcaggtcaatgtccgggcgtccgaggggaagccgtaggccagcagccggcggagacacttgaggcccagcagccacgagccgtagatgggggccgggccgccccccgggttggacagcagggccaggagggcagcggtgtctgccgaccagcgggacgccagggggccgagtaggagggctgccaccgcctcaaaggcacgctggtcggactggagccgcttggaggccagctccttgagcacatgatgcaggaccagcagcgtgcgctgctctgcaggaggggtgtgtcgaggcgggggagtcgggggggacatgggccacgtgtgcttgggtggccgggaggcagagtgtgccccctctgccccgagtgggtccgggcggtttgtgctacagcacccacccaggcgcatctccacagatggcccaacaagccgacggccctgcgcatggaaatcatcccacaatgcgcatggctagcatccccacagcaccagagccatcagtgcaggggtcacacccccagcagcgcataaattctccctttcccacctgtgtgcctggaggtggcctcagacaggagcgccagcagcgtttggaagaggtccggccaggctttggggtagtccacccgtgcaatcttggagatcacaactgccacttggacggcaagctgcagcaagacatgcagagggggggaggtctgttcgggtgaagtaccggaggcacatgccaacagatgcttggcaacggcaatgttgcactctcactcgaggagcagtaaaacccttcagcatgagcaggggactnnnnnnnnnnttgttggggtgaaatatcggaggcagatgccaacagatgcttggcgacggcaatgttgcactctcacttgaggagaagtaaaacccttcagcatgagcaggggactcccagcactgagcactgtcatttgcgccgttggataaccatagattccacctctgatggtgatcgtctcaagagcacagcgagggaaagctcacacttgcctttggatcctccagggctaaaagaccgagcattcgagagcgaaggtgtgctttttcgtcagccgacagggccctgcgtgcatacagacagcaagaataggtgtggctgcgacctttaaacctacatggggtcctgccaaaattggcttctgaccagcaatgtaaggtcagtgcagatgtgcaaaccccagatccatgtaaatgtgcgcatctgtagacacaacctctgtgttctcaccctggaagaatactgcgccagtgtcgcagcacgatgttcttgagctggaggactgccatccaccggcatgaggagtccgtatcaggtgtactcaaaatttcctggggacccaggtgaggatgggggagggcggggaggggggatgagtcaaacgctcagaccattggtagaatgcgtttcattatcgatgcaattacatatttacttcagatctgggtgtccacctcattgattccagggcccgggcgacatgggcactcacgacgagacaggaacagaagccgggccgggctgaaacggacagcagctccgcctctgcagccttctgagtagtcggatcctgtgtaatggctgccatcagtacatgatggagcgcagggatgtcggctggcgtcaggctcgccatggtgccagagcgctgcgaactcgcgctctgggcaactgcaccgcccttagccccgccaccaacagcgaggtggtgtcctatctacgcatgctttactccagttctttgtgatcgtatcgagtttccttgagcactcctggtcgtgattgctctgccttcggcatacagcgctggacctgtttattcgtgagttgggcgcaggggggacggccacgtgctttgtcccggggtggcattcgagggaggcacagtcaggcctccgagggggtgctcggccaaggaggtgagccgcgaaatgagctgcacagcgccctacgtatctaaggctcggcagaggacgcgttcagaccctttgataaagacacacgccaaacagaggctggtcgcgcccccaacagggctgccatcagcgcagcatgcggccctttatcctgcagggccactcccggcccctcaatcaagtcaagtgagtgaggttcagcgatgaatgaaaacaagcttgcctccctcctggcgatcactctcaccccacccgccgtcacgcgcagatataaccgggagggcgacctgctcgtgacctgcggcaaggtacggagtgacagacccctcagccgtttcttgaggaatttagaaaccgctgggtaccatgatagtttcgattctcagccgtttcccctcctgttgccgcaggacaagaccgtgaacttnnnnnnnnnnacatgatagtttcgattcgcaaccgtttccccccctgttgccgcaggacaagaccgtgaacttgtggtggacggaggatggccagcgggctggcaccttcaatgggcacacgggcgccgtgtggacctctgacatttcctgtgggtgcaatggggtgaagtgggcttgctgcatgcggtgattgagcagccacctcttggctctgggaggccgtgagtcccagcaacggtggagtcggatgtatcgtgcacagggcgatccccatccacgccatctcctcaccctccaccgcctgcccctctggacatccctcacaccacagatgacagcacccgcctgatcacaggcggggccgacagcgccgttatcctgtgggacatgaacacgggcgaggagcagcaccacttccggttccaggagccgtgccgcgcggtcaagttttccgtcggcgaggccttcgccgcggtgtcctccgaccccttcatgcaggccgtgtcggcggtgcgcatcctgcccatcgcagccgaccccgcagagcagggggaggaggcggtgcagacgctgcgaggcccccgtggccgcatcgcacgcgtggagtggaccgatcagaaccggaccctgatcaccgccagcgaggacggcttcgtgcgccgctgggacgtggaggtgcatggatgggtgtggggggaaaatgtggctgggcgtcctcggatgggaagggcgacagccctaataccaggaagtcaggctggagccctgtggagatttcccacagcccagggtctgggctggcgggacagacagctgtgatgggggttggaacttcatacgggctccattcctggatctgcaatgtggaatctggggtgcagggcccacggcttggcccgctgcccctctgaatcaatgccatgtgcgggtgggaggtcgattcccctcccctcccaccgtgctcccacacatacacccactcccactccccaccccctctcaccccatccacaactcagacnnnnnnnnnnttggggtgcagggcccacggcatggcccgctgcccctagaatcaatgccatgtgcggatgggaggtcgattcccctaccctcccaccgttctcccacacatacacatacacccactcccactccaaccccctctcaccccatccacaactcagacggggaaggagctggccgccgagcacgtgcacgagaagaacatccaggacttgcagatgtcggtggacggcacccacttcatcaccgcctccgtggactgctcctccaagctggtggacacccagaccctggccgtgctcaagacctaccagtccaacgtccccgtcaactccgcagccctctcacccgtctacgaccacgtcatcttggggggcgggcaggacgcgtcccaggtgaccaccaccagctcgcgggcggggcgtttcgagtcccgcttcttccacaaggtgttccaagaggagtttggtaacgtgcgcggccactttgggcccatcaacgccgtctccttcagccccgacggcaccggctttgccagcggcggcgaggagggctacgtccggctgcacaaattcgacgccgactacttcaccaccaagttcttctgagccggatggatggagcggtctgaggggaaagtagagtgcggagcctaggctgtgggcccttgcagccagggcagttacccacccagcttccccccatgcctctgtgtgtgggcgacggggagcggtggggccaggcttgcacgcctgccacccctccccctctcgcagttccaaggctcaatgtgcagtgcccatgaggcatgacgcggaatccctcctgtcctgctatgcatgttgtggtgtgctggcccttttcccgctttcccaaacacacgccatatctctgtccatgcctgctctccctcaatcgtctgggtgccgacgactgcctagttctctcctggtaccaactgttactggagaggggttcgcctgcatcatccgtcgcagcgttgccaggaggacaggcctgggcatagtcactgtccctcccaaagcaggcagagcaccccctacacgtatgcatgtcgacacattgcccaccagagcaccgcacttccttgagcacagatgcgattcgatgaagtaaccaaattattacaatggcgaatccgagcgacatcatgggcccagcactggaggaaagcannnnnnnnnngaaccaaagtattacaatggcgaatctgagcaacatcatgggcccagcactggaggaaagcagcgtgatacctactgtggcggtgggccccgacaccgacgatggcgcggacatacagatcgatgataaactgcgccgggctgctgagagggagatgcgtcgaagctcaaatcccagtgccaagcgtgtgaggacagaggccagcattggccgcttcgactacgccgcgccagggctcatggaggagggtctcacaggcttcctcctcacatctacctttgacaggtgcgctggagtcctttgcagtttcaatgtgtgtaaagcgcatacatggtagcagtatgttgctctgacaccttcagaaccagctgttcctaggttgcttgttgaccttcacgctcccactcccccatgcactgctgcagggagaagagcgccttgaaggaggctgtggcgctcctcgagggtgccctggtgagccagcctaacccaatccaggcccttcccccactctctagcatcaagcttgcagcgaggggcttgtccgccctccgcctcatgcccagcagtgctgcggctgaggtcgccggggacctaccttcccccaacagggatctggcgctcctggccgcctccctggccgtctccattgtgacgggaggcagctcagcgcgttttctccagcgactgacccccattcagaccacctgcaccgctgatgcgacagctgtacgaggtgcagcctcggatctggccacccgctctgagcactggcagtactgctggcctggaggtactgcgccagacagggaagacgaagcccagctgcttacttttgcagttgcgttcaagccacgtgggaatcaaggaccgtgtgtcggcgaggcggtgaagagcagggaccaagcagctgagccatcaactgcggttgcctctggacagggagcaaatgccctccctgccggtgggttggacaaggaggccagccctcccagcacggatgccagtggatcagcgcaggatgctgtgcagacatcaagaccaaagggcgaccagggtgctgctggagctacccagagcttgcgtcaggagcttacggcggcggcggcagcaggcctccaggctggcattaaaacatggctacctcactgcacagtcagggtggatctggcagaaccatcgctggtggtcttgctggagatgctgcccgtgggcggtagcaaagtgtttgcgggcctgtccctcctgtctggggaggcgtgcaccatgaagccccgcttggccatcaaggccctggagaaggcccacaaatgatgaaaggagtgcacgggttgtgtataaagaagcctgctcacctgtcatgttaaaggcagagaggacagcacaattttgaagggggtccgtcgtgcgccacttccgttcggagactgaaccccggtcgcattccacactgctggaccatgggccatacatcacgcgcgaccacttgtaacaataacccatatatagtgaagaacattaagttgcatatcttgaagtcccagaagactccggcccccgaaaccccagtggccaccactccggtacctcggggtgtggcgccccctcgcgcagggggatgcgcaaggggagcaagtactacgaggaggattacgatgatgggtacgatgacgaagaagaggaggaggacgaggaggagtggtacgcggaagagaccgctgcccagcctcctgcaccaccccaggtgagagctcaatgaaaggagagggtgccagggggcagatggtgtgaccccgaagtgcactgcatatgtcaccgcgatcagggcccaggatacagattgataattccatcagcgctgcatcacctcgcccagcatgtgcagcggacccgggtggccaagaccgcaccctcggcgctggggaagggcttgacacaggccccaggcgccggcaaggcagagggtgagcttccggtgtgggaccgtaattgatgatgcatcgctccattgccgaggtggtccccctgtgacccgcacccgttactccgctcaggcatgtgccccccactcacgcgacacctgtcctgcaggtgccaagactgcccaggcagcggccctgcgcnnnnnnnnnnggtgacccgcacccgttcctccgctcaggcaggttgcccccaactctcgcgacacctgtcccgcaggcgccaagactgcccaggcagcggccctgcgcagcgcgccacagcccctggtccccggccctgccggccccttccgctttgacaccccctcgccggacgacgcggcgcgggaagccgccgctcgcgggggcgcacggaagaagccgccgggaggccaaccgcccccgcccgcccccgggccggccgcgaaagacggaaccgaggaggtgtccgaagcgttgcgctccaagctgcggctgggcggggcgccgaccgaggaccaggccacccaactgccgcccaccccgcgccacgccctgtccgcctacgagcccagcgccgaagtggcgcgcgcctgcgcggcaacggtggctnnnnnnnnnngccccgcgccgtgccctgtccgcctacgagcccagcgccgaggtggcgcgcgcctgcgcggcaacggtggctgaggaaagcgcagcgggtgccaagccccgcctccaccttgtcgtgctgggccatgtggacgccggcaagtcgacgctcatgggccgcttcctagtggagctgggcctggtcccgcagcgcgtcgtccacaagacgcaggcatgagcacgggacaggcaggaatgggcggggactggggagcctctgctgctccgtcgcaaggctgtcacggggtaggaggcgccgctgcggcacggcgcagggcatgcgtcgggtgccctgatcccttgccctgtccctctaccctccgcagcgtgaggcggcggctgccgggaaggggtccttcgcgtgggcctggatgctggatgagcgccccgaggaaagggcgcgcggcgtgacggtggaggtggccatgaccaggtgagctggaaattgatcaggttggtatcgagacaagatgccagggctccccagccttgcccaaggtcagtcaccatgttgacctcccggtcagccgcaataccttggttcctccccaccctcactccaacgacccgtgctgcgccaaagattcgaaaccagnnnnnnnnnncaccttagctcctccccaccctcactcccacaacccgtgctgcgccaaagattcgaaaccagtcagcgtcaagtcacccttttggatgccccggggcatcgcgactttgttcccgccatgattgcgggggctgcccaggctgacgccgcgctcctggtcgtggactgctccgtcggtgtgcgggggagccggggagggtgggaggtgtggtggccaggggcgtgtcactggaatcccaagcattcctttggccccttgnnnnnnnnnncgcggcggagccggggagggtgggagtcgtggtgatcaggggcgtgtcattggaatcccaagcattcctttggccccttgctggatcatggcctcgatgttccatctctcaacccccctctcacccacccaggcggcttcgaggcgggcttcgcgccgccctccggcccagggtcaatcgggggccagacgcgggagcacnnnnnnnnnncctcttaaaccccctctcacccacccaggcggctttgaggcgggcttcgcgccgccctccggcccggggtcaatcgggggccagacgcgggagcacgcccagctggcccgcagcctgggcatcagccagttggcggtggtgggcaccaagctggatgccatctcgggcgacccggaggagcaggccgcgcgctttgcggcggtgcgtggatctctggagccctttttgaagtcctgcggctttgccagcagggcggtgcagtggctgcccgcctccggggtcacgggcgacaacctgcgcgggcgcggggacggcaccgggttgggcgcctggtggcgcggcggcacgctggaagacgccatcgacgccttccggcctggtagtggcggcgagagtgagcgggaaagggcgctccgcctgccgctgcgcctggtcgtgcacgaggcggccgccgcgggctccaagggagccgcgcagctgggcggcaagctcgaggcgggggcgctgctgccgggcagtcgcgtgctggtcatgccctcgggccaggccgccacggtgcgcacgctgggcgccgagggcgccggcggcgtggcggcgggaggtagcagtcccgccgcgctgctggccggcagcggcgcgtcgctgacgctggcagggctggacgacccggggtcggtcggaccggggtcaatcgtgtgcgaccccgcctggccagtgcccgccgcgtcggctttccgggcacgagtgctggtgctgcaagtgccgggacccatcctgccaggccagcaggtaagggtaggggggcggagggaaagtgggaaagtggggggttgaggtgtacatctatgaggagcggacggggcagggtgtccgagagtatagaggccagacaggttctgttgcagggatggccggagtggtcgaactgaggggcgatgctgatgtgctggaccaggaggcccaggcaatggactggttgtcatgcgagcagcaaggtccacactaaaccaggcattcagtccgagcgctacctttccctgctcccgannnnnnnnnnttgctggaccaagaggcccaggcaatggactcgttgtcatgcgagcagcaagatccacactaaaccaggcattgagtccgagcgctacctttccctgctcccgaacacaggtgtcggtgtactgccacgccgccaaggagagcgggacgctgaggaggcttcagcaggacgggccctcgccccgaccggcgcgctttcttgtgtccggccagcgggcgctggtggaggtggcgctggcgaggccgctggcgctggagacggctgccgaccttcccgcgctgggcagggtggtgctgcgggacgggggaaggacactggccgtgggcctcattatcgagctcctgtagcgtgggagagcctggccgctctgctgccgataacccaagctgttgttggccaaccccagacacgtggctaccgtgtatgttgaaggaatgctggcatgcatgggatcgccagttcatatacaaaatacgaagctgcacatcgtaagttcattcagtcttgcgtgatcgcgacgtgtatcatgcgagggggtcctgtcgcacggccacagggtctcatcaccacccgggttggcgggcgtgcccgatcatcgactctccgtcccacgggagctgcagcacaattacgaggggggcagtaccgctaagacgaagatgtttctataacacatcgttggatagacgttcatgnnnnnnnnnngattacgagggggggagtaccgctaaggcgaagatgttgctataacacatcgttggatagacgttcatgagcttgtagatgcccaatccatgtcggagatggtcgacatgtggacatgaccgtgccccaggaacagtttgtgaacctcgtgaacgcgtcctgatacaaatctattaaactactgatacccttgaggtgcatgccggcatggtgagccggttgttggtgcgagtctggggctggaggaggctgcggactggagtggcacccgaaggcgcccttcccagcgtcacagaggtcccctgccagatcaagatccacccagagccgggcgaagccaccacacacacggccgagactctcgtgcagtgagtgtgtggtggggatctgtgcatgtttggataaccaagtcatgaactgattggggtctggtgctctggctgacgggagttgccctgctctaccctcgtctcacctgcatccccaatccctgaccccaggtcctaccagtttccaggggaccgcaccagcagccgtcgctactggcttctgttctccctcctcctgggctccatcctgtggtggctgggcccgctcatgggcatcttcgtgctcgatccattcctgcagctgctgctagatgcctcccaggtgtgcccagcgccgccagtggcactgactgtgtcaggacggtggcattagcccagttgcgcgggatccgctctgttcagcgatgaagctggaggggcccgggggggctgggggactggcagtggctttgagaatacattctctcaccccgaagcccaactcttgctcatcaccacaggtcatcacccccgataccgactgctatgacaaccgtatgatctcacagtcctgcaagtcggagaccttcattgactattactttttcaatatcaccaatgccgagcaggtgaggccttggtggtgtgctggcactgctgtgggcagcttgtaggagggatgggttttatcgagcagtcctttgcttggacactcccatctcaccacctccgtccccacctctcttgcagtggctggcggggaccgagccgcccgcataccacgaagtgggaccctacacctttgccacgggggagaagcactttgacgtccagtacagctcggactggagcacggtgtcctactcttactaccagtggcagacgctgcggccggacctgagctgcgcagggtgcagcatgagcgacaccatcgtcggtgtgaacaggtgagttgattcttgcggtgctttggggcctgggctgggcgggattgtgtgcgcccagtgcagggttgctttggtcccaagtgctgcagaataaatggtgggcatgttgcccgcaatcccggcaggcgcaggactgatgcaggaacacattccagcgaatgatgcctcacaaagcagcaattgtatcttctcagctgccatataagcctcagcctctgataccccccttacccactaattcccaaagaggttaccagcagctgctgcagtcggcggcgggggcggccatggacgccgagacgggcatgatctactccttcatgccctccgtcctcttcaccatcaccgcctccatcgacgccgcgctgcgccctgccaccaggctcgcgcttcagggctttggcatcaccgaccccgcgcaggtggatgctgcggtaacctcggcggtggcctcgcagtgggcggcctgcggcaccctgctcgccgccatgagcaacccggcctcaggcgtgacctcccccttcctgtccagcctggggcccttcccctaccccccggaattctgcgcctacctccccggcgccatggcgccctacctgggcttccagcctgacccctcccagttcggcgccctcgggctggccctggacaccggcgcggcggccgccttcctggcggcggcaaagggcgccaccaacgccacggccatggaccctgcaggggcggccttcctcggcgccttcctgaccaccccccgcgcggcgctgcttgcgggcctggcggccgcgccggccacccaggccctggcgcaggcgctgacccccatcaccgccacgcagtggggcctgctccagggctacctcgtctctctggtgcccacctgggggacgctggtctatcgcggcttcctccaaagtttcgccggcagggccggcctggtcctcaccaagaccgtggaccagtggctgaatggtgaggggagagggggctagctgttggcgtgtgtgcccccatgatatggcgctgcctgcagcagagccaggcctgaggtcatgcagaaaccctgcactgttcccctctccacccggatccaccccctcccaccctgccctctgtcccagggtatgaggatccgatcctgctgctggccgccaagcagctgcaccccaccacctggcagctcatgccctggacctacacgccacaactggcactggccttccccacggaggacgcccccttgcgcttcttccagcagaccacaggggcgccgatggcggtccaggatctgagctaccgcgcctcagacataggcaggtacctcccgctcattcaacagcgggccctctccacgggccaggcggccaacagcacgctgttgggggtgcgttggctctgagggctcaaatgttgccgtggggttgggtgcctggtgtcagggactgatgctcgacagctttctgccaattctgggagttctcaggagcactgacgagcgttgcggcctggctctcatccgcgacctgtacgcctggatctcaccacccattcaccctctacccgccaggtggaggagtaccnnnnnnnnnntgacagctttctgccaattctgagaattctcgggagcattgacgagcgttgcggcctggctctcatcggcgacctgtacgcctggatctcaccacccttccaccctctacccgccaggtggaggagtaccgtggggtcccatttgtggcatacgcggacggcatcatgaacatgacgggcatctccgagggtctattggtgctggacaccaacaaccccgccacccagcccatcatctttgaggcaggcctcctccggcccctgcagacgcggcagaggggtgagcgctggcggggctgattggtcttgttcatttatgggtctgcgtatggcaagcagggtggcaggcttggcacatgacacaggagtgactagtccccaccacgcatgctcgtctgccctgcatcctgcaccaccctcgtcttatgtcaacccctctcctccaacaaactatccgctcaactgcccagggacaaagagctcggtgaagaagatccacacggtgcagnnnnnnnnnngttggtcttgttgacttatgggtctgcgtatggcatgcagggtggcaggcttggcacgtgacacaggagtgaccagtccccaccgcgcatgcacgtctgccctgcatcctgcaccacccccatcttatgccaacccctctcttccaacaaactacccgctcaactgcccagggacaaaaagctcggtgaagaagatccacacggtgcagttcacgatcgaccccgtcagcctggcctcctgcaatgccagcgcctatgctgcgtgggcgcaggccactcagtttgaccagggcaagttccagacggccattggagctctgacggcagccagcaattactgggacctcgtgcagaatgacatggccctgactactttcttcgaggggaccacttttggatcgctggggttctactttgggacagaggacccacaacgcgacaggtagaagagagccgggggtggtggggggaagggatgattgctcctgccgtccaggagccatggtgagggtctggcatgagggcaattagagctgacgattgtgaaagactgttccctccaaacctcccgtttcccctaccagatgtctcatccccgacgagtttgagggggtctttgacctcagcgccgtcttcagctgcccannnnnnnnnntgggggtggtggggggagggatgattgctcctgccgtccaggagctatggtgagggtctggcatgggggcaattagagctgacgattgtgaagactgttccttccaaacctcccgtttcccctaccaggtgtctcatccccgacgagtttgagggggtgtttgacctcagcgccgtcttcagctgcccaaccctcttctcgttcccccatttctacctggccgacgaacggatcgtgaacagcaccggtgaggttgcctatgatggcgtccaggagcctcacgcagtatttgcagcctgagcatgtatgtgcctggggtnnnnnnnnnngtacaatggcgtccaggagccttacgcattacttgcagcctgagcatgtatgtgcctggggtgccaggctcagaaaggtgtacctatgccaacaatctattgctctttgccccccaaaacaactcagggcaaagtgagtggcagccagaccccgtctctgacggctggtactttgatgtggagcctttcacctccttcacggtgggggcccacaaggtgtaccaggtcaacaatctagtaagccgcagtgcccatgcataccccaacctctgggtggcgccgggcagcggccaggccgccgggcgcgccgccgactttgtaacgggtgagcggtttgacagtgactgcccttctggagggagatctggcctgcgaggaagaatggggaggcagcgggcagatgtgcttatgagagcaaatgtccttgtgcattcatccacaccagagccaagctagagaacctttttctcactgataggctctcaaacctaaactgcccatgctcgcagtccctagcttccatctgctaatgtactggcagccgacagacaccaatgccctggtcatccggggactggtcacggtgtgttagggtcgggatttccacgcgtcgatggtgcaatcgttacctcctcgcttgcatggggagatgcgctgggagctcgggtcttccttgaactcggtcctctgctcactgtccccctcagcgcagtcaaagtgtaccaccgcatcctctccacccctcccaggcccagagcgtcctgtactacacccttgtggtggcgtgcccggtggctggatggctagccctcatcgtcagcctcctcctcctgcacgcaaccaggtgggatgttgcgctgggaggaagtgaaacggactctctgcgcttttcccttgggatgactggtatgtcgccgccctccctaatgcctagaatctgagcgcaacttggccaggggatgatggcaagtgcccaacaaccttcctcccaaaactcggttgcagcgcggccaaggcccgcaggctcgtcctggcacggctgcaaaagtctcgggcccgctccacccgcctggggaagcaggaggctgagatggtggaggccctcgtcagggtgagggatgcttgggatttgggcagatgcacagatgcattcagcagatcagggtgctcctggtcagagcggcacctacagggcacaattcgtgcctccaccatcaatggagcgaccagctcacttgctgtctctatctgatctgttaggcgcacatgtgccttatcggtgcatcacaccccatgccaatcgaccatttccctctcttccccctaggtcgcgcgggggagcgcaaatgtggtggtgcccctagacgtcagcgagtcgctggaggaagcaacggagcaaggcgagagcgggagtgaggacggggcgcagcggcctcctgctgcggcagaggacccctttgcggcccgcaaggcggctggagatcagggccacaactccgcccccctggacgccctggccggcaaggtggcggcattggaggccgatgagcagggtgacagctggctcgtgaggcctgcggtgctatgcatggacgcgcccagtggatccacgccacccccggggagccgccccagaccctccccgnnnnnnnnnnccgtgaggcctgtggtgctgtgcatggacgcgcccagtggatccacgccgcccccggggagccgccccagaccctccccgcgcatgggcctccccgtttccacgaccgcgcggtcgggggagtccggcgggctgattgcggcgatccacccggctgcgccggggggagctgctgacagcgcagatgcgaatgacagcgacgtggaacgggttctgcctcggccgagtgacagcgccagccccggccggcgcggccgaaatcttgatccagtgggggctgcctcgccggcatgaggtttggcccccgccctgctgcctgccgctgccctgccttgcccactcccaggcacccctctgcagctcaccacctgcacctttctcactccctcagcatgcatcctgaaagcaagtgatcgctcgcgcgcattacagggtcctaggcagcatgcacagcacaggcggttgcctcacagcttggcaaacttggtgcggatggcgtccatgacggagcccaggtcctcccgcaccgtgacgggggggttggcgtacctgctgctcagcccctgtatctcggcggcgtggtaggcggtcttggactgcgtgaacttgaggccgtgcgcggtggacacgacgacggtgcggtcggagggggcgatgacgccgcgctcgcgcagcttgagcagcgcggccagcgcgaccccggtgtgggggcagttgaacatgccggtgaggtcggcgcgcgcggcggcgtccatcagctcctcctcgctggcctcctccacgatgccatcgcaggcctccagcgccaggatggcgcggtgcaccgacaccgggtccccaatctggatggcgctggcaaaggtggtctgcgccttgacgggggcaaaggtgccccagccgtcgcggtacgcgcggtacagcgggttggcgttgcgcgcctgggccactaccaggcgcgggaggcggtcggtgaggcccaggtcgcgggccagcttgaagcccttgtagaaggcgtagacgttgcccaggttgccgcccgggatgatgagccagtcggggacctcccagtcaaactgctgcaggatctcgatggccgccgttttctgcccctccagccgcaggctgttcatggagttggccaggtagatggggctggcggcggtgacctcctggatcaggcgcatgcagccgtcaaagtcggtgtcgatggacagcaccagcgcgccgttggcgatgggctgcaccagctgggccagcgagatcttgtcggcgggcaggaagacgatggaggggatgcccgccgccgcgcagtaggcggacagcgcggcggaggtgtcgccagtgctggcgcaccccactgcctgcaccgactccgggcgcagcttggacaggcggttcacctggctcaccagcaccgtcatgcccaggtccttgaaggagccggtgtgggagttgccgcactgcttcacccacagatcgctcattccaatctggcggccgaagcgctccgcccagaacaggttgctgttcccctcgaacatgctgacgatgtcgtcgtcggagatttgctgtgatgtgaggaggaaggggggggatgcatggcaaggctggggtgagggcaggcaggggtgggtggactccatcatcaccaccaccattggcaaggaccaatcagctgcacagctgacctcgccccaccccgctattatgcacctttttcctcccaagggacttccgattcgcatcctacccaccctcagccccatgaacaacaccaaccgcaacccaacacgcaccggcagtacccactccttcttggaccagacaccggagccgtggggccatctggcggtgcccacccgcccgtcaaacagggtcttccagtacttggcatcgtacttggccagggcctcgaagtcgtgcttgacgtctagcaggcctccgtccttggcgcggtagaccacgtcatccaaggagtaggtctccttgcccacggtgccggaggcgatgtcggcaaaggggacgtactctgcgcggaacgtgccctccgcgcgagctgcatggggagcgaattaggacatgggattcctgagctctagcatcaggcgctatacaggccctataacgcgcatggttggcccgcagggacgcactcacccctcaggacggcgttggagcggatgtctcctggagcggtggaggcggatgcacgggtgcataccgatgcacggcgtgcgcactgtcgtgcagatggtacagacgcccgcgcgggcaggctgggggcagaggtggagggccccagggctccagctgaccggtacatggtcctctgcaggccgacggtgcctgcgacgttgcagcctttcaacccgatgatcacgggtaggattgaaacagagggtgatcacgcctcgagccggagcttgctgtgcgggcgggacccgggcaggttcacccccgaaataccccgctaatatcttcacgtgcgtcgtgctctgctgcttggggttgtgcgcgcccaatcctgcatcgggccctccagtttcctccaatctggcagtgttacagctcgtactagtgctcgcccacgcgaggaagtatcgttatcgagctaacattcatatactgggctgatcaggaagtttgaccccccgatcgcggcactgagttccagacaggcaccccccgctgggctccctgcttgggctggtaaatctggccctgcatcctccagggcgcacgccaccctcctgcactggattaaacacagattcggtcttgtgctggggataaaccgcttcccaaagctaccaaggcctcaaactcgcaggcatgtcgacgctggtggcgccagctgcccactttccagcccggcccttccccgcctctagcgcccggccacggcgctcgccctgcagccgcgcccatgcgtcagatagcactgccgccccagcatccgccttcgacgagctggtggccctggccgtggcccgcgacccctccctggccccaccagcaaaaaaccaggcacccaaggcccccttccgcacccttccccccaaggccccctggctgcgccagaaggcgccccagggcgagcggtatgagtacctggcggagcagctgtccggcctgaagctggccacggtgtgccaggaggcgcagtgccccaacatcggcgagtgctggggcgggnnnnnnnnnngcgagggtgagctgggcaccgccaccatcatggtgctgggcgacacctgcacccgcggctgccgcttctgtgcggtggccacctcgcgcgcgccgccgccgcccaaccctcgcgagccggaggacaccgcccgagccgtcgccagctggggcgtgggctacatcgtgctaacctcggtggaccgcgacgacttgcccgacggcggcgccgaccactttgcgcagaccgtgcgcagcatcaaggccctccgccccgacatcctggtcgagtgcctcaccccagacttccggtgagcgagtggagaggggatggggggtgcaggggggcattgcgctcgggcctgatgggccaaggggggtggcctgtggaggagctgccctgtgcctcgtcggcgccgtgctgagaggcacgtcaccacccttcctccccaggggcgacctcggcgccgtgcgccacctggcacgctcggggctggacgtctttgcgcacaacatcgagacggtggcctcgctgcagcggcgcgtgcgagatccgcgcgccggctacttccagtccctggacgtgctgcgggctgcgagaagggagggcgtgcacaccaaatcctccatcatgctgggcctgggggaggcggacgaggaggtcgtggacaccatgctggacctgagggacgcgggtgtggacattttgaccctggggcagtacctgcagcccacgccgcagcacctggcagtgcgcgaatttgtcacgcccgagaagttcgagtactggtgggtgggttgtgtggacaggggggggagaaggaacgctgagcggcgtagctggtcgttgtagtgtccccaggccggccatgcttgctggtctttgagacttggaaggaggttgtctgatggtcttgacggctatccattgccttggctttgactcatcatggttgttcagccctgcaccccacctcacatgcccaccacccacccactccccacgcacacacatctgcaggcggaaatttggcgaggaggaggtcgggttccggtacgttgcctccgggccgctggtgcggtcctcgtaccgcgcgggcgagttctacgtggcggccatgctgcgccaggaccgtgcagaaagcgcggccgccgtcaagctgcaggggttggacctcgtggcgcccgagttctgagatgctgcagctcactgatgggtggaacacgtgactcatgtgtggcgacctnnnnnnnnnnggcaaacagcgcggccgccgtcaagctgcagggggtggacctcgtggcgcccgacttctgagatgctgcagctcactgatgcgtggaacacgtgactcatgtgtggcgacctgccacgcgcgccctctgacctctgccgcaatgcaagtgtctgtggaatcttctgtttttacacgacgtctggcgcgaggggtgcttgtggccgcagtcgcggcatgtgtctcgtcgacgcactcccgagtgatggaggagggcggcagtcacgctgcatggggctcgacatggtccaggcaggccgcgcggcacctgggacctctctccatccggctggcacccgtcgcagccctcgcttcccacacagcctccacaaactcgccctgtcagaccttgcgcgcgccctgctggttcaggcgcaccacctgggcggagttggtgtccaggttccccgcgcgcttgaaggcggcggacatggcctccgccacgcgcgcccccgtgtccgggtccggcaccaccgccacggcggtcggtcccgcaccactgatggtgcagccgtaggcgccggcgccccgcgccgccgccttcaccgccgcgaatcccgggatcaaaggcccacgcacgggctcgaccaccacgtcggcgtccaggctgcggccgagcaggccggcatcgcccagcaggatgccggccaccaggctggcgcccgccgcgcagttgcgcgtcagctccgccatgggcacctcgctgcgcagcgcggcccgcatctcggcggtgggggcctcgaagcaggggttgaccagcgcaaaccacacatcgccgcccgggaaagcgaggcgctgcacgtccagaggctcgcagctcctgttgaaaagaggaaaggaggggacagggggaaggggtgaggcagcagagaggggggacgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccgcgccaggcttgggcttcttgcttcccatccacccaccactgaaacgatccacccacccaacacccgacacctgctcccccacctgatgaggacgaagccgcnnnnnnnnnntcccacgccagacctgggcttcttccttcccatccacccaccactgaaatgacccacccacccaacacccgaaatatgctcccccacctgatgaggacgaagccgcnnnnnnnnnngaaccacacatcgccgcccgggaaggcgaggcgctgcaggtccagcggctcgcagctcctgttgcagagaggaaggaggggacagggggagggggtgaggcagcagagaggggggacgacagggagtctcgcgtcagatgcctcccctgtcggcatgtgacagtggcctcagggatccagctggccacagcttcaacactgtggagctccaggctggcgcctgcagcaacaannnnnnnnnnnnnnnnnnnnnnnnnnnnnnnnnnnnnnncgaggagggccggggcaatgttgtcggcgtggtagcctgataccgcggcctccgactccagccccggcaggaccaggtccatggggctcaggggggcgccaaacagctcgttcaccgccaccgcagccgcggcggccgaggcggcgctggagccgaggccgctgcccagggggaggcccttgtgcagggtcaggccgacgccacaggcgagcggcgcgcccatggcgcgcagcgtagcggccgccgcgatgcccgcgcagttcttcacggggtcgagcgacaggcgcccgccctctcccgtcacgcgctggatcacgatctcgccggggcgggcggtgggcaggggcactgccaccaccgtgtcccccgggccctgggaggggtgttggaaaggtggagctggagggcttgcacttgatcctggatggggctgctctcaggtctccctgtggagccttggaccagaatgcatgcagcgcggagcgctgatgggcatgatctggccgggacccactccaggacgtctttcatcacccaccgagcggcgcaccctcctccacaacaaaacgcacctccaccgcacaccccagccagtcaaagcctgggccgaggtttgccacggtggcaggggcactcgcggccacctcgccccgcactggccgcagggtctccgtgctccttaggctgggctgcagagccgctcggcacaccgtgaagcatcgcctagaactacctacagttgcgctttttctatgagtgaatggagactgggcgtggcaggctgtgggagccaggaagggggtcgtgagggctgccatggggccccaacgacacacccagactgcaggcaagacctccctggagcagtcacttgcaaggaaggtgatgagtgcgagagtcggaggagctcacaatgcgtagatgctcggtctggtcacttggggcctcgcattagaaccccgtgcgctcatgcctgacgtgcatgatctgtggggagccgtgtgagaagaggccgctacacttcagagttgttttggaagtgtgcagaccacctttacatacattgcgcctattcacatataaaaatcagttctcagcgcgggcgaggcatgagggcagcgcgctctgaaatgagcatgagggcaatggcaacaaggcgtcctacgagcccctctcatccatggagacctacacttggaagctgtagccatcgctcgcaatgctcggaataagcagcctgagagcacagcgggtccaagcgtaaattatcgtgaactcgtcggtttacctgaacatttgctattggggatggtcatgtatggctctcgactgctcctgccctgttgaggaggcatttctgcgagcaagcactatttgcaatccatgtcttgtcgtcaatgtgagtggagcaggccgtggtggatgtcctgttggatgccttcagctggcagtgtactctggatcgattgggtcaactcgggagcgttttctgaggttattcaaatcatgaatggtccctcgggagggttaagcatgttcatacagtgttcaagttttaagaattggtgacattcaacgactttcatcacgtttctgcggggagcctgtgctactaacccgaccagtgggaaaccggcaggaggcttccgacaattgtgcgcggcgaggatggcagtccctttcatgtggaagccactggatatcacacctttattctcgacataattcgggcgacgtcgtcgaagaactttgtgtgtagctgcaggacgcttccttaagtctcggattcgacccggagtcgcacgggcgtggggtcccgacccgagggattatgtgattgttggtgggatgatttcatcaccagagctcgaactgcacgtcgcgacggcacagattgatataattctgtttatttattctgcgtggaacccgccttttcctcgcatctccaatcgggcagaacgcatttgggctcggcatcgtgtttaacctttaaccagcctgtgaggcgccccgtcgtcgcgatggacatgcacgccatgggcggcggcctggaagctggtaacgccactatgaccatgcacaccgagtgcgatggctctctggacatctccaggaagggaagctggcaaggtgagcaggccaggcgttggacggtaacttctcgggctggggctctcggggcgcggctggcatgccaatgcggtgtctgtgcctccttttgagagaccgggcggggtcttcggcgcgggtgatgtgtcgaattgggcggctccccggcatggggccttccgatttcgaaagggggcgggcgccaggatgaccccgtgatcttagtgtgatttgcgcggtcgaaagccatccacgctgcacgcgcctggctcgggcctgaccctctctgcaaacccttccacaaccatcgggcacatgccaagaccactgagagcctctccttcctgccaccccgtgcaggccacatcctgcctggctcggtgtttgtcatgtggggggcctggtgggcgtacaacgtctgcctggcggtgctgaaggccaatcattcccggccctacgcggcgcagccttggttcaggatgggcctgaagcgcttctactggatggaacccctgctgaagatcatattgccacccctggccgtgtctgtggagctctactttgatcacaccgccttcaggtgggtggacgggcgtgccagtgtgcccgggccataccagccatgcgtgggagtgtatgcttgcatctcaggtggatatcctggggtttagggcatggttgccagccccatatctactgtgccgtgcacaggatcgcgctgcttgaacaaggatggatcccatcctcctttgtaaccccattctcaccccacccttctccgactctttcaagcccctccaccattccaaacctgtaggtatttgtactgccccgagggcacacagtatgctggccggtacgccgtcacccacatgaacaactggcagcacacctccatctaccccgccttcttcgtctctggggtgacagacgtgctgtgcttgctgggcgtccccctcccgcctggcactggacaggtagggggcttctggaggccatgttttgtatgtatagagtgggcaagcctgtgaagctcatccgggcgaattctcaaggggcacagggtacagtgtcggggagccatgccaaatcctcctgttcaatcaggccatgcttgaaagccgtgccgccccctccctcccnnnnnnnnnngagctcatttgggcgaattctcaaggggcacaggctacagtgtcagggagccatgccaaatcttcctgttccatcaggccacgcttgaaagccgtgccgccccctccctcccctccaccccagagcgtgctggcgctggccttcggcgtcatgtccttcatcatgggctcccaccgcaagcacgagccgcttgacgccgccgtccacctcctcctcttctactccatgctcctggtcaccgccgcgctcctggccgagctggcgcgcccctcgtccccggcgctgggcctggcccgcgcctgggccgccgtcttcctgggcgcctggctgtgcgaggtgggggtcatcgagttcgacggcctgccgcagtggtccacagaatacgcagggtccgccatgtttgcgcccgtggtctgggccatgatcggcctactggtggcctccgccctcctggccctcttcgccagcctggcggcgctccaacgccgggggctgctgccggcgctgccgccgcgggtcgcgggctccggcgcggacggcgactgcccctggcagggcctggaccccaaggtggagccgcgccagacatccatgggccccgacgccggcgcggggcaaacatacacgcccgtctccgacggccagcgctggcccgccgccttccacatcgacgtctagtccgctggtatagaagccgagggcgagggtgaatggcagcccgccaacccccgcctgttcttcccctcgacaccgtgctctcctctcgctccctacctctctcgagcccgtcccaagccggcgcgccctgcggccccctcgagcccgctccgccgcccttgtctctcgcnnnnnnnnnngcctctctcgagcccttccaaagccggcgcgccctgcggcccccccgagcccgctccgccgcccttgtctctcgcatggtacagggtcagttgcacacattgacctcccccagacactgcactctcctcgtctccccctcgacctccctgggatcttcacagagagtctatctatttgaagatgacacacttggaacttgagcctgagcgatgccccatccttggagcctgcctgccttcccgtcctcattgccctgacccaccccaccccggaccaagtgatggaggggcctgcctgcctgcctggtccgctcagcgaccccggcaggcccatgcccatggcctgctcattgttccctaggatactcccatcgcccgccctttcttggcgcggcctaggcacacaccccacacatcgtcgcagtctactacttcccatgccgccatgagagcggcgtgctgtcgtcccggcagggtcaccgcaccccgcctcatctctctttgcatgccagtccgcactgtctccttccagttgatgccctgctttgctgcacctgtgatacctgtaccccgttgccatctggtgttgaccagagggttgaatggcttggtcagggcaagcgctgcactgctcctcgaagccagtgccacgctgtgcacgtgactttgtggggagattacagcaaagaaggggggtgccggagtcactgcgtcaacgtactggggagcaaaaaggtagcaacaggagggtccgagggcctatcgggaggtggggggcggcgtgttctcctcgctgctcccgttgcggccgtgggccatggctgccgagcgccgggtcagcgccggcttctccgcgaggccgcccaggacgggctgcgccgccgtcggccgctccttgagcacgggcgcgggcgtgagcttttcggcgaccggggtgcctgcgggcgcccccggccccgcctcgccggccaccccgggggcaaagggctcggggtcggagcaggccagccgccgccacacggcgtacaggccgccgtactcggagaagcgtgtgttggtgggcgccgcgccctccttcctcaggcggtgcacgcggagccagggccccaccttctcgtcggcgaagaaggcccagagcacccagcaccaggagtggtgctggtacatgggctcgtagaactcgggcgcgatgcggcgcagcttgtgcaggcgggtgtgcgggatctgggggaagtcgtggtgctcgttgtggtaacccacgttgtaggtgagcgcgttcatggggccgtagtagctgtacgtctcctgccccttctcaaacatgtagtgctccgccagcaggtgcccgcccatggggtgcagcaggctgcccccgatcagcgacccgatcagcaggtaggccacaggcttcaggccccagaaatagagcaaggccaggtcgaagccgagcgtggtggcccagttgacggcgtcggcggcggagggcggcttggggcgcacgatcagcgggcgcaggccgtagatgcagaggtagaccaggccccaggccagcttggcggccaggctgcccaccgcgcccacctccagcacggtgggcaggtccacgtccccgccgtcgatgcccaggaagaggtggtggtcgtggtggtactcgcggaacttgaccgcgacgggaaccaccagcaccatgttggaggccaaggccaggatcttgttgtacagggggcggcggaaggccaggaagtggctgatctcatgttgggcggagaacaggttctggttggcggtgccggagatgaagtaggaggccaccagcaccgcgccccaggaccagtccttcaccagccaggccatgtacacctggagcagcatcacgcaaatcacctggtggtggggcaagggggggggggagacatgtcatgagggagggggggtgaggcagggtggagggagagtcgcacgttgcaggcgggggtggggagaccctgctcctttctcatcctcttttgagttgggccgcccggccgaggggagctgccgaggcggggggtgacatgcaggcccgtccggtgggaatcacacacaataacaacaccccgaggacccagccacgcaagtgcacctgccaggcggtggcgtggtcgtagccgtagagcttgcgaacttccggtccgtacttggccagtatgagccggcgtcgcatggcatggggctcgccattgcccgcccacaggaaacgctgtgcgtcgggctggtccagtccgaggtccaccatgccgtcgggggtggagagctctgtggctgggaggcgcgggccgcttccgagacgcctgtcaaagggctgtcgcaggggggcttggggcctggctgccgcactcttggattgctgggatgttgattactattcaaaacaggaggtcttcagaacaggaggtggagctgcgaagctggagctgaacttcgtctgtcgcacgcgctcggaggccnnnnnnnnnncctgtcgcagggggggctttgggcctggatgccgcactcttggattgctgggatgttgattactattcgaaacaggaggtcttcagaaaaggaggcggagctgcgaagctggagctcaacttcgtctgtcgcacgcgctcggaggcctcaacgggcacggtgtgcggcaatggtaaagaggacagtgtctctgaagaaaaacaagtgtgggatgtgaagagattattctctctcctggtgggtgtgagagggaagggtaggcggagtgcacgtcttcagatttcggggctgcgtggacgtgcagctcaccgtgcgcctggctctcagccggcccttcggggtcacctcttcctatcgtaatcgccacccacgtgggtcaaaggagaaggagaccgaccgtccccgaacccgagtctaccttcccttatgttcaggagataaaatagaagagctttgctccgacgtcgtgccttgcgccatgggtccttggagctgagaccgccatgtccatgtccacacattcccgccgccgccatgacgattgttacggcacttgcacaccaccgaactcgggcgcagtctgcttgtctgccccgtccgggccggagattcgttgcaagcaatacaaggatgcatacacgtgatttgttgtgcgcagcagactgtttcaggggagagnnnnnnnnnngtccgggctggagattcgttgcaagcaacacaaggatgcatacacgtgatcatttgtgcgcagcagactgtttcaggggagagggtgcctagcccagaagagccattgtcgacaaaaatgcatggtgggcccagccatcgccacnnnnnnnnnngctggcccctcccagaagagccattgtcgccaaaatgcatggtgggcccagccatcgccacttcactcgttgcatgggaggccccaatggagcccaccaacacactcccggggcgcctcctacgccacccacgtcgcctctcacgacgcctcannnnnnnnnnggtggagcccaccaacacactcccagggcgcctcccacgccacccacgtcgcctcacatgccacccacgtcgcctctcacgacgcctcacgccccgttctgcgccgtggccagcccctgcctggcgatgagctcctccgcggccgcggccgcggcgtccagccccgccccccgcagcgcctgccccagccgctcctcctgccccgcccccagcgcgtagggcgagtggcgcggcccggggaaggtgcgctggctcacctccgcctggaaggccgacagtgcgccctggatcacctcccccaccgccgcatactgcttgcagaacttgggggtgaccttggcgtggtgcgggtgctgcatcatgcccaacaggtcgtggtagaccaacacctgtgcgatgagttcatgggggcggggagtgggctctggtttcaggatgtggcggcatgaggttgtcaggatccacgaggaatgaagctccccctgttctccgcctcacctgcccgctggtgtgcacccctgccccgatgccgatggtggggatggagagctgctgcgtgatggccgcgcccaccagctccggcacgcactccaccaccaccatcacacaccccgcctcttccaaagcctgcgcggatgagagggggagggggggagcaggagatgactgggtcagccagcggggccgtccctggttcagcgctgggcgtcaacgtcccgcctggagaggggtgcggcagcaaggcccggggtggcgccgccgtggccgcggttccctgcagttggacacctgaccaccgccaggagtcaccccccacaaacacaccatccccccgcaccttggcctcggcgacgacgcgcgcggcgtcgtcggcgtggaggcccgcgggccgaaacccgcccagcagcgagaccgactgcggggtcaggcccacatgcccgatcaccgcgatgccggcgcccaccacggcgcggatggtctccaccctggcgggcgcgccgcctggcgagggaagggcggcagggtggggtggggggatcggtgcgcgcgccaggtggggctgccgacgtcatgcggtgccacggtgtgctctgcatcaacatcacatccacccgagcgccggctgagcacccctgcgcacgtccactgcctgacacccggcccctgcctttgaccgcgccctgcctcccccccttccaccaccaccaccactgcgcatcacacccgcagcacacgcgacgcaccctcgatcttgacggcgtnnnnnnnnnntccccctttccaccaccaccaccactgagcatcacacccgcagcccacgcgacgcaccctcgatcttgacggcgtccgcgccgccctccttgagcatgcgcaccgcggcgcgcacagccgccgtcggcccctcctcgaaggagccgaatgggaggtcggcgacgatgaaggggcggcgcgcgccgcgcgacaccgcgcggcagtgcgtcagcatctcctccagcgtgatgggcagcgtggtgtcgtgcccgtgcaccaccatggccgccgagtcgcccaccagcagcatctcgatgccggacagctccacctgcacggcggtcgggaagggaagggaggggaggagggggtcattggggggggaacctcgtcgggcctggttccaggcggcacaggtacacatccccaccccgggcagctgacagcacgcctgggaccccccaccgacccaannnnnnnnnnctccccacccccgggcagcgggcagcacgcctgggaccccccaccgacccaacgcacgtgcacggctgaggggtagtcgtaggcggtgaccatggtgaagggatcgccccgggcgtgcatgcgccgcagcgtgcgcagcgtgacgcggctgggggagggcgctacggggcccgagtagacggtgtcggccggcttgctggagtggcagcaccagtgccgggccaggccccgggcggtgggttgcgaggtgatgacaggtgccctgaaggcaggagctgtgtggcctgggaacatgagatgagtggtggggtggctggggagcaagggttctgatcagaccggaagtgtcaggctccagactcctgggtgcacgccgtgacctcacgccatgcacgcgggcgtggcgcacctgcaggcctcgttggcctggcgacagacttcaggccggcggcccgggaccccgcgcaacgtagagcgaccgacatggggctggccacacgacggggtgactccctgcacgggagtggcctctacccgtgcgagtcggcgggtttgccctgtgtgacgcgtgaattgtgaggctgaacacaaactatttctcgtcccggacctgtggaaaggagctttgccagctctgcactacctcgtcgccctgtggggctctgtaaaccgcgcccccggaacttccggatgcagcattcacccattcagctggagggttgtccactcggtaccccataccgggtcacgctgtatccggacactgccgtttccaacactctatgccacccaacctggcaaatgagcgatgcacagggtcctcacaccacgcccgcctcctccggcgtctgcgtgttcatctgcagcgcatgcaccgaccccgccagctcctccgccagggacgcatacacgagccggtgccgcttcagggtggacaggccctggaatcgcggcgacacgatgctgagtgcgaagtgggtctcgcccttctggcccgccttgcccatgctcctgacaccggcatggtgtgcgtgcttccccgactcatccacgagctccagcctgcgtggagagggtgcggccttgtggtggggggtggtggattcgatccaacgtcaagacatatactgccagggcaaacagcctgccgctgacgacgagaacgccgttctcagccctccnnnnnnnnnngccggatgcagcattcaccctttcaactgaagggttgtacactcggtaccccataccgggtcacactgtatccgggcactgacgtttccaacattctatgccacccaaccagccaaataagcgatgcacagggccctcacaccacccccgcctcctccggcgtctgcgtgttcatcnnnnnnnnnnggtggtgggggctggtggattcgatccaacgtcaagacataaactgccaaggcaaacagcctgccgatgacgacgagaacgccgttctcagccctcctgaacgtcgcctccccacctcagaggctggaaggcgtcctgcagcttcctgcgcatgcttgccgccacggggcccatgtgctgctgctctgaggccgatggctccgcagctgcatccccaggctggggtgcagcctcccccccgcccctgggccggccaggtccggcggcctcctccccggctgctgcgccggtggtagccgcgccagcgccatggccgggcgagccccccgcctcgcctccctgcagcaggcacaggtccagcgcnnnnnnnnnnggccgtgaccgggcgaggcccctgccttgcctccctgcagcaggcacaggtccagcgcctttcgctgcatgagccggaacatgttgaggaagccgttgttgcgggagggcgtgagggcctgctggaagcccagggaggtgatgaagtcgggcgagatctggaccgtctcctgcgggctcaacccgctcaggcccaccaccagcagcgctgccaggccctgcaagatcggggtgcgggggcggcaggggggaggtcgtgggcgggcaggcagcgggaggagggggcatcgagccgtgcagagtgccgcatcgacagcatcggaggcctccgcaggcacccacatcacgatccgagcgccgcgacagcgctggcaaggaccatcaccccctcccccagcacgcaggcccgaccttggtcagctgggagtcggagtccgcgcgccaggagagcgtgttggccgcgcggtcgagctgggcggccacccacacctgcgacacgcagccctccaccttgtgctccggggtgtggaactcggcgggcaacgggtccagcctcgacgcaaagtgcaggagctgcttgtatcgctgtggagcaaggggtggcaaggggtggtgaggggtgggggccattacatgggctgctgcgggggagtacagcagtgggggagtcacgggctttggagaacatcgatcatggtttccaccattcggtgcggggcgcgcgtgaagatgaccatcacgcaccgacatggggtctggtacagcttgaaaggactggactatagactccagggcgggcggcagggcggtggaggtgcccgatgccgttggcgcagtccctcgtgcctgcaactgggaggtgcaagccttccgatcagggatggcaatctgcaggagcgctcaggcatgtgtggcattgacactttcattcctagatttgtagcatgactgtttaccaggcatcccgccaaggaaggccgtgactcactcttcgagacacatgaaggcgtggggtgtgggttcctcgccggggggtcactgctgtgaacggacggatacaggttgcattcatggtctgcatatccaggagttcaggttcatcccaaaatgaaggacacaggagagatcatgacgtccatgaacctctgcaaactacgagtctctcccccgggatataagggctgctacgcgtgcgagggacggagcgtccattacgaatgcactacaggctttcgacacgagagcggaccctggcattcagcattgatacgagcgcttttcattggatacaaatcgcaatggagcgacccacggggagctcccacctgtcctacaccatggctggcctcacggccttggggggtgtcatggggttcgctcgcacagcttccacgcccagcctagttgcgggagtggccataggagggctctttgcatacggcgggtacctcattcaggcgcgatgaatgggttcggcggggttcggccattgatctcggtgtacaagtccctggacatgtggcagggactcagatccccattctccagcgtggccatgggggcactccccaacaagtctgcacatcgtcacccgtggccctttaccccgctgtacagattggccggtcagaccgcgggcaccaagtgtctctggccgcctccttggtcctcctcggggccatgggcccacgctacctgcgcacccgcaaagcaatgcccgctggggtgatgagcgtggcggctattgccagcgccgtctaccaaggcaggaagacctgggagtggctctgaattgcatgccaagtgagagcacaacggcaattactgccccgagaatgtcgcgcccgtctgcactccctggcggcacagcccgttcccataccaaaagcacaaaggttgcggtccaagccctccaatcgcttcgcacataccccagtcacaatagacacctcacccaccacgctcccacgctgggtatgttcccccaaccgacggtgcgcatgtcataaattaagcttacagcatgctctagagcgagaaaatggggaagcgggggcgggacctgcatctttcagcagggtgcgccacagcacatatcaggtttcagccaaggggatggggagtaataagcgagtcattgaagttcgagccagggtcgtgggagaaggggagcaggtcaaatgctgtgacagggtgcagcagcgagggggtgagggcgcaagtgtgctgcgcttgcggcacacgagtatagtgagaggagcacaagaatggttgattagggcgtgcagcagctgcgtgggtcaagccggtcggtcagggctgccgtcgttatggacagggcccacacaccggggtcaagtgttgcgtggaggggccatgccactccagcccctgatagtggcggcatagggaggcttccaagcaggtcgagggcgcctcgctgattccctgctcaccggcggcccgccgtggccacgggggcggcgtcggctacctctgggaactggacgttcaggtcctgggcatcccaaacgctgttgagcgtggcgttgacggtggccccgttcaccgcggtgaagnnnnnnnnnnttacctctgggaactggacgtccaggtcctgggcatcccacacgctgttgagcgtggcattgacggtggccccgttcaccgcggtgaagacgagggaggagggcccggtgggggcggtgcccgggtggatccagaagccaaaggtctggcgggtgaggggcacgccgttgagggtgacgttctggatctggtacttggagttggcaaagtagaaggcctgccagaaggggttgacgccgtccttgggccacatgcggatggtgccgtcgatgaaggcggagcagtccaccttctcccaggacaccttcaggcggttgggccaggagccggtgaccgcggagtaggcggggtaggagaagtcaaggtcgccgtaggagcactcggggcaacggtccaccaccatggccacgatgtcgacgttctggacggggcacttggggtcgacgcagcgggcgcgaacgcaggagccgcagaccaggccatcgttccactgtgaatagggggaagagtggggagatggagaaggtgagcccaactgaggtgcagggggattgccggagcacacaagtctcgcaaggcgaggcgatttaagtgacacacagcaacagcacatgacacacacggagtatgcatgcactgatgatgctgcagttggatggtacgaacaatgggtagccttcatggacaagcccaaacacacatgacaccagacagactggtgagaaccccgaggcagtacatgactaaccccccccctccccaagccaatgctgacctgttcctcgttcatggccacaaagtactggctggcccagttgttcaggtagcggaagctgcaggcgaaggcggcccccgtgttgttaacagcgtcggagaaggcggtgccgtccccatggaaggagtcgctcccgatctgggggaccttgtcggcgagctggagggggtccaggaagtccacaccgtcgaaccttgagacaagtgagtcttcgctggttggggttgtcgcctggatgagagcagggagggggttagggtcagcacattgtcagtctgtctgagcgggggcgtgcggccgaggtgcacgcgccccgccatgcccaactcgaccagggctcgagcaagctcgcagcacccatgaaacaggctgtcatggccacaatccacattataattgcttacctggtcagcgagcagggcgcgggcggccgtggtgggcagtgctgtgagggtggcaagggcggccagtacaaaaagggcattcgcccactgggtgggtttgctgggggccatggtgtgagcttgtaatgtaatgcttggtgtggcggcccctgttcagtgataaaatgattgttgtggatgattgtttgaatgcgctgtacagattgcatgggttttataatgggcgctcgaagcagcggtccgtctgtcggactggaatcacatcagcgcccccgccgcagctccgagagccaggaccggcagggtactgtccgacatccatggtccagcggtcgggatcccatgcccaatccctcatgactaattgcttcgcatcacagaatgttctggtgcagacagacagggtatgatccgctgaggcacatgctgctggctaccgcgctggtgcattcccgccacgttgaccagttggggcgggtgttccgcctgtgttgcccatccgattgagcatctggatcaagtgggagggagatataatgtgttcttgtacacattgcaagcgtccatgggccctgttgctgctgccagggcccggcagtccccggtcagtctacactccttgtagaaaggctcggggtcccacgtcatgcggccagcccttcatgcacggggtcgaggccactccatgggccagattccgggccatcccacaccggatgtcccaaatgatcacacgggacagaccaacagttcaaaagcaattcaatggtactacaagggatcgcaaacactcacctcgacccatcgcccctccatgctcagtctgacacgagccacccacaccttggccaaacctcagccggcagaacgccccttactcaccatgagggctgcggggatgagcatcatccagttcttttgcaaccacgtcttgttctcgtcctccagctttcttttcagcgctgctcgggcagcgggggtgagctcctcgtcctggtcgaccgcggctgccgcagctgctgcttctgcatggtcatgagggcaggaatatggggtgggggattcgcgaggaggcccagggtctccataaggcacacctcggcaacttggttttaaaaaagaagcctcagggtagggatccacaggtatgaacttttcgagggggtggaaaggcttcctgccgacagcgcagtattatgttggcctccaccacaaaacttcatgccgtgggacatactcatnnnnnnnnnnccgcgaggagacccggggtctccataaggcacacctcggcaagttgggttaaaaaagaagcttcagggtagggatccacaggtatgaacttttcgaggggttgaaaggcttcctgccgacagagcattattatgttgggctccacgacaaaacttcatgccgtgggacatactcatccaccaccacctgtcctcatgcctgcgcccaccccatgcaattccacacgagccggctttctcactcaccagccttcttctgctcgggggtttggggtggggcctgttgcttcacctccgcagccttgatggggaactgcacgtgcacaatttgctcgctgggtaggctggcaagcgccggcgtgcctaatcgcagcccggtggcatctggggctccatcggagcaggccaggtcgatggagagaccagctggctgtccgtcgctatgcaggctgagggtgaggggcgtagcaaacccctgtgcggcccagcaggccgagggcaaggaggccaggaggatcgctcccgaagcatcctttcctacagacacgcggaccgaatagaaacgggaggcacccaggtcgccgcctggggctgcgccagagcggatgaggacgccctgccctccctggcctgcctgtgtggagacggggttgggaacagggtgaccacgattccagcgttgagccgtgcatgatcgccgcccgcaaagcgagaggacaggtacccagcccagccgcctcaccagaacgtggtcctcgaagacgatatgcccacccggcgtgaaggttttcccatccaaactgtgctccagggccagactcacccccgacacgaccccgcaacacaacacggcggtcaagcctaagcagacgaccaatttcgccatcgaggtctgtgaaatgcgttgcatatgtttgtcggggtgcaaaggcctcgttgatcgctgcacaactcccctcctcgcggacgtggtcgcccgtgtgaagcatgcacagcaccacggcatgtgcaaggtctttcaaaaaagcgatcagactgtgctttacacggctcacttggctctcactctcaacatcagaggatcaagcatgcaccactgtaccatgcacacacacggacgagaacatttaacatcgatattgcagggctggctgtgtgctgccctctatcgcaggcgatcctgcaagcacagcttgagcagggccatcctcacaaacagcccgttctttgcctggcggaagtacccggcgcgcgggtcagagtccacctcgggggagatctgtccgggtgtggatgtgattggagggatgggtgcgctgcaggtggcacctccgatgggcccgtccttggagggggcactgggcgccaggccccgcatcgacactctcaccccccccccagggccgcatctcgacctcatggacacgcctacctcgtcgacccgcgggagtgggtgcatgaccactgacttctgcttcatcagggccatgagcttgnnnnnnnnnnacccacccccccccagggctgtgtctcgacctcatgcacacgcctacctcgtccacccgggggagcgggtgcatgacgaccgacttctgcttcatcagggccatgagcttggcatccacgatgtacctgccctttgccagctcatagtcgtcgggccggtcctggaaccgctccttctggatccgggtctggtacagcacgtccacctcggcagccaccgcctgatcgagcaaggattgtgcgcgtggggcattggggaaatgaggtacttgggatctggcattcttggtgagcaaccaggtgtcgtgtgacagcctgcagactcccacactccactggtgcccagggctgccgccgctgtacccacatgcacaacagctctccagatcccagagtgaggcacaactgcacgactcactgacaggtcatcgacctcctcccactgcacgcccacaccggtgaggtactccttgatgtcgtccttcatgcggacctggagacaggcaggggggcggggttggctggggtgagactttctctggcctcttgctcacccgcatcccaagcaatgtccattacccatgcctaggctaaaccccagctcctcccgccactgcactcaccacatccggggcaacaaagtacatcttcacattctcatacatggacaggacataggctagggacctcactgtgcgcccattggctgcacaggcaaaagaagggggtgatgtgggataggggcggcgccacggcgcgcagcagtcctcaactcgggggcttatgccctcgctcacatgactgaggtttgcagcacagagaaaaggcatgattatacctgttggcgccctgaatgccggcatcccagggttccccagttcggttttgagtagggtatcttcgtactcgagtcactctgagccacaacccacccaccagccctccacttgcccacctaaatctcccaccagcccgacggtgaagttttcgaggcgcccaatctcccgctggatggtgtagacgtcgatcagggcctgggtggggtgctgccccggcccgtcaccagcgttcaggatgggcacggaggccgcgctggccgccttcttggcgctgcctgcctgaaagtgacgcagcacgatgcagtctgcgtagccctccaccgtgcgaatggtgtctgtgatggggaggagtgtgtggtcaggtttgtggggtctaagtaatgcaaactgaatttgaaacagactgaggggaggccggccctctaggctgctagggaattcaaccccagggaggaaagtgaagcaccaatgcagctccatccccgcttctcaatcaagatcctcccacaccaaaatctcaccctccagcgtctcgcccttggcggcggaggagaattcgcccgcgctctcagtggacagcacggtgccgcccaggcgcgccatggcagcctcgaaggagaggcgggtgcgcgtggagggctcatagaacagggtggacatcacggcgccgtccagcgcgcgggattcgggggtccctggccgaacatcctccatttgcctagccacctcgaagatggtgttcagggaggcctggttgaactgttggctctcgatcacgtgcttcagggggagatccagccacgagggggcgttgaagttctcaacgggtccaggtttgacgtacagggggctgggcatggggcgggcagggcgggaggggcgggcaccccagcacgggccggcggtgggtcggaccgcgcatggctgcaggggccgatgcattgcgcttagcatcatctcaatgcaaacggttcgactccaacccttttgtagaggtttgcgagtacctttggagacgatgcccgtgctttacgcaattcacatgcaaaccagtgcgcgcgacccggcacgagtgtcgcgccctccccaaccctgtcgacatggatgttgcagcacaaggcagcagagccatggactacgttgtctctagaccagtacttctgcatgaaattgtgctagaattttgtcgccagggatgacgtgagggtgcgaccctcgatacttttgcccaggagtgatcgcagcccagggctgatcgggcatctcgggcatctatggccaccaagggacggacctgttcccgaagctgcttggactacctgctcatcgaagtcgtcagtcactatgcaaatgcccgccagggcccctgcctggaggtgaggtgaccgctgcactgctgcggtgattaaacacgaaaacaattgtcggtgtgagatcgagcacaagaggccccaaatcccctcaggtagcactggaggcgataggcctgcgggtgggcattgccctggcggagtggtgcacccgggaccggtcccccatttcagagcccctggacatcatcaagttcatctgcaaggagctgtggaccgaggcctttggcaagggcgtggacaacctgcgcaccaatcacaggtcgggaagttggccctatttccaggctgatcgtgctgtgcgggtcgcctgagcagcgctggaatctgtcataccgtataagcagcaccattgccccccctccgacggggcttggtctcgcccacnnnnnnnnnntggtgcgggtcacctgagcagcgctggaatctgtcatacagtaaaagcagcaccatcgtccccctccgacggggcttggtctcgcccacaacacgacgtactctggctccatgcaggggcacctttgtcctgcgagacgtgcagttcagctggctggaagccctgcaccccaaccagctgccgccctggctaccgggggcgggccccagcaggacccctacccaggacgatgtcccgccctcccccaccagccccgggcaccctgcgcccagcaccctgccctctcccgtcaccagccacgccgtgctgccctgcgccctgctgcgcggcgcgctgagcgcgatgggcctggaggccagcgtcaccctggacgcctccagcctgccccaggccgacttcaccgtggtcctccggtcgccaccaggctcctgggcagggcaggagtgagttgagaagtgagcggagggaggcgggatgagcgcggtggaggcggggactgaggtgaggagcgaccagggtctcctccattggcggtgacgagaggcgtccacgaggctgggcaagcaggcctccttgagatggtgccgggagggctcagagactgcagccatacgataaacccattccagaatgcgtgcagcatatgcattgtacggcttgcaagctctccannnnnnnnnngctcttccattggcggtgacgcgaggcgtccacgaggctgggcaagaaggcctccttgagatggtgccgggagggctnnnnnnnnnnnnnnnnnnnnnnnnngcccatcgttcttctgttggaccagcctaccgctgggcctcccgtgagggaagtcatggtgcattacagcgtgtcacgcgcatgccaccgagcagcaagtgatgggagagcggaaagggatgaggctggtgtgggaaggggcagtccattcagacaggggggggggcgagggtgtggcgccgcgcggaacagggtcaccagaggatctggagggtcgggaggggccaccaatggcgcatgggctcttggacagctccggagtccggaggccacggaaggggcacatgcgggcgccgcggtctggcgagcnnnnnnnnnnttggagggtcgggaggggctaccaatggcgcatgggcacttgggcagctccggagtccggagcccacggaagaggcacatgcgggcgccgcggtctggcgagccgtctccttgccgcatcgcccgtcggcttgggagtgcctgctgccacggcgccctcccacccctcgacctcccatgccctccagcccccgcgcgcgcaaagctggggcgcgctctagaagccgccgcccatgccgcccatgccgcccatgccgcccggcatggccgggctcgccccctcaggcttgggcgcctcggcgatcacggcctcggcggtggtgagcaaggaggcgaccgacgcggcgtcggtgagcgcgacgcgcacgaccttgatggggtcgatcacccccgccttgaccaggtcctcgaactcgcccgtggccgcgttgtagcccacgtcggcgtcggcctcggggcgctccagcagcttgcccacgatgacagcgccctcctgccccgcgttggcggcgatggtggcggccggctggcggatggcgcgctggatgatgctgacccccgtgcgctggtcgaagttggcgcaggcgtccttgaccgactccagactgcgcgaggcgtagaccagcgcggtgccgcccccgggcacgatgccctccgccacggcggccttgnnnnnnnnnnagactccaagctgcgcgaggcatagaccagcgcggtgccgccccccggcacgatgccctccgccacggcggccttggtcgcgttcagcgcgtccacgatgcggtccttgcgctcgcccacctcgaactcggagtggccgccgaccttgagcacggccacgccgccggacagcttggccagccgctcctccagcttctcgcggtcgtagtcggaggtggaggcggcgatcgcctcccggatcatgtcgcagcggtcggccagcgcggcgcggtcgccgccgccgttgagcagcacggtgtcgtccttggacacggtcaccttcttggccgtgcccaggtggctcaggtccacgttctccagcttcatgcccaggtcctcggagatgacctggccgccggtcagcgccgcgatgtcggccaggttggccttgcggttgtcgccgaagccgggggccttgaccgcgcagaccttgaccccggcgcgaagacggttgacgatgagcgtggccagggcctcgctctccacgtcctcggagatgatgagcagcgggcgctgcgtcttcagcgccgcctccagcacggggatgatggactggatgccggagatcttcttctccacgatcaggatgtaggcgtcctccaactccacgcgcatcgtcttgttgtcggtgacaaagtagggcgagatgtagccgcggtcgaagcgcatgccctccaccacctccagctccgtctccagcgtcttgccgtcctgcaccgtgatcacgccctccttgcccacacgctccatggcgcgcgccagcagctcacccacctcgcgctcgccgttggccgagatggtgcccacctgcgcgatctcctccgtggtgctgatctggcgcgcgcggcgcttcagctcgctcaccacgtggtccaccgccaggttgatgccgcggcgcaggtccatggggttcatccccgccgccaccgacttgcacccctccaccaggatcgcgcgggtcagcactgtggccgtggtcgtgccatcgcctgccgcatcgttggtggcgccggccacctgcttcacgagcgccgcgcccaggttgtggaagcggtcggaaaactccaccgccttggccacagtcacgccgtccttggtgatcttgggcccgccatacggctgctcgatcaccacgttccggccctgttggtgggtgtgaatgcaagtgggtgggggtaggcacatctgggtagggtgtcgcggttgcgtctgtcatcccgcggtcaggccaccaggcatgtgctcgtggcnnnnnnnnnnttggtgcgtgtgaatgcaagtgggtgtgggtaggcacatttgggtagggtttcgcggttgcgtctgtcatcccacggtcaggccaccaggcatgtgctcatggcgcgggccggcagcctgtcatgcaccaggcccggctttccacagacaaggattgggctgcagtgccgtggcaggggaggcacaatccaattccccactccagacccttatgcgccttccaggtgactcaccacccctcccagcgatgacnnnnnnnnnncccacaggcaaggtttgggctgcagtgccgtggcaggggaagcacaacaaaattccccactccagacccttaggcgctttccaaggtgactcaccacccctcccagcgatgacccctggaaactccaaccggctacccagacactcctccactatacaagcctaccttggggcccagggtgacctggacggcgtcagccagcttctccacgccctgcagcatggaggcgcggcaggcgtcgccaaacaggatgtccttggcggcatacccgcgggactgggagtaggccaggacctgtggtggggcgggggccagggagggcatcggggcgccgtgcatggtctagctgcattattgtttcggcatggattattcgagatggatccatgatgtggtgcaggggacccctgcaccaccccaggcacatgctccccgacaccccgtgcacggccannnnnnnnnnaatggatcgatgatgtggtgcaaggaacccctgcaccactccaggtacatgctccccgacaccccgtgcacggccatcaccgaccccacgcaccgacttgcggccagaccgggcggcctgagtcaggaggctccgtgctccctgcatgatgccagatcaggggatgattcgcagtccagcgcgtgtggtgcagatcacaaaggggtcctcccattgacccgcggtgcacttctagaatttccgagtcacccccttcccgccgtgctgcggtgcccggggggaggaaaggagcgaatctttcgagggtggagggacacaatcgcggggcgttgcacccccgtcctgccacatgcggcactgcaaggatcatttaagcggtgatcagtcttcctgagcattgtatcggtgacataggcccctctcagcctcccgtcgactcctggtcggccctcacgcattcgaaccgggcggggacgccatgttcgtcacctccatccagtccaggccctgcctggcgcccatgcgccgcgccgggcaccctggcaccggcaggagcacgccaccggtcgcggtccgggctgccagcgcccaggacgccgcccgtgtgctggagctggcagcttccaagcctgagggtgaggccaagaagctggacgcccgcgccttccgccgctccctgtccaagtccgggacctacaccaagcgcctgaccaacgaggaggcccccctgcagtccatggacgcccatggcgtgggctactcccgcaccggcctggtggcccagatgcgggagacggggaacacctggcagcaggccggcatcaccgtcatcctggccgaggcctacggcttctgctggggcgtggagcgcgcggtgcagatggcgtacgaggcgcggcaccgctatcccgacgccgagctgcacatcaccaacgagatcatccacaacccttccgtgaatgaccgcctgcgggagatgggcgtgcatttcatcgccacgcgcgacgacgggctcaaggacttttcccgcgtcgcggcgggggacgtggtcatcctcccagcctttggcgcggcggtaggggagatgaaggacctgcacgagcgcggggtgcagattgtggacacaacctgcccctgggtgagcaaggtgtggaacgcggtggacaaccaggcgcgcaaggggcacaccagcatcatccacggcaagtgggcgcacgaggagacggtggccaccgcctcctttgccggcacctacctcatcgtcaaggacctggccgaggcggagtgggtgtgcgacttcatggtcaacggcggcgactctgcgttcttcctggagaagttcaaacacgcctacagcgagggctttgaccccgtccgcgacctgcagtgcatcggcatggccaaccagaccaccatgctcaaggtgggtgggtgtgttgggggagttcaaggttcttggggtgggtttgaaccctgtgctcaggtcagtagcgcgtccatgcaccgtcccccttacctcccgacccttagggcgagacccaggccatcggcaagctgcnnnnnnnnnnatgggtttgaaccctgtgctctggtcagtagcgcatccatgcaccgttcccctttcctcccaaccctcagggcgagacccaggccatcggcaagctgcttgagcgcacccagctgcagcggtttgggcctggcgagctgtcccgccgcttcatgatcatggacaccatctgcgacgccacccaggagcgtcaggacgcggtgttcaagatcaccggcgcccaggagcggccggaggaggcgctggacatgctgctggtagtgggtgggttcaactcctccaacactagccaccttcaggtgggggaggggggagggaaggtaaatgtattttaagcgaggaggaggatgtggggggtgggcgcacggtgccctgaaaggcaccccgtnnnnnnnnnnagagataaatgtattctaagcgaggaggaggatgtgatgggggggcgcacggtgccctgaaaggcaccccgtgtgacctctggcaagcgtggacctgaggtgggaggggtctatccagacagggaggcagtgcatccacttcgcagagacccacctttacagaaacaactcactctctcgcgctctacctcccctgcttgtaggaaattggtgagatgaagggcatcccgtccttctgggtggactgcgcggaccgggtggatgtgagcacaaactcggtgctgcacaagctcgcgcacggcgagctgnnnnnnnnnngtccccttgcctctcagcacgtcctctccctgtccattttcttccctgttttcttnnnnnnnnnnagtggacgtgagcgccaactcagtgctgcacaagctcgcgcacggcgagctggtggagacgcgggactggatcccgcgggacgccagcacgccgctgcgcatcggggtcacctctggcgcgtcgacgccggaccgggcagtggagnnnnnnnnnnccgggacgccagcatgccgctgcgcatcggggttacctccggcgcgtcgacgccggaccgggcagtggaggacgtgctggacaggatcttccgcatcagggacccgaacttcaagggcatccagccgcgggccacaaaggtgggcaagccgcagcacgccgaaatctgagtcgggcacgccgctgacgtaaaactgagcctccttccctgtgaccgattggtgcgtggtcgatcccttgcctctcggcacgtcccctccctgtccattttcttccctgttttcttggcactttcatgcttgctttctgttgtatatgaagaacgcctcattgtccggcaggctgcaaattggggaaggttggcagtgttgtttggcgggaggcagtccagatcgcaggcggggttgggaatgagcagctcctaggcagtcaattctgagggaggcaagatccaaacctgcgccgccagctctccatacgcgccctaggcctcgccgccgcccacgaccttcnnnnnnnnnnatgtatatgaagaacgcctcattgcccggcaggctgcaaactgtgggaaggtcggcagagttgcttggcgggaggcagtccagattgcaggcggggttgggaatcagcagctcctaggcagtcaatcctgagggaggcaagatccaaaccttcgccgccagctctccatacgctccctaggcctcgccgccgcccacgaccttctgcacgagcgcccagacctcctccacgtgccgccactgggtgtgcactccacccacggccaggcgccagacgtggcgcccgccgagccgggtgtgcaccatgaaggtgcgccccgacgcgttgacgcgctccagcagcgccgtgctttcctcctcgctagcgccgcggggggcgaagcagaccaggccgaaacggggggtggtgatgatgtcaaaggcggggtcggcctcgaccaattgcgccagcgccttggccatgtccaggctggcgggtttgggaaagggtggcgagatgggttgagcgtgaggatgatggagagcaagtgcctctggcgatgacagatggcagacacttcttgtttgtgcctttcttcaaagcaaggacgcatgggctctcagcgcaacatnnnnnnnnnnagttgagcatgaggatgatgcagagcgagtgcctctggcgatggcaggtggcagacacttcctgtttgtgccttttttcaaaggcaaggacgcatgggctctcagcgcaacatccctccgggcacgtacgcccaacaactacgcattcccccaaacgaactcactggtggcggaggtaggcctggagacgctctgtcccatacatgcggagcacaaaccagagcttgagggcgcggaaccgccgacccaggggcacctgccagtccttgtagtcgaggtgctcggcagcatgccgcagccccgcaaactggaactgcggctccagggagagcgcggtgcgcagccagaacgagttctgaacccacagggccgagctgtatgggtgtggggatggagggcaggtggggatgagagggagctaggaggactggggtcctcctttcatgagaagatgtctgcagcctcgactgcgagacactgtctcgagggaatactttcgcggccccacgtttcaaacacctcacacgcccaccgcaccagtcannnnnnnnnnaggggtcctcctttcatgagaagatgtctgtagcctcgactgcgagacactgtctcgagagaatactttcgcggccccatgtatgaaacacctcacacgcccaccgcaccagtcaaatgtgaccagcatgcccttgtgggggttagtgctgaaggagtccacgccctccagcccctggaagtagaggtcatgctggtcgggcaggcaagcaaagaccccggcgtaggccgcgtcgacgtgcaccctggcaagtaggggtcggtccaaaggaagagtgagtgcgggtccagcaaagggcaagggcacggggcaggattcaagagctccagcagccacaggcggcaaaatcagcatcacgggggatcgcaccgcgcgcaagcggttcctcggccccaattctcgctcaccatgcgccatgcctcctggcgacggccgccagctcggccacggggtccacggccnnnnnnnnnngatcgcaccgcgcacaagcggttcctcagcccccattctcactcaccatgcgccatgcctcctggcgaccgccgccagctcggccacggggtccacggccgcggaggaggtggtgccgatgagggtggtgaggaagaaaggcatcagcccatggccctcgtcggcggtcatggcggcctccaaggtcgcggggtccagcgcccaaccccgctcggcgctggtggggagcaggcgcaggtgctggatgcccgccaccgcgcacgctttcttcacacaggagtgagcctggtcggtggtgtaggcgacaaggcgagggccgtccgcgccggggttacggccgtccagcgcccgcgcgcgcgcggccagcagcgccaccagggccgcctcggaggcggtgccctggatcacgccgccgccgcccgtggtgccggtggagaggaaggcgtttgggaggcgcaggaaccgggccaaccagtccagcgtcacctgcagcaggaggtgatgcaggggattggagggcatccaaggagaaggtccatgcacagcctttctgtttcggaagccaggaccggcagtggaagcttgcattgccaggtggatgcagtcacgctgcctcnnnnnnnnnnagtgatgcaggggattggagggcatccgagggagaaattccatgcacagcctttctgtttcggaagctaggacccgcaatggaagcttgaattgccaggtggatgcagtcacgctgcctcatgaccgtgcttgctgccaggagcacggtctgaatgtcctacaaaactcctcccagctcccacaaatggtttcaaaacaccaaggaaacccaccgtttcaagctctgtcgcggcgggggnnnnnnnnnnggccgagctcagcatgtcaccaaggagggcagggtacgaagaattcgctggataccatctacaggttgcagattcagagggtgtaagaaatgccacagattgattgtgtgaatatgaaggctctcatggcaggcaatgtgaatagacagtttgccagtaagcgggatgcttccgccgtagtcaagccttagctatttgcaactccccatatcactgaacaacccgccctccaggttcccacgactcacgagaagaagcnnnnnnnnnncgccacagattggttgtgtgaatatgaaggctctcctggcaggcaatgtgaatagatagtttgccagtgagcgggatgcttccgacagagtgaagcctcagctatttacaactcccatatcactgcacgacccgccttccaggttcccacgactcacgagaagaagctggggtgctgccagtgggtgataccaggcatgatgtgcgtctgcacgtctgacaggatggcatccagcccttccggctgggtgggggcagattctgggagcttctcggccaggtacccaggggcgacttctgaacgaacagggtgcttttcaatatttgatctatagtctacaatggcatctatcatcttgtagcctagctgccggaactgtatggtggagaaannnnnnnnnntttttcaatgtttgatctatagtttacaatggcatctatcatcttgtaacctagctgccggaactgtatggtggagaaagataagagtggaggtggaaccatgacgtcatcaaacagtacccctctctccaggcgatagtgcgctgcatgcgagtggattccatatgcaaccagattcatacgtcttcatgggagatgggatgctcgtagtcctctgctcccgttccggcagatgtgccgggggtgtcggacatggtgcggttgatcgcaaaggcttgcagtgccccaaaaactggctaccacctaacaattctcacgcagttttatcctctgcactttgatgtcagctttttgattcgtctgcgtacattacagcgttgagtggccagcaggaaggagaccgcggtccgagacgagtctgagggcgcgctctagcaatttggattccggatttcttaccctgcatcgacctcggcctggagtcgatcagaaattgtcattgccagattgcctggcgaggacgggtgatatactcaaggcgttgcatcgcccacaaaacacacacttatctgcaagggagttactgcatcagactctgctctacagctcgtgatatcgatcgttcagctccccagcaggtgcgtgtccgcatggagcacccctcccgagacacctgcgttgggtgtcggaggagctcacatgccagggaggtgcccacattgcaccacgcgaccgcgaaacaggcacacttcgggcatcctgtcatcgcatgtccgctggctgggaatcatggcctccccaccaggcgtcacgcgctgcccacctccctccccttgctgcgcagggcaccgcgttcctgtggagagccgaccacatggccaccgcatccactttctcggcgttcgatgcccgctgcggcgacctgcgtcgctcagcgggctccgggccccggcgcccagcgaggcccctccccgtgcgcgctgccatcgccagcgaggtccccgtggccaccacctccccccggcccgggcccacagtttatagcaagctggacaaggcccacaccctgaccccggagcgcatggagctgatcaacggcatgtcggcctttgctgaggagcggatcctgcccgtcctgcagcctgtggagaagctgtggcagccccaggacctgctcccggaccccgagtcccccgacttcctggaccaggtggcagagctgcgggcccgcgccgccaacgtccccgacgactactttgtggtgctggtgggcgacatgatcaccgaggaggcgctgcccacctacatggccatgctgaacaccctggacggcgtgcgcgatgagacgggggcggcggaccacccctggggccgctggacgcggcagtgggtggccgaagagaaccgccacggtgacctgctcaacaagtactgctggctgacgggacgcgtcaacatgaaggccatcgaggtgaccatccagaatctgatcgggtcggggatgaaccccaagacagagaacaacccgtatctgggctttgtctacacctccttccaggtacagggtgctggggtgtgtttgggggttgaggagccggtttgtgtggcggggaggtggtcctcgtttgttctggtggttgtcatcacctttgagtttgcatgcgtgcataccggagcctccaacctcccactcaggcccctcaccccctctcgaccatttcacaagccccacccccttgcnnnnnnnnnntgtgtttgggggttgaggagccggtctgtgtggcggggaggtggtcctcatttgtgctggtggttggcgtcacctttgagtctgcatgcgtgcagactggagcctccaaccccccacccaggcccctcaccccctgtcgaccatttcacaagccccacccccttgctcgcatcgcaggagcgcgccaccaagtacagccacggcaacaccgcgcgcctggccgcgcagtatggcgacgccacgctttccaaggtctgcggcgtgattgccgcggacgaggggcggcacgagatcgcctacacccgcatcgtggaggagttcttccgcctggacccggagggcgccatgtctgcctacgccgacatgatgcgcaagcagatcaccatgcccgcgcacctcatggacgaccagcagcacgggacgcgcaacacggggcgcaacctgtttgccgacttctcggcagtcaccgagaagctggatggtgagtttgcttgtaggtgcggatccagggaggggatctctaggagggcggccgcagtttgtcgcgatgctgccagctttggtgtggtgaacatggggtgcgacgagctaccctcaggatcgccatctaatatgtggctcagtctcccctcacacccctccttacctcaatcttccagtgtatgatgctgaggactactgcaagatcctggagcacctgaattccaggtggaagattgcggaccgcaccgtgtctggcgacgccggcgccgaccaggagtacgtgctgcgcctgccctcccgcttccgcaagctggccgagaagtcggcagcgaagcgcgccaagaccaagcccaagccagtggccttctcctggctctcaggccgcgaggtcatggtctgagcggaggccttggaaatattcgcgtcacgcgaggagtaggctctgctggtcggccctggatacgctgactcttcaagcagtggggcaccacacccaccttttgccaagggcaaggagtcggaagggggcggggctgccatgcacccctgacgggcatggccgttccgcgagggcgccaactgcggcggcctgcccgctggctcgtgcccccctacccccaccattgcctggagcgtttccatccccaaatcacattccatccaagttgtatcactatgcccctttggctctatacactcacggcctgaggtcccttctcggccgtggcggcacacgcccaaccccccaccatactctttccatacactgcaatgcttcgagcctgcctgccacctgctctgcttgtctcccctcccttcccttgaggttttccaatgcagtaagagaagtcgacgtgcatggacagatgattgagagatgaggggtgggaaagggtcaggaagcatcaggatggaaactgagtagagtgtcacagagcttcagacttccatctgctggcctcatcaggcgtgcgccagctggcgctcgtaataacagttaaagtccaggccgctcagcagcgtgcgcagcgtgtccacgtgcgcccccggctccgccgcccggaggcccagcaggcggaagagggcgcgcaggcgcgcgcgcgcctcgctttccagaccgtccagcgcagcgcagatgggcgcggccaggtcgtcgtgcggggagtcttcctcgctctgaggattctctgccacataccctgggcccggctcggcgaggcgctgggcgtgcgccagcgcggcgtactgcagcgcgcagctcaccacgcccagcgtggcgtcgcgaagtacttcgcccagcggccccccgccgggcaggcaggcggcctcggcggcggccaccgccgcgccgcgcgcgg

SEQ ID NO: 33844 - DNA, 125 bp, Chlorella protothecoides
gcaaggtaaggtgcttctgttctcggcattcctcaaataacattagctgctgtcctctgaagatatgtgtgtcatccttcagacttggaaatgctgtgctcactgtcattgtagatgtgaacaca

SEQ ID NO: 33845 - DNA, 163 bp, Chlorella protothecoides
gtgttgtgtgggtgggaaggggcggggatgcagcggggggccaggtctggtgctggaggaggggtgagattctggttcccaacatggcagctctgtaaaggaaaagctgccacgttggtggtgggtctgcagggcgcaccatctcggtgctcgagtcgactga

SEQ ID NO: 33846 - DNA, 108 bp, Chlorella protothecoides
gcacaccaggccttggaaggggaggggggcaaggagagtgaggaagcgcgtccaagggtgcagcacgccgccgcacctgatgccatgcttgagagtgcctcgctgtgt

SEQ ID NO: 33847 - DNA, 61 bp, Chlorella protothecoides
cgactgtgtggcaaggacaggcatcgggtgtagggcaatctatgcagggcaggcccggttg

SEQ ID NO: 33848 - DNA, 123 bp, Chlorella protothecoides
ggcatccagcagcatcttcagcatcgcacgagggccaagcgtcgtgcgcacaatgtcggccacggcctgtggagtaggaagggaggagtggagggagattcattcgaggagtgagcgactgag

SEQ ID NO: 33849 - DNA, 117 bp, Chlorella protothecoides
aagtgagtggggctttgcttgggggtggggggttggaatttgcgccaacacagagtgtttgggggcctgggcatggcagcgtgatggtgggcgtgaccatctcagcccgccccgcgc

SEQ ID NO: 33850 - DNA, 61 bp, Chlorella protothecoides
aacaagcaagtcacgctggaggcctacaacacccgcctcgaggggtttggcgtcctcgtca

SEQ ID NO: 33851 - DNA, 108 bp, Chlorella protothecoides
cgggcggaggaggcggcgccgccctcccccgccctctccgcgggggagggcgggggtgcgcgagtgctcaccgactgcgacgtcgccacgcttatgggcctgaccacg

SEQ ID NO: 33852 - DNA, 61 bp, Chlorella protothecoides
gacgtcgccacgcttatgggcctgaccacggtgaccctgggcgaggacgacccccagccca

SEQ ID NO: 33853 - DNA, 79 bp, Chlorella protothecoides
cgtccccttcacctccacacaagaccccctacttccccacgcaccgactgaaacaaagcttgcccccgtcgcggcgagt

SEQ ID NO: 33854 - DNA, 87 bp, Chlorella protothecoides
cagcaaccttgaatctgtggcaatggattggtgagaacgggccaggtgaagggaatgcgtgatcacatgcgctgatgcaaactctac

SEQ ID NO: 33855 - DNA, 72 bp, Chlorella protothecoides
agcgtcgcatcggtaccttgtttgcgccccaaaacttcttaccagactgtaatgactatcatcgactcccac

SEQ ID NO: 33856 - DNA, 61 bp, Chlorella protothecoides
gggccccgtgctgacctggctggcccccgcccccgccctggcgggtacgggccaggtcaac

SEQ ID NO: 33857 - DNA, 1622 bp, Chlorella protothecoides
  modified_base (247)..(330): a, c, t, g, unknown or other
  modified_base (404)..(413): a, c, t, g, unknown or other
gcgctcgcccccccgccgcctgccacgccgccggtgcgcaccacggtggcgacctcccggcgcagcgccgcctccagccgctccgccagccggcccttgccccgcaccagcgcgtcaaaggcgcgggagacggggccctgcgcggcgggcggggccctcgtggtgggtgactccccgcccccgccgatggccgcgctctccaccgaaccgggcagcacggtgatggtgccgtggctgacgcgcaggnnnnnnnnnnnnnnnnnnnnnnnnnnnnnnnnnnnnnnnnnnnnnnnnnnnnnnnnnnnnnnnnnnnnnnnnnnnnnnnnnnnngcggggcgcggccagcgacccgcgcgcttccagcgccgcctcgaaacgcaccgccgcagcgccgcgcactcgcnnnnnnnnnngaggcctcggccgctagcaggggcgcgggggcggggtcgggcgccgcgccgcgcgccgcctgcatccgagccgcgccgccggcggtgaggggtagccagcccttggccctgcaggcggggcgagagatggggggggggggggccctcaaaggaagggggtctgtgatgcgggtggcgcaaggggggtggtgactggccgtgacagcggcacgcccaaaggccatgccgtgattgcaggggaggggagcaggcaggagggtgagttgggaggttgcactgggccccccgtcaccaaggtgctattctcccgcaggaaagcgacgaggcgccttgcatctccgcaggtcgtgccatccacccaaccacggaaccgatcccagccagacccaggagtggcgacccgcaggcgtctgagcgcttgcacccccaggtgcccattctccagcacaagggtccaccaaccccctgctccacccctcccccgcccccaaacaacacacacacgcgtgggaaaaaataggagacccaggcacctgatgatgcccgtcctgccggagcgcgcttccgcggcgtccagcgtgaagacgccgtcctcgcagcgtgcctgggcgttgatgccgcgcagcgggaacttgaggtaggggcaggccagcacgcccttggtcagccgcgccgtgccggacaccatggggtcggccacggggcccgagatgctgtggggatgagattgggtgggtagggcgagagttgctggggatttgcgggggatgaggggtccgactgagggtggactgcagagtgtgcgagcgcatggcggcgacggtgcggccccgggaggaagggccccagagcagtgcgcacgcagcatgccgccgcctggaccctgccggagcaagcccgactccttgccagggtatggggcggccccctgcgactgccggctgtccctccctcgcccaatcaatgaccgctccctcgtatccgccggcattccgcccgtcaacctctcctccctcaccccccggactcactccaggaggacctcggcgccgccgccctcccagctgacgtccggcagcatggcggtgatcagcgccatgccgccatcgcgcaccgacacgcgcacgtcggcggcgcccgctggcccgaggcccagcgacccctcggcgtgcacggcgcccgaggcgcgcggcgccttcccgccggcgc

SEQ ID NO: 33858 - DNA, 61 bp, Chlorella protothecoides
aagacaggtggggtttgatgaaggggggggggaaatttgatagctggcaatgtctatcgtc

SEQ ID NO: 33859 - DNA, 132 bp, Chlorella protothecoides
atgaccttcggaaacccagcagagccaagtcagtcggcagctcgacttacacaggttgagagcaaacggaccctccctcatcgaaagcactcccggtccattcttttcgcaccaagaaaaaactgccaggta

SEQ ID NO: 33860 - DNA, 2691 bp, Chlorella protothecoides
  modified_base (92)..(155): a, c, t, g, unknown or other
  modified_base (490)..(499): a, c, t, g, unknown or other
  modified_base (598)..(607): a, c, t, g, unknown or other
  modified_base (2177)..(2186): a, c, t, g, unknown or other
cgcctcggggctggggatgggtgacgcctcagggctgggaatgggtgagggtgatgcctctgggctggggatgggtgacgcctcggggctgnnnnnnnnnnnnnnnnnnnnnnnnnnnnnnnnnnnnnnnnnnnnnnnnnnnnnnnnnnnnnnnntgggctggggttggggctgggctcttcaccaaggccggggctcggtgagggcgacgcctccgggctggagctggggctcgatatgatgacatttgtcactgtcccatcattgtcggctgagcctgtctgagtgagggtaccagtcccagagtcggaggaagattcggtgttggagaaaccagggccttccgccgtcgtactccctgagacctgtgacacattgggagatggtgatgatgagttaaacaatcatgcatccctcaacacctcgccgacaatttccaccaatgtgcaagtgttgacgccgtactgtggcccaccctcatgtcgatatnnnnnnnnnngtgacctgacacctgacaaccatgctgtgcaagctgccggtcagtttcctgcaatacccagcgataatcaatgaaagctctcaccgtcccgctggccgnnnnnnnnnncgatgagttaaacaatcatgcatccttcagcacctcgccgacaatttccaccaacgtgcaagtgtttacaccgtactgtggcccaccctcatgtcgatatatgcagacgctgtcaagcacacccctcaccgttccaccctcagatgtctgagtggatgctccgtcagtgatggaggtcactaccccgggtgaagagctgttggcctgggaagtccactgggacgttgcaaccccagcgggtcccgtggttgttccagtgaagcctgagtctgtagtggccgtgaaggtgccatcactggacgcctgcatcggtattggagtatggaaagtcacagccacatactatgcacgatgacctgacacctgacaaccatgccgtgcatgctgccggtccgttcctgcaatacccagcgataaccaatgaaagctctcaccgtcccgctggccgtgcccgtcacagcggagcctgtggtgctagaggagccttccaagccgccgatggcgcgggcgtcgttccctgatgctgaggccgagatcgtcccggaagagctgtaggcccccgtcgttgacgagaccgcaccggacaactcaccatcggaggccccagaagcactgactgagccaaacaatttcctgtgtgttacattgttggaggagggttgacgccgagcgcgcgggtgacaaggtctgtcctcccgagtctcggggttcaccgacagcccctttccccctaactctttggaatacaacataaaaaatatgtgattatgcagcacatgactcatggcgttgcgcgctcacctgctttgggcaagccctcgcgacattaaaggatcggccgatgcgaagccgaccagtagaatcagcacgacgcccaaccgcattctagccattgctttgcacccagtctactcgaccaaattatggcctgggagtgcactaggtggaactcagggacacatcgaatgtttgtgcagcgaagacgtgtactttatggccggagcacacggagggttggcatggactcatgcctaaatcttggagaccgcatgggatttaccaaacccaggaacgtcgaccccatggcaaacgatgcgtgtggagcgatgtcaggggacggcatatatgggagagcattcatagtaacctttaaccatcatcccatcagctgaaagagtcgtggggggatactgccctcccccgagtgccttgtttcgtcgcatccggagccgtatctcatactccgatgggaaattctagtctgcgtcagcgtcccctcctcatgtccactcacttcatcccacggtgtgtaatttaacctggaattcaaatctagtaaatttttctaaaaaccctttacggcgagcgtcgggtgtcggagctggaagtacctcagttttgagtttgttccgctttgggattcttccgacgttgaccagctagaaccggacttgcgacccacaacgcctgttgggaccgagagtcagtgactgcacagaactatatcgataaagtctcgatcccaaacatttgcgagtcaacacgctggcgcacatcttgcgtcggccannnnnnnnnngaagtctcgatcccaaacatttgcgagtcagaaacacgctggcgcacatcttgcgtcggccactgtgtctttatgaatagagtaaatattcgtcgattcggaagcgccgcgagggtccacacacaatcgggcagtcttcgcatcattttctgacactatcgctttctgctacaactattccggcgtatgcttcgcgcgagccgaagatatgccgctaccgggcttgcgccggttgcacagctgcttcccgcaagcgggatctgactggcgcagttggttgccctaatggcgaaccagagggggtgggggtgggggagggcgggagaagggaaagcagggggtccaccaaatgctgtgggacgaagtgcattatcaaaaaagcacttggtcagcatgagcatgttggctgctccgttcacgtcgcggttgacgatgttgactctgtagcccttgttaacacaccgcttcgtgtcccactgttgtgggggttccccttgaccgggcc

SEQ ID NO: 33861 - DNA, 64 bp, Chlorella protothecoides
catcgcgctcctaattctgcagacataattcaacaccctgcccggcgtaccttcaccagcccaa

SEQ ID NO: 33862 - DNA, 4587 bp, Chlorella protothecoides
  modified_base (531)..(540): a, c, t, g, unknown or other
  modified_base (599)..(608): a, c, t, g, unknown or other
  modified_base (1988)..(1997): a, c, t, g, unknown or other
  modified_base (2147)..(2156): a, c, t, g, unknown or other
  modified_base (2687)..(2696): a, c, t, g, unknown or other
gcgcgcgggcgaagaggtcgccgccgcgcgcaacgacctggccggcgcgctgctggacctggcggagctccgcgcggcggcaacgccggccagctctgacccagcgacccgccccgcagctgccgagctggccacgctgcgcgcacggctggagcgtgccgagacggcgttggagggcgagcgccacgcggcgcaggccctgcagcgacggctggcggcggccgagggagcgacgggtgattcagaggcgctgcggtctcgcgtcgccgagctagaggccgcgctgctggcgggtggcgggggcgaggaggcgggggcgctgcgcgcgctgcacgtttccagcgccaagaccatcgacagcctgctggtggagaacgagagccttgcgcggcgcgtcaacggcgccggcgcggcgcgggctgacgggcttcgacctcggggtgggggcggtgaggacgaagtaagtcacgaaagcgctagggtgttgagggagtgcagggggttggaaatccttgtatcgtcatgcgccgnnnnnnnnnncccatggcattcaatcgctcgactgctcactccaaagtgcaccccttcccactttcagnnnnnnnnnngagtcacgaaagcgctagggtgtcgaaggagtgcaggtggttggaaatccttgtatcgtcatgcgccggggcgccggcgccacatgtgtgtagcctttgcaccgcaaccttgcgcagacgcatggtgtgcgccccttctcgtcggcatctcggtcgatccatggcattcaatcactcgaccgcatactccaaagtgcaccccttcccactttcagcagatccagcccatgtcttcatcgttgtggcctgggccagagcccgacaggcgttccaacacccacacgccgcgccaaccccgctcccccaaggcattctctttctgggcctggatcgcgggagcggatctggtggacgcaggggcggaggactgaaagtgccgcatcggatggcgggaactttaagtcctgtgacagtgtgcatggcgatgttccgatgtgccagaatctctaggcaagccacgtcctgaagtcagacagccttgtgtaggcaacagggagtgtcttacagccaggggcgtggcagcggtaacagtacgaggagcgagcagggaatcgggtagcgagtcaaaggaggataagaggtgcgtggcaggggcatgggaggctggtccctggcgcctcctgggggtctgacgcgacaagcatcctgcttgagaagcaggaaagacgcctgccttccaagcagtgatgacaatgtgttggatgaggagtggccctctccaggctctccgcttcatggccgccctccccgtccacggcctcccatgccaagtgccacgttcttcatcttgttcttggggtcgatgcgcttgaactggggtggggagagcattttgagaggggttgaggccatgactggagggatgctgggcacgctcagacagcgatttttgcacccttccagtgccacatgcagaccggtttgaggccagtgctctcgctgaaatacttgcaatcccctttgaggcacggaggcagcactagcaagcctgagccggccagacactcaccatcggtgcgtttttcaacatgtcggggatgatgatgaaccggatctggctccctcggatgaagatgtgctccatgtgggagaccttcccatcacgtccagtggcagtgatgttggatagctgaacgttccagttgtcctccgcgtcgtggagctcccctcggaagatctcgccagtcttcagctcgacctgtggtggtttttgacgtggtgaggagggcacaatacaaaatgtcagggcagagagacggctgcacgggccgcttcctgttggtcgtacaattataagagcatctcagccaacaatttccaagctcacgctgacgatgtggccctctgcctcgtggatgagcttgacggggatacccacannnnnnnnnntgttttgagaggggttgagaccattactgtggggatgctgggcacgctcagacagcgattcttgcacccttccagtgccacatgctgaccggtttgaggccagtgctcttgctgaaaggcttgcaatcccctttgaggcacggaggcagnnnnnnnnnnccgtggtgaggagggcacaataaaaaatgtcagggcagagagacggctgcacaggccgcttccttttggttgtataattataagagcatctcagccaacaatctcaaagctcacgctgacgatgtggccctctgcttcgtggatgagcttgacggggatacccacacccttcaagcttccagctgccaaggggggcagatgggatttcggtcgcaaggtgaacaaaaccaatcagttacatatggtcacacgaaccgcatcgcaccactgtacacctgcgtacctgctgccatcgccatggtaaagagacttggtgggtgatggctggacggcgctgggggtagagagaaggcgctcctagaggcaacgcactgtagaggatcttagtgcgtggtgtggctcgagttatgcgggaactgcaccccacactcgcttagagtgtgaccgggcggtgcagggacgatggtgtttttcgcgtaagtggtagaaagggagtcgctcctacaccggggcaaggtgagaaacgagccnnnnnnnnnngtgtttttcgcgtaagtggtagaaagagagtcgcccctacaccggggcaaggtgagaaacgagcccctggcatcgcacccttccttctgccttgctgatttgcggcctggttctcagccaagcatggcccgggtcctgaagtttgcgagcgccacctgatcccctcgccatggcggtggaggacggtgagacggtgatgggggagggccaggaggtggacagcgagtcggagagcgacagcagcgaggagccccaaagcggtacccccgccgtggaggaggaggtgtgtgatcgtgcgctggcggggcagggaggtgctgcgaggctttgcgatgggcccgccatgctgtgccctcccttgcctgcctgactgggaccctgggcttgctggagctggggcgttcccacccgccccccccctcctcctgcctctccaggtgagcacctggatccactggttctgcggtctgaagggcaacgagttcttctgcgaggtggaggaggactacgtgcaggacgacttcaacctgagcgggctggggggcatggtgccctactacgactacgcgctggacttcatcctggaggcggagtcggtgcacaccgagatcatgaccgaggcgcagcaggagatggtggaaggcgcggcggagacgctgtacggtctcatccacgctcgctacgtcctcaccgtgcgcggcctggccgccatggccgagaagttccgggcgggggagtttgggcgctgcccgcgcgtgctctgccacggccagccctgcctgccggtgggtgtgtcggacctgccgcgccaggccacggtcaagctgttctgcccgcgctgcgaggaggcctactacccccgctcccgcctgcacggcaacctggacggcgcctactttggcaccaccatggcccacctcctcctgctcacctaccccgcgctgcgtcccaccaagtccaccgaggccttcgtcccccgcatcttcggcttcaagatccaccccagcgctcacaggatcgcggccgggtcgggcgcggagcgcaagctgcggcgcgtgcagcccgccagcaggggcgccgcggcgccggccgccggggcggcgagcaatgggacgacttcgtcgcagcagaaggcgggcgccggcgccgcgccgccggcgtccctgcagcccgaggcgcaggatgtcgccatggactcggcgcccagcgccaacgcggcggcctgaagatggccatcgcgcagagcggggcgcggcgacgccgggcggaccgccgtgccgtgcgccgtcgtgacgtgggccgtcgggccttccctcgcctccgcctcactcttctctttcttcatctgcttgtgcgccgggctgggggtgggatgcgcgcccgcgcagcccatccatctgacctgccgcccgtcctctgctgcatgtcaacatcgcagggatgtgagaggcaaactcctcagggccccccccaacccgacaggtcctgtgcgctctcactctttcccccgcggcgtgccgccgagcacaatttcccttccgactcgtccccctccgctgcaccgccgtgcagtcgcccccgtcctccttcctgcttcccccttgtaacacaatacagactgacaacaggtgcatggaggagggttgtcgggggtcatgaaagccggccaaggaacaagcctggggttggcagacctgcgacgggggcgatgcacgtcgcggcacatccctggcgcggggcaactccatcaggccggctcgctccagcgctccgccagggccgcggccgccagctggacgctgcaggacaggcgcaggccggtctgcgccggcagctgcgcggcggccagcgcctgcgccggggccggcgcggcctcgccgccgtccgccag

SEQ ID NO: 33863 - DNA, 105 bp, Chlorella protothecoides
ggcatcacagaccaaagtggggttgcggcataccggctgggaaagttcagcacaaaatcgcagcatgcgcaatacccccggcccctcagcttcagggtgttgccc

SEQ ID NO: 33864 - DNA, 61 bp, Chlorella protothecoides
gcttgagggaggtcgacgatgcgggggaggtgctgcgctacgtgggttcctacgatgcgga

SEQ ID NO: 33865 - DNA, 94 bp, Chlorella protothecoides
cctgagcacatgctcggagccatgtgcgtggggatcgtatagtcatcttgggatgaatggcgactgatgagtgcaccctcgtgaaatgcacctc

SEQ ID NO: 33866 - DNA, 75 bp, Chlorella protothecoides
cacgctcagcgtgaggaagctgcgaaggggcgtgtgtgtgggagtgggtgcgtcaccattgcaacaggcgtcgct

SEQ ID NO: 33867 - DNA, 73 bp, Chlorella protothecoides
cacccccgtgagccgggacagggtcacgcggagtggccggaatgggtcctgtgttcgctcgaacccttgggcc

SEQ ID NO: 33868 - DNA, 61 bp, Chlorella protothecoides
ggctggcctctgtgcaacggtaaaggcgggggaggtaaacagaagagggaacttcggacgc

SEQ ID NO: 33869 - DNA, 106 bp, Chlorella protothecoides
cgctgcatcctcctgcggtgacaagggtgaatggcgcgactgtgtatacatgcatctgcaaaggccacgctgccggcacagaggatcccttgaaaccatttcctga

SEQ ID NO: 33870 - DNA, 5303 bp, Chlorella protothecoides
  modified_base (3793)..(3832): a, c, t, g, unknown or other
  modified_base (4553)..(4611): a, c, t, g, unknown or other
gggggggggggcatgggttggcaggttcgggaggggtgggtgtctgactggggtacaggagtcgtgtagctgctcagggtgggggcggcgcacttggggggaggcgtatactccccggggcagacgcgccgcagatacttctctggtggccggatctcaccccaatatcaccacgcacggcccccagaccaccccacctccagctcgtcgtcaaaggcgcccgccgccacgcccgacttgctactgtgcgtgccggcgccgcccagcgcctcctgcgtcaccacctcccccgtgacagatctcaccacctcgggcccggtgaggaacatgtaggaggagtggcggaccatgaaggtgaagtcggtgagggcgggggagtacacggcgccgccagcgcaggggcccatgatgagcgagatctgtgtgaagtgggggggggaggaagaagatagagggtcatgtgcaatggcgatgggggctgcacagcctggacatttcccatctataagtgttcccacacccttccatgacacgcaagggcgggtcggactggaccctgtccagaacaagaggggcgagtcgaaggatccagcatcgaacatcaaacgccacaaagccacaggcgggcacccgcaacctcgcactctcaaccctcctggacagaattaccaaaatggcacctgtgggatgaccccggaggcgtccacattccgctggaacacctcggcatagccgccgagcgacagcacgccctcctggatgcgcgcgccgccggagtcgttcaggccgacgatgggcgcgcccgcagccaccgccctgtccatcagccggcagatcttgagggcgtgcgactctgacagggacccgccatgcaccgtgaagtcctggctgaatacgaagacggggcggccaaacaccgtgccagaccccgtgatcacgccgtcgcctgcatgcggcggagggcaggagttcaaatggaggacccaaccttagaggcgtcgagatcaggagcgtcagatcacggccgggcgccgtggggtcaccccgccaccgacccaacccaccatagtactgctgggactccatgtcaaagtcggtgcagcggtgctggaccagggatcccgcttccacgaaggagtcggggtccaggaaggcagcaatgcgctcgcgggcggtgagcttgcccttctcatgctgcttggcgatccgggcctggccgcccccagcctccgcggcctgcttggcagtcacgatgcgctcccactttttctgcgcgatgaaggggaggggaggtcaggtgcagccaaatatcgaagtgccatcgaccaaaaggaccgcataccatcatcatcgcaactcacgttgtccagagtgtacacagggagttcctcgaactccgccaagcttgcgctccagcgtgccgcgccctgtcacaggtttggacgcttcatcgtctctgggttgtagattacgtatgtatcacttgactatatatttgatccgaaacgtaccgtgagagcgggcaggagtgctttggtgtgtcgggacgccctgctcgcggcccgcaccagctgcaacatgatgagctgtgcgcaagaagctacgatgtatcctgtcactaacaaaatataatatcgactggatacgagctatgctggggtcggtgatggcctgtcgcatcttcaggtcgtggacagcggggtgtcggggtccggtatacggggctcgaggacaagcagattttctaggccgtcacctacagcagaaacgaaagggaccacttattatttcctggtatgcaggcttcgagttgattattgatgttttatattcaaaagagtttaccagtctacattcggctctggccaaaggcccacagaggagactgttgtcttgctgacttcgcctgcatgatgatgatcagatcgacgaccgggatccagtatatgggtgtcatcgatcaagggttccatgaccggtattgggtattgagggaagccgcatggacgggctcgttggcgttccgggagagccggctgtcgggcgaatcgaggggtgtggagccccggcctcccaacctctcatacgagactttgcacctcatgacactcatggtcaatcatcagagagtgctgtcctcttgaaacctcctacagcattgattaatactggcctttgcatgcggatcgctttcgactccgatggttggtggcaagggtgatgaaccgccgagggaggctgggtacccagacaagaggcgacgcatgccgaccataggtgccggggagacccgcgcgtgctacaagcatacatgccgcatccaaaagtgcctcagcgagaccaactacgacaacgctgcgtgcagctgggccatcgatgccctgaaggcctgctgcgagaagtatggcaaggacagcatccactgcgcctttcccaaagacgcatgagcacaggtttcctggaggcgttcatgaacgtcctcctgggagacgttggccctggtccgtcagcgtccttgtccgaaattggcctcccaagtttaccctgtggcctgacccaacaggcctgaatgtatggcactcctgctgatctccatggcggtgacgtcttcccaacatgctttcttcattcttacacggtgtaaacattcgcttgctctctgagcaagcaatgagcgtggcaggctggtgtgggcggcctgggtacactgaccagcgcatcacctgcccgaccctgcctggaggtgctgcttgaaggcttgcagctgcgctcccagcctccgctccgcccgcatcagctcctggtgcctccggaacctgcgcaccgacctgaagtacgccccgaaccccggcccaggcccttgcacggctgcgcacagtccagcttcagtatcgtcgcctgggcgggagccggccctttcaccagcggccgccagcctggccgccactgcatcctcgtcctcgccaccgcgcttcctcggccccgcctcctgctgccgcgctttcctgggcaggggcggcgcagggcgaaagccgcccgtggccgtggagtagcgctgcgccagctcggcgggcgaggcggtgggcggcaggaccgagctctgcgccacgccgcccgccaggtcccgcgccagctgcgccacggcggggtggtagtggcgctgaagcaggctgagctcccagaggggcaccgccagcgcccctgcctcggcggggtcctccacgtcggggcggtaggtcctgtaccccgaggggccccccgcctcgttctccagcgcggcgcgcaggcgaggcacgcgtcggagcagccggtgcagcacgcacagcatgcccagtgcggcgccggggtcgcgcaccgcccccgccgcgctggcgaggcgcttggcgaaggccgcctggcgcgaggcgtccagcgcgcggcggtccagcaacatcccatccagcaggctggccagcagcggcgccagtcggccggcggcgggcgcgtcgccgctggggacgggggcctcgcccgcgtccatgccccccctcccccctccctcctcctccccctcgccgtcctcctccagcggctgcagtgccacagcgtccagcgcgcggtatagatgctgatagaaagcgccgcggtccacgttcagcgcctcgccctggccggacaggatgcgagaggcggtgagcagcgtgcgcacgcgctccgcggctggcagcgcggagctggcgagcagctggtccagcaccgccatcaggtctccaaagtactccaccctgttgggggggggggggggggggggggnnnnnnnnnnnnnnnnnnnnnnnnnnnnnnnnnnnnnnnncggagtgtaaggttggaacagagtttcgcggcgagccagagggggaggtttatgaggatctgtgccagggcgtctcgatcacaaggacgaggcgcatggcaggtgcggtccttgagccggctggcggggccgggcgcatcccactgcagaacatctaccgaggccaaacctcctcggaccaactgcctcctggggcccatcaaacccaccctatgaggccagcgtgtgcggccagctgctccagaacggggaagaggagcgggaacttcttcgcaaaccgcgcggccgacatgggcaggcctggtgcaagtcgtggggaaattgtgtcggaggttgtgagaggaaggggccggcaagtgtggcttgctgcccttggtacgggcaccggctctgaccggttgagtatccggccagcatggccaaggccccccccccaatgcgcctgcgcaatgaacagagccagggtctctcgctcaccttcccggcgtgcgacgaggcccgaggcggttgcgtgcttgagcacgcggaagtagacctcgaacagggcctccagactggccgactggtggtactgacgcgagtcctggtcctcgtaggctcgtgcctcctcgaaggcgtggtccacgtcgtccttcttccgctctttcttcttcatcttcttccgcgcagccttggcctctgtgaatcgatggggggggagggggggggggggggggggggnnnnnnnnnnnnnnnnnnnnnnnnnnnnnnnnnnnnnnnnnnnnnnnnnnnnnnnnnnncggtgacaggggcggaccgagcagggcaggccaggcaggacgtatgcagggcatgcagctcccctcacgtcagcactgcattcgaggagacatggctcaacactcgtcctcactcgtcgacattcgcgtgtggccccaaggccctcgcccccaaactcccccacacaacccaccccgcctccccaccctggaagtccttggcgctggtgatgtcggcggtgtgaacggaggccagcaccgccacgacctcgggcgggcagacgcaggagcgagccttcaccaggtccgccagcagctggaccgcctcggtgaccacgccgccgtcggcgctctggctgctcagcagggagcgcagggcgtccaccacgatgcgcctgggtgggagggcaggggttgagctgagcggatggggtgtatgaggcaggtggcagccggatccagctggaatggaccggtgctgtgcaggggaactgccgtcgagactggcagtcggtcccttgcagcccccaagcaccggaaacgcccccctggaacgaacctgagctccggatcgcgcgaggtggccaccggcaccagcgcctggagcaggtcggtggtgtagttgaagtgcggcgcggcgaccagcagacggcccatgcagcgtgcggcgacgcgcgcgtgcggcagcgccgcgccgcccgcgcgccccgccg

SEQ ID NO: 33871 - DNA, 107 bp, Chlorella protothecoides
cgcgcagtcggtgagcagggcagggcatggcgttgtcggggcggggtcggtacccccaggtccatgctcctcggaagccgtggtgggtggggggttgaggcggtgca

SEQ ID NO: 33872 - DNA, 61 bp, Chlorella protothecoides
ctttccagggtgaggcaggctggcaggaggtgtcaaggggccatgccatgatgaaaggaca

SEQ ID NO: 33873 - DNA, 73 bp, Chlorella protothecoides
ctgcacgcccaccggcacaagcgggtctgcaatggcgtggagacgtggacggaactgtgggacacgaagcggt

SEQ ID NO: 33874 - DNA, 73 bp, Chlorella protothecoides
gtggacggaactgtgggacacgaagcggtgtgtcaacacggcatgcaaggtcaacgttatcaaccgcgacgtc

SEQ ID NO: 33875 - DNA, 61 bp, Chlorella protothecoides
gaagaaacgaggaacattggtcgaacttctccgaagccaggaaggcaacgtcaccataact

SEQ ID NO: 33876 - DNA, 102 bp, Chlorella protothecoides
gccaccccatggtgcctgcatgaatataaaattggtcatatcatctgtgcatgcaatgaatgaaagctttacgagtatctggcacgcccagcctggccgctc

SEQ ID NO: 33877 - DNA, 75 bp, Chlorella protothecoides
gtcctcgaagcggatggagtagcccacctcggcccccagctccacccccatctcctcgctcacgcgcttggccac

SEQ ID NO: 33878 - DNA, 61 bp, Chlorella protothecoides
agctgtgaccggtgggtgtggcgggctggggggtaagccgcctgttcattcctggtccatg

SEQ ID NO: 33879 - DNA, 457 bp, Chlorella protothecoides
  modified_base (183)..(347): a, c, t, g, unknown or other
gaggagcggtagggtgaccgcgagcgctccctgtaggccatggctggtacctctacctgtaaactgggctcctgtatagttttgcgtcggttcaattactctcaccggcaagtaatgctgaaatgtttgtgttatcccggtgcgactgtcagtttctggactggagcagggcgctgaagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgtccctgagcatgcattgccaaggatagagtgcgctcaaagggttttttaggaagcccgatcaagcttggtgcgcagctctcctcttccgacatggtggtctcggtc

SEQ ID NO: 33880 - DNA, 76 bp, Chlorella protothecoides
cgctctatgagccacccccaaacctgcagcggggtcgtcgatgtttgatcgatcatgcctggacctgcagggaccc

SEQ ID NO: 33881 - DNA, 67 bp, Chlorella protothecoides
cggccagaagcttgtgcaaattagccagcaagtggctcggtcccccagcgctcatgccgtgcgcctg

SEQ ID NO: 33882 - DNA, 61 bp, Chlorella protothecoides
tggctgtccgatccacagggagcggccgggtacccaatccccaaatcgaatctggcacacg

SEQ ID NO: 33883 - DNA, 71 bp, Chlorella protothecoides
ggccatcacggcgtcgcctggcttcatcctgatacgcgcccccccccttgatcatgtcattccctgtcatc

SEQ ID NO: 33884 - DNA, 126 bp, Chlorella protothecoides
tggggatcgccggctggacgagctgcgcagacaagtgagggaatgtgagtggggagtggggtggggggctggagtttcggcgtcgagaataaatagtccactcggctgaaggtcgacggccagatg

SEQ ID NO: 33885 - DNA, 99 bp, Chlorella protothecoides
tgggttaagcgatcagactcgatctaacaactttgggaccttttagtgatatactatgactggagtcggggtatgtcgcaccgcttttcctgtggctca

SEQ ID NO: 33886 - DNA, 73 bp, Chlorella protothecoides
ggtgcgcgtgccagaacaaacgccattgggtgcagcctgagcaaggaatactaaccttgagatcgattttcac

SEQ ID NO: 33887 - DNA, 118 bp, Chlorella protothecoides
tcaaaaccgctttcccaaggccatcgccagtaggctggcagccggatgcgttgtcgttcaaactgatccttctctcccgctccctaaccaccagctcctccagccgcgcctggcctac

SEQ ID NO: 33888 - DNA, 104 bp, Chlorella protothecoides
ttcacccgggacgcagaggttcgtgtggagggagaaggaaattgaccgacattttgtcgccagggtcactcatgaaagatctttcgtgtgtttagattgtggca

SEQ ID NO: 33889 - DNA, 387 bp, Chlorella protothecoides
  modified_base (156)..(292): a, c, t, g, unknown or other
gacatgctgatggctgcaaaggtgtcctggaagtcagtattattccttggatcctgtgccctgcgattgagttttgttgtgacacgctcctgacgctgcactgtctcaaccctcccacccctcgacctgcaggtgtacagtctgcctgctgaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagaccatgacttcaagtgtctgtgtttggttcttagttcctgctttggatcggcttgttgcttggtgcccctgtcttgacgaagatctgtca

SEQ ID NO: 33890 - DNA, 198 bp, Chlorella protothecoides
tcctcgccacgggtcacgagaccaggtctgcgagtgtgtgcattttaggaaggggtgaatagagaagtgctttgtgtgtgtgtgagggggatggtggtcaggatgtgtatgccgtaatccatgtgcaaggagacgcagcgtcgtccgacgattttattgctgcccaggctctggccaccacgacgcaccacccctgag

SEQ ID NO: 33891 - DNA, 80 bp, Chlorella protothecoides
atgtggggagtagctcagggtggagggcaagctttgtcagcgctgtccaaggcagcaccaaggcagccgtcactccatca

SEQ ID NO: 33892 - DNA, 74 bp, Chlorella protothecoides
gggtggggggcggggatcgaggagggagggcttggaaggccgcgcgaatgcatcgatcggggggaggaaagtgg

SEQ ID NO: 33893 - DNA, 66 bp, Chlorella protothecoides
ggcaccgtgcctaaaacccaagcccctcactgcatccggggtctcgtctgtaacattcctacttca

SEQ ID NO: 33894 - DNA, 61 bp, Chlorella protothecoides
catcaggctgctgtccatggcattgaggtagtcggagaattggccttgcatggacgacacc

SEQ ID NO: 33895 - DNA, 61 bp, Chlorella protothecoides
catgctgtgatttgctgtggcggtcggcagggtttcctgcccccacgatcctctgtaatgt

SEQ ID NO: 33896 - DNA, 171 bp, Chlorella protothecoides
atgtgtacgtgccgtcggcaaggggggtggggtcgggcggtgtggcccctggatcgccaggcgccgggcgcggagaggtgtcggtgctgatgggtgcccggggtgggggtgccggggtcgccggcccgcccggtgcggggtcctgaaggcgccggccggccccggcctcgt

SEQ ID NO: 33897 - DNA, 97 bp, Chlorella protothecoides
ccgcgatgccggccagctgggcgtaggacagcgcagcgttcaggggggcgtggaagttgcctgctgcgcctgctgccccggcgtcacgcacgcagaa

SEQ ID NO: 33898 - DNA, 78 bp, Chlorella protothecoides
ggcctcgatcaccgccctgcaaggggtcggaggggggagtttgtacagggagtcgaggacgaggggaatgacgggatt

SEQ ID NO: 33899 - DNA, 23580 bp, Chlorella protothecoides
  modified_base (461)..(470): a, c, t, g, unknown or other
  modified_base (1185)..(1194): a, c, t, g, unknown or other
  modified_base (1565)..(1580): a, c, t, g, unknown or other
  modified_base (1656)..(1665): a, c, t, g, unknown or other
  modified_base (3367)..(3376): a, c, t, g, unknown or other
  modified_base (3593)..(3602): a, c, t, g, unknown or other
  modified_base (3790)..(3799): a, c, t, g, unknown or other
  modified_base (4301)..(4310): a, c, t, g, unknown or other
  modified_base (5050)..(5059): a, c, t, g, unknown or other
  modified_base (5602)..(5611): a, c, t, g, unknown or other
  modified_base (5667)..(5688): a, c, t, g, unknown or other
  modified_base (8207)..(8216): a, c, t, g, unknown or other
  modified_base (8372)..(8381): a, c, t, g, unknown or other
  modified_base (9727)..(9736): a, c, t, g, unknown or other
  modified_base (10345)..(10354): a, c, t, g, unknown or other
  modified_base (10823)..(10832): a, c, t, g, unknown or other
  modified_base (10942)..(10951): a, c, t, g, unknown or other
  modified_base (11036)..(11045): a, c, t, g, unknown or other
  modified_base (11248)..(11257): a, c, t, g, unknown or other
  modified_base (11834)..(11843): a, c, t, g, unknown or other
  modified_base (12970)..(12979): a, c, t, g, unknown or other
  modified_base (13264)..(13273): a, c, t, g, unknown or other
  modified_base (13330)..(13339): a, c, t, g, unknown or other
  modified_base (14165)..(14174): a, c, t, g, unknown or other
  modified_base (14705)..(14714): a, c, t, g, unknown or other
  modified_base (15120)..(15129): a, c, t, g, unknown or other
  modified_base (18453)..(18499): a, c, t, g, unknown or other
  modified_base (20431)..(20440): a, c, t, g, unknown or other
  modified_base (23276)..(23285): a, c, t, g, unknown or other
caatgccgaaggccccgcatggtccctcatgtactcttacctgcgaagtttggatcgacgcccacacgtctggtctggagtagaggctgacactattgggagcgaagaacctgatagcatccgctccaccgctggcaggacgtgcaggtacagatccactcccttggactggatcaccgcatcgagtaccctaggatagcaggaaaaatgatgaaagcgtcgaagtaataatcaatgtgtcaagaatgtgatgcatctcaatcacaaatacgagctttccattcatccagtcagaaacgacagggaacatcccgatgctacaaatgaatctacctgtgaatggacggaccgcccagcgcagcgttcattgtccatattagactactaaactcaggtctccgagctctcgagcatacttcagctccctgtgatagccgttggatgattagcacgatatcatnnnnnnnnnncttcattgtccatattagactactaaagtcaggtctccgagctctcgagcctacttcagctccctgtaatagccgttggatgattagcacgatatcataagtatctcctcgctaagatgtttgtactgccaacagaagtgaatgcattgctctgactttagggcatacagcatccccctatgtcgcttgagcaggtcccgagggctggtgaatgttgaatggagagagtgaccttcatctatacacacctgcttgctgccgtgtggaaacacttccagacctagagttgtcatatcgttgcgccttgcaacgagtatctggtcgtgctgatgctcctgagcaacgatgaggccgactattggaaagcgcttggtccactccttgacgtaacagctgacaaagtagctccaatcgacatccctgctctcgcacaggtcggtgtcgggccttcgctggtcagcacaataggcgtccaggaccgagactatccattctcggagctccacagccgacatggtgtgcaagctgtcattggaagctgagcaccctatcgcagcgagggtcgccacaaggcagccgatggagaagcaggccggatttagaatggcgtccacacacgctctaacaaaagcttggtcgattataagttcaggccagtcgtgctgtaggagcttcttgaaagtctgccaccaccaaaggtcttcagcagctgggnnnnnnnnnncagaatggcgtccacacacgctccaacgaaagcttggtcgattttaaggtcaggccagtcgtgctgtacgagcttcttgaaagtttgccaccaccaaaggtcttcagcagctgggactgctgccagtgcatgctcttctattgtactgaaagacatatctgtggaatgcaggcgagcgagatatcagtcagtcgtttttccagggccttgctgtgttgaactcacgtgcgttctacatcccagtcatccacgcacacaaaactcccctccactcacccctggccacagagtccgtgtaatctatctggatgcagcggatgcactgggctcccattgaattttggtatctcatccatgcgcctaatttcttnnnnnnnnnnnnnnnngagcgaccggcctcagcgcggcatgtccaacttagtcgctcttggatccagaaccgcaccttgagcagggcgttgnnnnnnnnnnaaggagttgacatctccttccagtttggttcccccctcgacatggacctacgtgagtggtgcagggtgtagtgtatgacgatcaagggaccggcctcagagcggcatgtccaacttaatcgctcttgaatccagaaccgcaccttgagcagggcgttgcccctttcctccatcaatatctcataggtgtgcagggtgccgggccctccgctttcactggttgatgtttccctcctctcatagtatacgaagaggatgcaggtgagagcatcaagaggctcgcctgcacgatgtaaatgtatgcatgtggtgattggccgtttgaggaagcctcgcctttgagtttgtcatgcagatctgaaaaccacacctacttgcagcacgggcgagctttggtaccagcgatgtttcttctgctggcagaagatcaacgccaaaaagcattttggcggcagcggtatcccagatgctgttcacgtgagaagatgcattttgagtcggtcgagtacaggaaacaaggcttgggaatccttgcactagcagatgacctcatgtgcagtgcatgtctttttacctgagatgggcacgctcattgatggccagcaggaactctccttcgggtcgaggaaaggacatgagactggagatggccggctgggaaaagctctgcgaaaaaacccctccaaacacctgtgaaaagtatgtgctgatgccatgatctggaaacgatagcagctgcgttgttagtgtatccccggcatcactcagccacaccttactgagaccaagattggggggccgcagctctgtaaccttctccccgatgctctcgacatccactagtaggatgcggccttgggttgtcccaatggccaggtaggcgttgacgtactgaagggccacagggtcacctgtatctctgagtctagactccaacgaggctgatgtcaggctgtaaggcagttttgaagagatgtcgggtgacccggagtgcgatgctggggtgcagatgtcgctctctgcaagcccgacctggatgctgtgcagcaggtcgtcactggtgatgatggccaagtgagcttggtcgccagaccgcctccaaccgatggacggcaagatactggcagcaaactccagcgatgctcttcgggacggcactccaggcgagatcagttcgaggtagagctgacgtgggttgagaccatccaggcgccacacgagagtgggcgagtcatcggcagaacccctcaacgctcccgtagtggggcgccgagggtaagtacgccgatcaatccccccgcgtatgctatccagcggtgaatcatctccttcatgatagtccagccctatctccacgaagtccggtcgcatcgttccaggggcctgcagttgagagtgctattgtaacacaccgggatggcacattgatcgtattgctagatcgcgcatcacgatcccatttcaaaacctcaatgtcctgaaactcactaatgaatattgtcgggcaatgagagtgccgctggcggttcagacagcgtgcacgtctcgacctttatgacctgggatccaggacgtgcggaggaatgcagtacccctgaactcgcagcatcccagcgaagggttcgagcaacagaagacgggaatgcaccttgcccaccacgcaaacctgtacttgcttgaacaggtgcaattgagagctgagnnnnnnnnnngagacgggaatgcaccttgcccaccccgcaaatctgtatttgcttgaacaggtgcaattgagagctgaggatcttgtttggggtttgcaagacgtcggagctttgacgctgagcggacgttccctagaagaccgagttcggaggggagttggtgttccggacgctgccccaggggcgtgcgcatagcttcttctttggatgtcatcacaaaacaggnnnnnnnnnntgacgaccgagttcggaagggatttggtgttcttgacgctgccccaggggcgtgcgcataccttcttctttggatgtcatcacaaaacaggttggtcacagagatacccagtgtagctggagggtgcccaggcgacagcaacccactcttggccccccacccttcaccctaggctggtggtcgtgccnnnnnnnnnnatgccctggcgacagcaacccactcctggcccctcacccttcaccctaggctggtggtcgtgcccaccgtgacggtcctggccgtcatgaaggcacggctgcaaggcgcgacaaaggggcacgctctgctgaagaagaaagcggatgccctgaatatgcggttccgacaaatcctcaagaaaattgtccaagccaaggagcagatgggggacctgatgaaggcatcatttttttccctggctcaagccagatacgcaactggcgacttccgccacaccgtgctagatggcgtggatcaggtgggactgggtagctgccgtgtaagggagcttgcacgaagccattcatcgacggtatggtcaaaggatggcaggaggcccagctttccagtgcaattacattctcgtgctgcaggcgtccattcgtgtacgcgcaacgcaagacaatgtggcaggagtgaagttgcctaagttcgagtctttcaaggagggggcagacaccnnnnnnnnnnctgttgccattcatcgatggtattgtcaaaggatggcaggaggcccagctttccagtgcaatcacgttctcatgctgcaggcgtccattcgtgtacgcgcgacgcaagacaacgtggcaggagtgaagttgcccaaattcgagtctttcaaggagggggcagacaccaagcttgctctgatcggacttgggaacggcggaaagcagattcaggactgccggtacggtgatgtgggcttggctgacgtcaatggcttttgaggagacacaagggagctccctcctgcagctccctgggagtgactattctagactcaacagacccgcttgggcaagcacttgccccaccacaactcgatacccggactttgggccatccttgtgcaggaagtcatttttatctgcggtggagcttctcgtcgagctggcaagtttgcaaactgccttcttgaccctggacgaggccatcaagaccaccaaccgccgtgtgaatgcgctcgagcatgttgtgaagccaaagctggaaaacaccatcgcatacatcaaggtgattgtcgtcactttggactgatgggcacttctccagaagctgtgtcacatgggtgatcgagctcccagcctgaagttgaaggctgcgtgtcgctgggcgaccccagtgaagtttaagtgatccaggcttgatctcgccagtgctcccaaccctgcagggtgaactggacgagctggaacgcgaggagttcnnnnnnnnnnctctccagaagctgtttcacatgggtaatcaaagtcccagcctgaaggtgaaggctccgtgtcgctgggcgaccccagtgatgttcaagtgatccaggcttgatctcgccagcgctcccaaccctgcagggggaactggacgagctggaacgcgaggagttcttcagattgaagaaggtgcagggcaacaagaagaagaacgctgatctggctgctgccagggtgagtacagggcttggcaatgagcgtgttggggctgattgcaaaggtacacgaatgatttgccatgccttacttaagaaaagctccatgcacacacctcctgccatttgcccctttgagtgtgtaggagctggaggaggccaaagagacaacacacgtgcatgacaaactagccaccgtcctggaggttgaggacgacgatgtgattttctagaaccttgatgagctgagcagcactccccccctccactgtataccttcgcctctgtacccatgcttgcatggtaaaaggcaaccaaattccaaatctgggggggggtnnnnnnnnnncgacaaactagccaccgtcctggaagttgaggacgacgatgtgattttctagcacnnnnnnnnnnnnnnnnnnnnnntggggctcgcactgccagcagtcaggctggcagggtttgggggagggggacagctgccgatgggcaaacgcatgaccagggcgcacaggagagagtttccacacggaggagggaaatggaatgaaacaagtataggaatggactcggtccctgtatccgcaccaagagggggccccatggcaccatcgacagtagatgcagcagccctgtaccctaggatgcggtgctgtttgacctgacaagactctgttggtagacacccgcgccagtctgggcataggcgggcttggcgttggggccactgacatgctgctgaggcacgggaggtggacctggacgtgcgggcccctgacctacggcaggctggtaggtgtaagcaggtggagcgcccgggtattgggtcgggggggggggtccagggtgagctgcctgcgggtataggtacccaccggtggtggtggggtagccatttgcagcatccatcaccgacatcttttccacgctgctccccagctgcagatttgcgaggggataggactgagcgtgaaggggaggcggacataattctccccagtgacacggcaatacagaatgatgaggtggccattcccaatctggcctgtgagaggggtgggcgggtcagatccgggaaccacccttcgccacccaccatttctatggccttgctcgcatcctccatatccacagagttgctgtacgcaggagctgctccatacgctgtcgcccccaccacacccgacatgtggtgggcacctcggctcatgtacttggcggcctcagattggaagtctcggacacgctcccgtggcagggatgtggcttgacccaagtgcttgtcctgtccgcggccccccgcctcaaggtgcgcaaactggcgcttgaagttgtccactacgagaattgaaggagggcaggacccggggattgagcaaaaactagggaatggcacgatcttacctatgcaggttcatgcacacgcgggggggagggggggcgcggcagtgcatgttaaggatgcatccccacatcattacattgcaaataaaccctggacagtcagccctgagcacgtactgacctgccgaggggtagacaaagtttggctggcgccgaccgcctgccatgtagtcggccagcatctgcggatggtactccagtgtttcgcggtagatgagatcccggacctcatctacgttcagcttgcgccgttcaaactcgaatgcgagcttgctcactggctgtgcactgggctcgcgactgggctggctcaacccatggaagtatgggtcggccaaggcctcctctgcaaagggtaccgaggatgaagcggtgccaaaatgaggcctgctcacagcaacaccgataaagtatacctgagtcctcctcattcgtctgaatcaggtaggctccatttacttggaagctacgctcacaaagccatgctgctcttccatcctcccgaaacacacctgaggtgggtctctcggcgggatcaaaagccagcaagcgcctgagcagcttaagagcccctttgtcagccttcggaaagtaagcctcaaacgacgtgccgggcttcttccgcatgttgagcaagaatcttcgggccttctcattgcgcacctatactccaaggacaggatgggtaggtgcatgagcaagcgggagccctcagtatgaccccgggtgctaataccaacagcagagggatgggcatgcccacctcggtcgaaacccgagtcccctgcccgattttccattcgaaccaacagctgcatcgaggaaacggagatcccacctttgcaatgacttcctgggcaggagtgcccagcaggtcagtgatcagctccagctggtgaaccacattcctgcctgggaagaggggctttcccaggagaatctctgcaaagatgcaaccaatactccaaatgtcgatggcaggcgtgtactttgtgaagaaggagccgcagagctcgggtgcacggtaccaccgagtcgccacatagtctgtccagaagacggtctgtggcatgtcgttgaaggctggtcgcgccagtccaaaatcgcagatcttcagcttgcagtccgagtttgccaggatgttcttgggcttgaggtcgcgatgaaagactttagctacaccgtgggattaaggaatggggtcgcaccgttttcaaagcagtaagacactaacaacacaccgtgggggcaagtcgggcgctgctgccatccaatatttcccaacacacttaccgctgtgtatgtacttgaggcctcgcagcatttggtaaaggaagaactggtggtgctctggtgtcaaatcatcattggcttttatcacctgtgcagatgagactggaatgcctcagccacaaaccagctggcgcacacccctgccagaagaagtgaagcaggcccccccatgcccctttcacatcttgccttcccacctcgccccagccaaggtcccctcacacagaatgttcacatacctgatggannnnnnnnnnggtagggaatagggtcgcaccgttttcaaagcaggaagacaccaccgacacaccgtgggggcaagtagggccctgccgccatccaaaatttcccaacacacttaccgctatgtatgtacttgagacctcgcagcatttggtaaaggaagaactggnnnnnnnnnnctgaagcaggcccccccatgcccctgtcacatcttgctttcccacctcgccccagccaaggtcctctcacacagaatgttcacatacctgatggaggtcggtctccatcaactcaaacacgacgtatatgtccttgaagtcgtgcatggagggtggcagcatgatgtgtttgatctccacgatgtctgcagcaccgggggaggcaaggggtcaggatgggaggtacagagtgcttctgagaccaggggacagctgctacaagcgctggaatctgatctctagtggaaacacgcacctggatgtctcagcaggcggagtaacttaatctctcgcagaatgcgggtggcatccgacacgtgatcgaagacatttgtgatcttcttaatggccaccttctcgcctgcatgaccaatggaagggaatatatcgtgcaaacattacacagaagtaagtctggggaggatagaccacagccagacgacttgcctgtgaactggtcgactgcactggccacaatgccatagctgcccttccctatcacttccgtgatcttgtaccgctgtgactccgtggcctccgcgaagaagtctttctgctccatctgtgccatctgcattcgtgtatggatgaatttgaggagcgacgggcacaattcgcccatcatgcctctcagtcccacaggaaggaaaaggatctgtgcccctggcgagccttacccgatgacctgccacacccgaagaataccaagcccttgagctatggtttggatgcaaatattcgagtacagatccgggtcagatgggaaccccgagcccgggcgttgcggggcgtgggtccagagtgacagtccaacggagatggtccctcccggctactggatgtctgtcgaccctgccagaacagccagatcagttgtgcatgtctttccggccggttaaatggggccacagccggttggatgtgccgtactgagactgggagggttccggcacggagccacccacagagcaatcctgctcaaaccttagtccaggggtggtttgcagggaccagatgcaccagctctgggagagtgaggcctttcgatgtgatgcgggtgtcgagtcgctggtgcgtcttggtctgctccctagcacgggcgttccgtcgtttgtgcacggtgctcccgggattggcaaaaacaataagacccttgccacgccaaaaaaatacctgagcatatgcgacctcttacatcatgcacattcttaattgaacctcaacccgagctcgagcggggtatatctggtttcaaggagtgctcgccagctgggtcgtgctcctcctgcctgcaatgtgcacccagnnnnnnnnnngaagcttgagcggggtatatctggtttcaaggagcgctcgccagctgggtggtgctcctcctgcctgcaatgtgcacccaggtgtgcagcgccacgggcattatctccactcggttgcagactcaagtccgaatgctacgtccttgacgtgtcacctattccgatgcgctgaatcccttgtgttgggtctgaggtgggtgagatcccaccgcctcgtaccgcaatctcgagcactgacactcgacatgcaccctctcccatattacagcacgtcgaccttgccgagacgcaccaagagcttgctcaagaggcgaggctcttgagcaagtacaacgggctggcccctaagagggctctcctacagcagcggaagtccagcaagcactttgattccgctgattgggcgctgtccaagagcttgacggcgaacacaggggtgagctcagaccttgagtccctgcccccaaagcgatgggagccccggactcccacgctccagcggcgtagctcaaagctgagtgtagcttcgtcgtaatggctgctcttgggaagtttttcctcacagtccagcccatatctctccagtgatcccaccgttatacctcacannnnnnnnnntcttcgtcgtagtggctgctcttgggaggtttttcctcacagtccatatctccagtgatcccaccgttatacctcacagcatgtgaaccatgacccttttgccagcacggtgtagtgtggcagcttggcataccaaatagtgcacattgcccttttcctgagccatccatagatggtctgtaagataccttccgcagtcagcaagttcaggcagttgagtgcagggaccagtagggtcgagaatctcctccgggggaatgaaggcaagaggcagcgctctgttggttctcggagtccatggcgtgcagcgtccgccggtgtgcatgggagtctcctgggcagtcttgcaggttgtccgcagccccaccaactatgaaatggttcagtcgagctgggttgcttaggtgctgcggatccagtccttcagcgcgatgttgtcctgcaaacgccagcgatgtgcagccatgtnnnnnnnnnnagagtgcatggcgtgcgccgtccgccggtgtacatgggagtctcctggacagccttgcaggttgtccgcagccccaccgactatgaaatggttcagtcgagctgggttgnnnnnnnnnnctctttcacggcatgtgcgcttggaagagggcgcgagaagtactcccggccattgttgggattcggtgtgggacctcgccttggnnnnnnnnnngtcttccacggcatgtgcacttagaagagggcgcgagaagtactcccggccatcgttgggattcggtgtgggacctcgccttgggacattgatcacgatgataaaacccaacggcgtcctcatcaattaaagctccttggaatgtactctgtgcggcagaggctccccctcgtgatgatctcgggcatgcccaacctgcatcnnnnnnnnnngaaacctaaaagcgtcttcatcaattaaagctccttggaatgtattctgtgcggcagaggctccccctcatgatgatctcgggcatgcccaacctgcatcctccacagccctaagcatcctcacgagatgtcggcgtctgcctctcaagatttaccaggagagcgcgatcggcactctgagtctcaattaggtcgtgggagggccaaatatgaaaagcagctgaaccagaatgctgccgaattcagtcctgcaggtactcggccttgtgctcttggcaaggtgtgcttgtgaagctggccccattatatgtcccaggcaccaccgctaccatccttgttgccagggtctgctccagtggaaataaacagaggagccagagtacctgacaaggtgatgagatgtccatcacgctcgtgttcaccttgactggtgatgatgacatcgagctgctgaataggtagatggatgatgaggatattcagtcaccttaacaggagtcgatcccctacctgtactcgcaggcccagggcaaacagtctgacgcatggaaaaggtcaagtgggttgtcccccggannnnnnnnnnggagatgtccatcacgctcgtgtttaccttgactggtgatgatgacatcgacctgctgaataggtggatggatgatgaggatattcagtcaccttgacaggagtcgatcccctacctccactcgcagtcccagggcaaacagtctgacgcttggaaaaggtcaagtgggttgtcccccggaagcccgcatctgaccacgggcaaggctgttgcctcgcttcttaagtttcagtatgctccacggccacaggtgatgccttttctcagggaatagtggttctccggcttgagatggtgagaaggatttcgaagggtacatactccttccgcatgacagctttgcatcgctcagaccccctttccgtcttgatggaagatctcccagattagtcggccacggcagcttccagctccaaatcgatcgacaaggagggcagcctatgcggcacatgtgaaccacaggtacgatggagccttgaactggctctcctgtgcctgcggattttaagccaagccaagttatgagtgccaagctgccatgtttgtccttgtcacgccccacctttccccacaagaaggtttctaatatctgatgtggtgctgccccacctctcaaattgggatctggacttggatacgctgtgggcagatgtcgttcaggttggtgtgactgttgtggactgagtttgcggcacatgcattgtccttggccatttctgagtcacagtgtccgggagctcatgcgcaccactattaggtcgaggtcttgacgagcgaagacttggtgtgcccaatcacactggagacgccagtgtgcccccagatcacgccatgcggccatgtcttcagctgtcatgccatcgtccaggtgaggggggccacgcttcgtgatgaagtggcatgcggtgccaatcaagctcaccagccccgcagtgatgatcttgcgtggatgttctcatcatgtgtctattggaccatagttcctgtcttttccttaactttgggtcgcctcgtctccatgcagcacatgggagggatcaacgagggccccgccaccttccgctgtccactgtgcttcagtctcatcaagaagctggacctgcgaagtgcatccatccgccgcgttnnnnnnnnnnctttccttaactttgggtcgcctcttctccatgcagcacatgggagggattaacgagggccccgccacctttcggtgtccactgtgcttcagtctcattaagaagctcgacctgcgaagtgcatccatccgccgcgttgcggcgttccaggtgagacctttgagagcgactgagctagccatagacatggtatgtatccacagcgtgagggttccgcccattcagggtctcttctcaaaattggtatcttcttgtgcaggtgggcaaggacatgcacatggtgannnnnnnnnntcgcaattgggcgagcatgccaaagcctgggagtgccagcttcgaggctcgtttacnnnnnnnnnntgccagccatagacacggtatgtatccacagcgtggaggtcccgcccattcaaggtctcttctcaaaattggtatcttcttttgcaggtgggcaaggacatgcacatggtgagacgctccccatctccagccaaaggggacgtatctcgaaacttcttcagtgaagcagccaatggttcacaagagcttcatgtctcagtggagtctaccgcaaagatgcagcccccagttgctacccgccattgggcgagcatgccaaggactgggagtgccagcttcgaggctcgtttaccatcgtgccatgcatttgaaaggtttactacagtgtccgatcctctgccgctgtttcagcagcaagccgcggcattgtgccgaatggcgtgtcaggtgtgaggcaagcctggtggtgcatttcaagtgctgtttgtcgagcagatcccatgccaaactgtgtgagctgctcattgacaaacatgccatccaccctccctccctgcaatggttgtccaaggctgaggccgaaggtggcttggaagctgcttttactgccccattcatccgccagtctgctacatttgtcagtcagcaggctgcccaatggtatgagcatcagagcatccgaaagcatacttttgacggcgctatctctcaagcggatgctgctgcagccaagaaactcggagcccaggccgctcgtcaagtggatcaggtgcgggggcaagggcgaggtgaggtgacagacaatgcaccaactttgcatctctttccagggttgtcagcaatgtccctgtctgataattcgcaggcaggagcatctgtcacgggnnnnnnnnnnggggggcaagggcgaggtgaagtgacagacaatgcaccaagtttgcatctccttcaagggttgtcagcaatgtccctgtctattaattcgcaggcaggagcatctgtcacgggagcaacagtggttgccactcgcctgcagcagcagtttccttctcttccctcgaaggcgtcccagcaagagaccctgtatggaaggagcgatgcatcacgacaggatcctggcacggaagcatcaggatcagcagctgccgagagcagcccaagacctgacggcaatgagcaaacagacacggcgggcgtggagtcgctggtcgccggcagcactgcattgcatgcaagcttccagtcggatggtaggttgccatagggttgaacgaagttccagcctgacagactggtgaaatcctcggtttttttgtacaatgtaggtgaccgcagtgaggtcaaccccaatgtcctgcctgcaaactctgcatcaaccacacacaaaaataacctcctgccctcccatcgcagatggtcaatgggnnnnnnnnnngcagactggtgaaatcctcggttcttgtgtacaatgtaggtgaccgcagtgagatcaaccccgatgtcctgcctgcaaactctgcatcgaccacgccaaaaaaagaaccgcctgccctcccatcgcagatggtcaatgggtgtttctgagccctgtcaatttgcgcatgctgttgcacgaagcgggtgccacagccacgcctcttcccaacggcctgcatggtcgactcctggaactggagtatatcacgcagacagaggcgtcccgaaggcggtacagagcactctcccatctcccgcttggaggtcagtgcgtcgtgggggtaaacccacggccactttctggcctggtcagaagtctgggcctgcatgtaacctcacctcagggcacaaacctccatctcacnnnnnnnnnncatgcgcatgctgttgcacgaagcggaggccacagccacgcctcttcccaccggcctgcatggccgactcctggaattggagtacatcacgcagacagaggcgtcccgtaggcggtacagagcactctcccatctcccacttggaggtcagtgcgtcgtgggggtaaacccacggtcactctctggcctggtcggaagtctgggcctgcatataaactcacctcagggcacaaacctccatctcactcacccctcccgcagcaacatttcggttgtgtgagctggacctcagtgattgctgttccgcagacactttggatgcattctcagaaggccttaagctccgcgctgctcggagggcacggctcgcaaaacaggccgctcatcagtcgcgtcgggataccatggctgctaccgaggctgccgccagagcagcctaccccgtgccacaagctgctccgcctatagaggagtgggggggcgagccaaagctgtggatcgacccaggtgctatcgtgacatctgcgacggtggcacagggaggagtatcctatgctcgcctgacccgagaaggatttacggcgtctggaccagagctgtcatcggcacgttcgccgggggccagtgtcccatctgtgccaagccctcaaggagcctgggccaaaaggcaagcgacgccgggggcacaacaagagggaacacgagtgacttggtcggcctccaccccgcctcacagcaagcaagcaagcggcgggaaggggaagaagacggtcgtgtacacaactcagcaacgaaagtactgatgtggttgcgtgtcactatgtctcgcgtgcttgctttccaggaagtttctggacttctccatatagctggcctccatggatcctcgagatgtgcatgtacagaatgtgagtataaggtatgtaatgtcatgatcagactgtataatataaagggagctttatgagatcacagacagtcagtgctcaggtggcaacaccgtgtagctgtgagaacgtcctcttgacagctctagggttggtcgtgcccgcagcggccccgaaggggtgcaccacagagatgtctggggtcagttcagcaatgtcgttagggtttgctttcgtgacggagagaactcctctatgcgccttgcgtgctcgtgcatgtcttagaacctcctgtggagcccgtgtcacggcatgctgagcctgctgctgtgtgagaccaagcaaacctccaagatttacgacatccacaggccgcctgtatgaggggagggagcgatgcgaagggattgtcgcaaaaacgcgccttccccaaggactctgataccaaagaatgcagaacaggacatataaagtcaggacgtctcacctgagatcgagtacagttctggctccactgctgagaagtatgcccctcccccgggtctcgcgaaccagagccgcaacattagagatgaattgcattcgagtggttgaatcccgcaagagcgccgagtagcatacctttgaaaacgcacagatgagagtatgggaggcaatgggcggactgagaagcccaacgaaaatctcctgaagctgcatctatgggactcacctcaaaatacactccacgagccatggcagccgcgatggtactgggtttgaaccggtatgccaatcgcttggtgagatccagggagatgatgtccactggcaggctggtacatgccaatgccagcgtcttctcactctggggttgtatggcaaggatatcataggtacttgtaacagcttcaaaagtacaggccagctgggcttgaggcccgtcctcggctaccaccgtgaggcgactgagctgttcgagctgtccaaaagtcctcccaagctgcagaactgcattgagagccgttttggccttcgaatgggcattgcgaaggcttaaagggtccatgggctcgaagtggcacctggaatgaaagggaagagctcgggtacaaaggttgcgtgaatgctcccgacgtatacaccagcaatcacaaatactgagcaaataatgcatcgaagatcttacttgtgagtggcatccaatggagcgacgactttgctgcatattgctgccacgccgtaacccagccgcaagcaggtcgccaacctttctcttcgcgttccatgctcgaggaggacctcgctgcagctgagatcgctgtatcccgtggctggggttttcctttttggcatggtgtcgcacgaggacgtcagtggtctgcgctctcgctgtccggctggacaatgtgcagaagtcgaacaagtaggttcacagttatttgcatgctgcgcatgacatggtgccaacccacgcaaagcacgagctaatgaggcaatttcttcatcttcgtcgcgccaccgcagccttgtcctcctctgtcaatctctgatagagcagaagatatggtcggtccgtgaacacctgctgggaactcacgcccaggacgtccccgtcgtcgaatcgcagccacctgtggcaaagcagcaagtgcattctcaggatttcattgaggacctttgttggaactggatccatggcacttggcccagcatttttatgctctgcatccttgcgctctagataccctgcaacgccacagtcgcacctgccactggggtgcagcacatccgccgtgtagtgcccggagctgctctcggccccccggtggctcacggtggcgatcaacttgtacagtgcgccatgatcaccgctgtctgatgtcagccactgccccttgatggtgatgtatggctcaaaggacacccttttcccaacctggaaggcactcgatgacgaggaagggcaccgcattcataattggaggaagcccttgagcgcatggcaaggaatggcgagacaaacgcatccctgccgagtgcagcccgcatagacagctgagcgccattctcccaccttattggctccgtccccagcactgccgccaaactcaaagcgcatgaggtgcagcgtcaggaggtagggcagggtctgcaggcgcagggtcttggttgcactcactggctgagagccggggaacggcctgtaccccgccacggtctcagccgccgtgaggtcctccagggcatccaccacgctctggatctggggcagggcatagggaaggagtactgtcgtgtgtctggtccagggggcccttgcctgctcataacagtgcaggtgcttctgggcacatttcgacatgcatggcagatacctccctggccgtcaccgcggcacgcagtgcctgctgtccgtccacccacccacccacccacccgtctcacccccggcctnnnnnnnnnnnnnnnnnnnnnnnnnnnnnnnnnnnnnnnnnnnnnnnaggatgtgcaggcccagcgcgcagaagggctgcagcgtgacggaggctggcgcaccactggccgcgacgaatgaggctatccgcccctggaacagggccgtggcggggctggcccctcccatgacgccagactccccgcgccgcacgttcctcttgccgctccgtgtcagccactcctccccgtcgtcctccccgcgcgccgagccgccgggctccgcctcgcaccgggaccagccccgcgtctccgccagcgcagacagctcggcgtgcatgctgtccaccaggaaggtcaggaactcctgggcatcctgctgctcccgccgctggtcgccgcccgtgcagttcaggggcgcgaagacggccacaatgtcggccagcatgccgggggcaaagggcgcgcctccggcgagcagggaggcggcgcccgtctcgcccctggacgggggcttgcctccggcgggcgggggcggcggcgccagcttcctgcccaccagcgtgggccctggcggggagcgagccgacgtccctggcttcccctcacgtcccagaggctgcagctcgcccgccagctcagcgagggccgccagcgtggggtacacgctcctgggcagcgactcggccccctcccgagccagtccagagagcaggctgcagaacgcagggctggccagcagcgcctgcaccgtggcgctggcgaagcagaggttgcccgggttcagcaggccccgcggctcgtaccgcgttgctgctgaggccacccagtcgctgctcgcaaagagctgctgcagccgggtcgaggcggcgaggagctttgacccggtggcctgcgcagggtggtccgcgccggcgtccgagggcgtcggccctgtgcgctcgattgcaggcgcagcggcctcgtggcccggctcagcctctacaggtacagttcgcggggtcgtcgcctcccctgcaggcctgctgctctgctcgttccccgccccaggcgctggtgcggcctggtgcggcgtgggctgagctgcggcgcacgtggtggcatgagaggagggccggggcctcgccctaccgggccggcgtccagcggcagcagcgagctcggcccacgatttgggaggcccttgctgcaccacaggaggatggctgccgggaccaagctgtggggttggatcgtcagagcttcctacagcaccagacgcggcccgggatgcagtgatgggatcagcaccttccgctgctcgaggttccttggccgctccatcctcctcagagccaggcccaacaatagctgcatccgccgctggtggtccagttgatgacgccgcacgaggggagtcgatggccgcatccattggcggaggctgtgacgaggctggtacttcctggggcgccccgtttttgggtgccgtaccggccccagtcgctgcacgctctgggtgggccccaggcaggatgggctgtgacgccggggccgcagctccgccccccttcacagctcccaaacctggcccacggtgcctgccggtggcggaagggcctgccaacgcacgtgcaaagggtggcgggggcgtgtatgagacgaccatggggtacagtccgtgtggaggcgcaccccccagctgggggtgaatcaagcctgcaaagtggtgtgggatgcccatgattatgcaggaagatgcaagacacacacttgagtgagcaccgcccccgcttgcacagtctcattcgcaccaggaaccgggtggtggggatcccagggcaggacacctgggggcggcggaatgaacgccaccggccctggaacaatgggcaggttgtacataggaggtggacctgcagagacacgcagtgaagccagacggtcaggtgagctggaagtgtgcaattgcacatcaaggccagtgggaagtgggatctgggatggccgggcatgaaagnnnnnnnnnnggtgaagccaggcggtcaggtgagctggaagtgcgcgattgcacatcaaggccagtggggagtgggatctgggatggccgggcatgaaagtggtacactactagcacaaacaccgtgcatctctggtgggagtctcttaccgcatctacacacctgggtagaggatagccggcgcaccggcatgctggcaatgggaaggggcgccagggcccacagggccttggtacacaaacccagctggtccaacagctgcaccccttccagcatttggtgagcttccaccgctgacatgccaggctggaggaggagggcgaggtgggtaggtaggatcattgctgttcatcgtggcaagggaggccggaggtggggccatgggtggcacagggctctttgctggctggtcgttgttaggttgggcgagatactctcgaggccctcgcgcctgggatgtttcctcttgctggtgcaaagagggcgcagcaccatgagaatccaggctttcatcatggctgtccactcccacttgagcgagatgcaacattgccgtctgctgcaccattgctccaagctggccagaatctggttccttaggctcagttgccctgtcagcatctgcagccttgggctcagccaggggtgcaggcaacgcaggctttgcaggctgtgctggtgtagcttctgcggcaacagggcccggcgcagcccctcctgacaggagggaagcccatgacgttggcgtgcaggtggggtcagcccttacgcctcctttcaaagcgctcagggaggtaggagagagtgacggcctctctccgctgccgccaagcactcccgcaggagtttggcaaggcctgccgctgcctggcagtgtgcctaggctccgcatggggcttgaggcggaatcctggcctggggcggggatgcagtcgccgtccctgggcgacgcaagccctgcggattggtcggagcctgatgcccgcggactgagcacagccgcccagctcccatggcctggaggtgaggaggaggggccagcatgctgggcccctctgaccccaggtctcacggccagggcttgtgcgttcaggacaggcaccgggtggtggcggccaggtggtccatctcgagctgtggtccccctaggcgccgtgaatggagcagcctcccgtatcccccttcccgagcttcgaccgcgaccgccaccacgtgcacgccgtggctcctcgctcacacggcccagagactgccatgtgtcagggaggagtcgctctcatccttcgcccgtcacatgtgaatgggtgaccgcgaagcagggtcccggtgcaccctgttctcaccaggatagtatgtcactcccatcacacctggcgcgatgccgcctgcttgcgtcctttggagttttgctggatccagccggatccttgatcgggctcctccgtcatgcgagtctgggtcgcgctcgccctcctacagacatccgcacttgataatataccgaggaggatactgaggagcgtcccgcgaggcttggatcatagaatcgaagggtcgttcatgcatcaaggcctgggcgcgcctgctttaggcatggcgacctaaaagtgtcactggagtgggcaagggccgtctgcccacgtggctggctgcatgcaatcgtcaagacttgcggaagtccacctcatacttctagggagtaatttacataatgcattaataaaaatcccaacaaccacctctaagatagtacctctctgcgatcgcgctcctcgtggggaccgcctggcgcgagccgggacgagatgtcggggactgcagggcccctcatcctgtccagtcccgcatccaggcgtctgcgcctccttcactgtgccgaggctggaaacgccgatgaggttgctcccttcccgggcttggacccctccacctcctggacgctggctgtggcggacatggccgtcctgggagctggggtttcagaggacgctcccagcgcaaatcctggtggtggacccacccaggaccccaccatcgcagtgggtctggccgtcgaaacgatgatccggcttcaggtacctctgctgggccgcaggacgtcccctgcatccacggacgctggactctgcccccgtcctcctgctttgcgacctttctcctcccacctccactccccacacctgcctccagattcctgcgggagcactggtggagctgagttccgtatatgcacaggatggccccccgggcgagcgccccgagcaccacctgggtcacgtcatggcgctgggccccggcagcgctgccgcccccgacacggcctacatgcaacccctcctggcccacaatctgggtgcagcactggacacgagcctcctcctgtgcccctcaggcgcccgccccaacgtgcgtattgcccggtcgccgctggacgcggtgccggctgcggcctccgtctcgctcgcccccgtggccgtcccggcctccgacgtgctgacgctgcacggggagcggccgggggaggagggcggggcgcccgacgacggcgccgacgacgacggcgccgatgtcgtggccctgctgcaggcccacttcctggcggccccccgcgtcgtggcacgtggcgacctgctggtcctgccgcgagcccgcgccccggagcccgggctgctgctggacgcgctgcacgggcaggccgcggtgccgggcgaggaagggaggccccgggccggtggcgcacccatcctgctccaggtgacggccgttcagccaggccccggcccggcgctcttcgtccccggcaccaccgagtccgtcctggaggggagcgccaggtcctccgcgnnnnnnnnnngggtgacggctgtgcagccaggccccggcccagcgctcttcgtccccggcaccaccgagtctgtcctggaggggagcgccaggtcctccgcgcctcccagcgtcctggggtttcccagtttgcaggagggcgcccccctggcccccgccgcggccgagctggcgcggctgctggccggcgtggcgcacccggggtccaggcgcacgccgctgcgcctggcggcgctcctgcacggcccgcccggcgccggtcggcgcagcgcgtgcctccgcgcggccgccgcggcggggttcca

SEQ ID NO: 33900 - DNA, 165 bp, Chlorella protothecoides
ctcgatgctggaaggtatggggccctgtgcgtgcaaagctgatactgcggcaatgggcgcaacgttagggttgcacgttctagactacaggatccttgtgatggatgctcggttgcgtcgaatacgcatgtgcatataatccttgccctcactcgcgtactgcgc

SEQ ID NO: 33901 - DNA, 119 bp, Chlorella protothecoides
caagtttcctcccaggctgggcccggatggcggtcgcgcacccgggttcaaggtgcaaccctaccaggtgcaggtgatttcggtgtccggcccgaattcacatcgctggagggtgcggc

SEQ ID NO: 33902 - DNA, 61 bp, Chlorella protothecoides
ggctcagatggggcgagaggggatgcagggtattttgttgttggcaatgttaactcggaca

SEQ ID NO: 33903 - DNA, 172 bp, Chlorella protothecoides
ttgggcacgaaaatcagggccatgctcggcgatattaaccaacagtcccaggcagccacagagctcgtccagccacgtctccagatcccaattgtccttggcaagccctggtgagaagtgcattggacatcgtttcgctgtttgaatcttgcagatggcatttgcatgagat

SEQ ID NO: 33904 - DNA, 63 bp, Chlorella protothecoides
ggcccagatgctacggtgaggacctgcgcccagctccgggagaggttcttccggcaccacggc

SEQ ID NO: 33905 - DNA, 121 bp, Chlorella protothecoides
ctggcccaccccccgcaggcgctccaggccctgtgggagccgtcccggcatacctttgccgtgaatggggcggggaggagcgtgcccgggtccctcaccagcgggctgcatgccgtcaagc

SEQ ID NO: 33906 - DNA, 61 bp, Chlorella protothecoides
tactcctgccgtgttaggggggggccggggtggggggggggttgaagaggcaatggaggga

SEQ ID NO: 33907 - DNA, 189 bp, Chlorella protothecoides
ggcctgctgatctggatccaccaggtgagggctcggtgtgcgggggcctcagcatgcgactgtgggtgcgtgcccacgcagtcagttcccatcgtccccacacgacccgcactgaatcgacttggtgccacacccctcgttcctaccccactcaaccctgcaggacgaccctcgctgggcgctggcgga

SEQ ID NO: 33908 - DNA, 61 bp, Chlorella protothecoides
gcgcgcgcgagaggcgggggcgggggcaggtccagcgcgcgctccgggcctcgaactggcc

SEQ ID NO: 33909 - DNA, 167 bp, Chlorella protothecoides
cagcccctgcatgtaggggtgcttgcgtgacatggcggggcaactggtccatgaaaaaatgctcccagcgtccagcggggatcctgccgaggcttcttcgacttgccgctgccggagcaggcttcccactctcagtcctccctgcaccacgcctgcagactctccgg

SEQ ID NO: 33910 - DNA, 176 bp, Chlorella protothecoides
ggaaaaccatccatccttggccaaaacttctttccagctgcgggtggttcatcaccgacaccacagcacccagcactgctcttgacccccaccatccttgccccttttgagtgtcagacttttgcaagttgaggggtgcagcaggagggtgccaaggctcgcagcagggttgtggg

SEQ ID NO: 33911 - DNA, 182 bp, Chlorella protothecoides
cccccgccgcaagtcgctcgacctgcctgatgtggccgcgcgagcaacgcctcggcccgtcatataccaggtgtgtttatcggaagcgtgaagtgaccgcgtgctggtgcgcgcacccctcaacgagctgaaagagcccgcccgactccccctctcgcagaacgtgctgcaaaaggtgcagc

SEQ ID NO: 33912 - DNA, 101 bp, Chlorella protothecoides
acgccaggatcctgccattcaaggtcctgggcccagacactagggcatccgacctgcacgccgactgaccgttcaggaagagggagaccggactggactca

SEQ ID NO: 33913 - DNA, 103 bp, Chlorella protothecoides
cctgcagcgccgacggggagtgggcccgggggggtctgtcatccacatcggcgtgtgcggcctgtaacagccccgtagcaccacaggttcaggcctgcccacc

SEQ ID NO: 33914 - DNA, 74 bp, Chlorella protothecoides
gtaaggaatgtacgaaaggcagtacctgggttggatggaggggggatttttgtgtttgacagctggacagtggg

SEQ ID NO: 33915 - DNA, 19793 bp, Chlorella protothecoides
  modified_base (800)..(809): a, c, t, g, unknown or other
  modified_base (1244)..(1253): a, c, t, g, unknown or other
  modified_base (1690)..(1699): a, c, t, g, unknown or other
  modified_base (2132)..(2141): a, c, t, g, unknown or other
  modified_base (5374)..(5383): a, c, t, g, unknown or other
  modified_base (6129)..(6138): a, c, t, g, unknown or other
  modified_base (7090)..(7099): a, c, t, g, unknown or other
  modified_base (7254)..(7263): a, c, t, g, unknown or other
  modified_base (7925)..(7934): a, c, t, g, unknown or other
  modified_base (9140)..(9149): a, c, t, g, unknown or other
  modified_base (9647)..(9656): a, c, t, g, unknown or other
  modified_base (11277)..(11286): a, c, t, g, unknown or other
  modified_base (12745)..(12754): a, c, t, g, unknown or other
  modified_base (13242)..(13251): a, c, t, g, unknown or other
  modified_base (14529)..(14538): a, c, t, g, unknown or other
  modified_base (15772)..(15781): a, c, t, g, unknown or other
  modified_base (16778)..(16787): a, c, t, g, unknown or other
  modified_base (17188)..(17197): a, c, t, g, unknown or other
  modified_base (17505)..(17514): a, c, t, g, unknown or other
  modified_base (18251)..(18260): a, c, t, g, unknown or other
  modified_base (18968)..(18977): a, c, t, g, unknown or other
  modified_base (19139)..(19148): a, c, t, g, unknown or other
  modified_base (19231)..(19240): a, c, t, g, unknown or other
  modified_base (19558)..(19567): a, c, t, g, unknown or other
cggcggggcgcaggcgcgggcgactcccccaccccccgcgcgccggtggaggaggagatgcgctcgctgctgaagaacatgtccattgacgaggtggatgcggtggccgcgctgagcgcgcgcgggtcgctggaccgctccggcctctggttcggcgcggggctgggcctgcaccccgccggctccaccatcaccgaggagagctccggcgcggcggagggcgcggcgcgcagcgccagcttcgaggccagcgtgtccgggtcggaggcggcggagccggcgctgcgcttcgccatcgaggacttcatgcccgagaccgcgctcgtcctgggcggcgacaagatgtttgtcacgggcagcgtgcgcagcgcggcgggtctctgggagcgccacgtccacctcaagtttggggaggaggaggtgcctgccgtcgtgctcaacgccaccgtgctcaagtgcaacgtgccgcgtgcccccacccccgggcgcgtgcgcctctgcgtcaccctgggcgacggcgtccccgtcagcaacaccgtggccttcacctaccgccacgtggaggcctggaacggggcgccggcgccgccggcgcccgccgctggcgcagacgtccacgcctgatggatgcaggggcagcgttgcggcagccaggaactgggctgcgaaagcagcgacaggctgacgccagcgcctttgacgcgcctgcaccccctcctcctcacactctcccctcaccctcctccccgtgcaagacagaaagcgacgtcgatgttcctgcacctttgccacgctggaannnnnnnnnnaagcgttgcggcagccaggaactgggttgcaagagcagcgacaggctggcgtcggcaccttcgacgcgcctgcaccccctcctcctcaccctctcccctcaccctcatccccgtgcaagacagaaagcgacgccgatgttcctgcacctttgccacgctggaagttgcgccctctgcctcctcgcgcattcttgatctgtcttgtatcttttgatacctgcccttccttgtctggtctggatggacccatgcctggcctagccttgccaaacgtgcgtgacctaaaacacaagtggcatgtaagatattaaccagcccgagggctaggagggtgacagccgaccctcagccatacaaagagcacagaatggaccaaaggggatgcctgagcagtctcaagagcaaatgtgtccagcgcacctcgcacaggaaagnnnnnnnnnnccaagtaagatattaaccagcgagggctaggagggtgacagccatacaaagagcacagaatggaccggtgtctcaaccaaaggggacgcctggtgagcaaatggaatgtgtccagcgcacctcgcacaggaaagctaacatcgtcgtcgtgattcccgctttccggggtttcgggatgtattaccaaacgccgagacaatgcatgggccgcggactgcagagtgcatgtgctacctgacaaattccgataatcactgaaaacctggtttgcatgatgcgcagcagaactcgacgccccctccaggttccggtggtcatacaccgagcatgtcggtaggtctggaccaccccggcgacacccatgcagcctgacatacatggtctacacacgtgtaccttgcaatacgtactaattctatggcagaatcccaccctgnnnnnnnnnnactacctgacaaattccgataattactgacaacctggtttgcatgatgcgcagcggaactcgacgccacctccaggtgtcggtggtcatacaccgagcatgtccggtaggcctggaccaccccggcgacatccatgcagcctgacatacatgctctacacacgtgtaccttgcaataagtactaattctatggcagaatcccaccctgacactgtccggggcggggtgtggccgacctggccctccctgctgcgggtgtcatgcgactccagacccatgctcagacagctgcgtggcctggccgccctgtatttgctgctggggaggagcctgagcagcatcgccctggagctggtgcggcacatcaggcaggcaggcggcatgctcaagagcctgtcccttggcgggcgcctggtgtaccgtggcgtcgagnnnnnnnnnncggcaggctggcggcgtgctcaagagcctgtccctcggcgggcgcctggtgtaccgtggcgtcgagatcaagcgctggcacggcctggcggcagcctacctcgcctacaaggcagcccaggcgctgcagggtatcatcaagtacctggcgcagacggggcagaggagaacgctgcggcgccgcatgcgcagcgcgtcgtcgtatgagtaagtggagggaggggggggtctagcatgttcgcagggtctccgagcaatgcatgcagtagatgatcccgttctctgttcatgcatgaaggtactcaagctctccccctgccatcatggcttcgcagggagtggcaggggctggcgagggagtgggatagattgacgggagccaaggcgaagccgtgcctgacagcctgcgaggcagccgagctccgggagctgtccgggaagctgcgggaagcccgcctggcaggcgatctcaccgccctcaggttcacgctgcgcatggacctgaagcggcggagtgggtacgaggccgtccagaggtaggcggtgggcgggacggagcgggatctgggtatatcgaggggctttttgtctccccctctggtctgatgccagtgctggtgctcaccattaggccgcctttctagatcgatgtactttcctgacccgtgccccatccctgcgcattctgacaggctcctggacaccggcatccagtgcatcacgctgcctgccgaggtggaggagtacctgagcgaagccatccaggcgctgcagcacatcgtgggcacgcctggtgagacgaagggatgctttggtggagtaaggggaggctggttgtacgtggcagtgtagagtatgcagaccttgcatgtgtcaaggggtttcagcctgcaggatcatgcggcagagtgctcctgcctggatttcctagcaggcctgagatctggcacaggatgagctgctaaagctggcggcgcagccttgtccctccataatgccgggtgccagcgctgtcccaccctttaccttcttctacccccctctactcttgattcctgcagcattggtacaccggggtaaggtatcgttcttccgcgagctgcggcacgcctacggccgcactgccctggtcctgtctggcggcggctccttcggcttcttccactatggcggtgcgcaattttgtgtggagcatcgcccctcccttccttgttacgagcagccgattgcaaatgcccgctccagaaagtgtcaggcactgcacctccgagattaagactgccttcgcctccttccaaaacccccccaccccatcccccaaaaatacttctgccatgcagtgatcaaagtgctgctgaatgcgggcatcttgccgcgcatcgtggcggggagcagcgccggtgcactgggcgcgggcatcctcgcctcgcgccccgtggcccagctcgcggcgctggtcaacatgttccccggcgatctggacatgaacctgctgtccaacaacaccacgccccacatcctgcgccacctggtggtcaagggtgaggctggtgtgggtgtcgcgctgaggagggagccggtggcacggcgggccgcgagcacactcgtcagagggatcccccttgctgtgcgcaccaggctcctcctcctgcacccctcccctcccatcctcacacgccgcttccgctggcgtgctctgccggatgggcgtcgacccattcctccagacctgattcccgctcaccaccccatcccacccctcacccctccaggcacggcacaggacggctcggtgttcgtggagcgactgaagcgcctgtacggcgccgacctgacctttgccgacgcgtacgccgtctcaggccgcatcctgaacgtgtcggtgtgcgcggccgacacgcgcgagcccccccgtgtgctcaactacctgtcggcgcccagcgtgctggtctggagcgcggtggcctgctcctccgccttcccctggctcttcgcgccgcgcgagctgctggcccgcgacccacacggcgccaccgtccccctgggcgcggtggggggcgggggcggcgcggcgctgccgcgccgctggcgcgacggcagcctggagctggacctgcccatgcgcgagctgggcgagaccttcaacgtcaactactccatcgtcagccaggccaacccctggctgctgccggtgatcgccgcgcagcgcctgctccccgccggcctcggccgcgcgctggagaccgagttcaagcaccgctgcggccaggcgctgaccttcttcccccgctcccccctgctgaaaatggtgggccagccctggggcgggcacgtcacgctggccatgcccgccgccgcctttggtgcgggccaggccgcgcgcaacctcagccctgccgacatcgcgcgcgcggtgagggagggccagctccgcgcatggcgtgcgctgccggtcatgcatgccgcctgcgccgtggaggccgccatcgacgccgcgctggcgcagctgctcgcgcccagcgattcgcgggacggcgccgccacggcgcagcaccccctgccacgcaagatcccgcgcgcctcgctgccctcctggctgcacctccccgcgctgggcctgccgtcctccgcctcgctggagcatgagctgggcgcgcacgggtccctggccgcctccttggcctcgttagatgaggaggcgggggaggcgggcgggtcgccgctcgcagacgcggcgcccgacgctccgatgtcctatgcggcgggggatgtggccgccgcggagcacgtctggcgcgacctggcggagctctccacgcgctcccactccgcgctggactgcatcgcgccctgacgcgagcaggacagggcgcctgaatggcaggcaggcctgcacagatattcttgcgggcacatcggtgccccagtctaccagcatcttccctctgttgtattacaagcactgggcacgggcatgtcctccctgggataggtttgattgtactcgtcgacggtatgcaagggacatgatacagggccaagaccagggtctacgttcagcagcagcctcgatggccgccgtcgccacatccgaacctggggccagtggtgcgacgcaggctgagtggcccagcgcgagcggtgcgcccgtgccacgcctgtgtccagcctccacatggcggagtccctccatgtactaaagagaggaggctcctctccaccccctttgcccgnnnnnnnnnntcatggcggactccctccatgtaccaaagggaggaggctcctctccaccccctttgcccgctcagtggatgcggacgggaacggcggtggagtgctgcagggtggggtgcgcctccagcgccgcctccatgttgccgttggaccagtactccggctgcccgtgctccaggaaccagtcgatggtgcgcttcaggccctccttccagtccaccgtctcgctccagcccaagtccagcagcttcttgtcgcagatgaagtagcggcggtcgttgaaggcgcggtcgcgaacatgaacgatggagttggcgggcaagccaaagtgcttggcgatgtcggttgccacatccacgacggtgcgctccttctgcgtgccgatgttgtacgtctcgccgacctgaggatatggtggagggaggttgtgatacttgggctgagggaggtggggcagtaggaaatttcccaaaggaagatttcattcctgaggtgtggtcaagcactttgagaatcagtgttggccccagcggataccggaatatatactggcatggtggatcataataacaatgcaagtgttgtagctgagctgagctcatgcaccaaaaagggaaccacgcactcgcaaaccaccctttgaaacatcagcacatgtctctactagggtccaggtggtggtcggcaggcacataccactgagacggcgctcccacccatccttcccacaacgcaccgtgcccttcagcatgacnnnnnnnnnnggtaggaaattttcccaaaggaagatttgatttctgaggtgtggtcaagcactttgagaatcagtgttggccccagcggataccgaaaagtatattggcatggtggatcataataacaatgcagtgtgttgtagccgagctgagctcatgcaccgaaaggggaaccacgcactcgcaaagcaccccttattaaacatcagcacatgtccctacttgggtccaggtggtggtcggcaggcacatgaccactgagacggtgctcccacgcacccacccacaacgcaccgtgcccttcagcatgacgatgatgtaggcctccgcgacgtcctccacgtacaggtaggaccgcaccgacatgccgtcgccgtggatgggcagtttctcgccacgctgagccctcagaatgaacttggggatcatcttctccgggaactgcagatcacagtggggaataaaatggtgttgtgcagatgccggtagcgaagcggcccatgagcccaggcgcccttgggcaggcaggccacatacgccctccctcccaaaaagtaaaaagacgcctgctagaccaataagaacgcacctggtggggcccgtacacgttgtttccccgagtgacgatgacgggaagcttgtaggaggtgtggtaagcgcgcgccatcatctcggcaccggccttggccgccgagtaggggttggtgggctccagggcagaggcctcgctcaggccctcggccttccccagcgaggtctcgccgtagacctcatcggtagagacgttgaggaagcggcggatcttgccgtacaggcgggcggactcgagcaggacatgggtgccatagctgccaaagcatgagggagagggtgctgattgtgagcacaggctttgtgcgtacaggggagcatgcatcacgtcaccatatccattcctgcacacacgcttgccaccccagcnnnnnnnnnnactgtgggtacaggggagcatgcatcacgtcaccaccttcattcctgcacacacgcttgccaccccagcatacgtgttgttcatggtgaacgccaggctgttcccgaaggagttgtccacatgggtctgggcggcaaagtgcatgacggtgtcgnnnnnnnnnnctcctcggtctccagaatgtgcacgatcaggtccgtggactggatctctcccttcacgaacttgaagttggggcagtcccggatggacttcaagttctccagcgtcgcgcagtagtcgagcttgtccaggacaaccacctgtggggcgaatagatgcggaggggtggttggaggggccccaccgatgctaacgccgacatgctggcatataagtttgatcattgggcataagcatgaacatgtgcattgcttgtagaggtgttgggcgatgcggaggcccaatatgccgggccccccacgcagatctgggttgcccaaagctctggacatgccgctataccttgacatgagggtagcgctttacgagcttgatggttacatgactggcaataaacccagctccgccggtgatgaggatgctgcgcgggacgtactcctcgacggccatggccaccaactgccccgtggaagcagtgcttgcgtcactgggaggtggagcgctgcactttaatgcaagatctcgatgctatgtgatgaatataagggcagaacacaagagatcactgtgaggattacccgcacgtctccagcccaagtcggttcgcgtcgggaggttgggacgggtttcctcgaccccggacagggcccccagcccctgtccnnnnnnnnnnaatgaatgtaaggacagaacacaagagatcactgtgaagattacccgcacgtctccagcctaagtcggttcgcgttgggaggttgggacgggtttccttgaccccggacagggcccccagcccctgtcccggtgttcagaaaggtcactacaggactagcagcgtcccgcgcaatcagtgcgcggcaagaggaaacagatgcagtcgacaaaggcatatgaaacagagaggaacgcaaggcattctcagtagcgtccaccatagccaccaccgccgccaccaaacctgcagttcagcacgggaggcgagtggttcaaaggcatggcgcccgcacagcagaacagcgcagtgaacaaggcaatcgctggatgtcaggacagtggctgctcaggaaacagcccaggctgccgcggtgacaccctcatcagtatcgcccccccaaaagtgcccaggccgtgcgccctccccacatccgactcacccgccgtagccgcccccgcggccgccacccacagggagcatgtttgccccagtgcggccgccgcccccgaacccgccgccgccgccgccgcggccgccgcgccctctgaaggagctgggccccccgctggtcatggcaaactgcctgagctcgggaggcaccacctgccccgcctcctccaggatgcccaccagctgccgggccatgcgcccattgttggccgtgaagaagctgtgcgcgcgcccgtccgcgcccgcgcgccccgtccggccaatgcggtggacgtagtcctccgcgctgccgggcatgtcgtagttcaccaccagcttgatgtccttgacgtctgcaggtcagttcagggaagggggaagggagggggcgagacccacccagaagggggcaccggtgagcaagggtggtgggggggggcagggtcactgggcatgcatcgtgagggtagctgataggacgctagagacacggtaagccggagtgcacaggggagggccgggctgggcaggccacaggcgggcggcgcggagcatgcagggcgagccaggcgaggccgggcgtggcctgcaggcggcaggcggcccgtgatgacaaccacggaggcctgcgccatgctgccactcccccagagcggggttcctccccgctcggcccggtcagaggggccgagcaggcctcccgcatgttgggagggcgtgcggtcagagaccctnnnnnnnnnnatccacttccccagagcggggttcctccccactcggcccggtcagaggggccgagcgggcctcccgtatgttgggagggcgtgcggtcagagaccctggggcccgggtagggggcccggatgggttccctcacgtcgcagcaaggacttcaggggtgggggttgcaggtgctgctcgacgcgcgcacaagcagggctgccgagcatgcaccaaaccgcccagcgctgacagcaccgtcgcgtgtgcggcttggtgagccacccctctttgaccgcctcgcgccggctgtggcactcgctccgcgctcgtctgcccacggtcctccgcatgcacaccggcgccatgcatcaacttccccaaagcccgcaagggctggcacacgcacgggcagtggcccagagcgagctcgggcgcatgtgccaagcacgttggcacggcacgcaaggccaaggcgccgtgcatgacccgtaccacgccaggcatgcggttgcagcaccnnnnnnnnnncgccaagcacgttggcacggcatgcaaggccaaggcgccctacatgacctgtaccacgccaggcatgcggttgcagcaccggcatacagcaagggccggctcctacagccgcagccgcaccccgccagcgtacggggtcggtgcatgcgtatacactccgccctgcctctcccaaccaccccccctgcttcctcacccaggcctcgcgccgcaacgtcggtggcgagcatgatggggtgcttgccattcttgaactcggcaagcacccagtcgcgctcctgctgcgtcttgtctccgtggatggagagggcggggaacccgtcctggcgcagctggcgcgtgaccgcgtcgcagccgcgcttggtctcgcagaagacgatgacgcggcggccgtccatctcgcgctccagcaggcgtagcaggcgcggcagcttctcgtgctctgacacgaagtcgaaggcctgctcgatcttgtggttggccttgaggtcgctggacccaatggtcacctggtagggcttggtcaggaactcggaggccagggcctggatctccttgggccaggtggcggaccagagcagggtctggcggtcgggccggatctggccgagaatcttcctgatctggggctcgaaccccatgtccagcatgcggtccgcctcgtccagcaccaggtaggtcacgcggcgcaggttagtggtccgcccctccaggaagtcgatgaggcggccgggggtggcaatcacgatctccaccccgcgccgcaggtcattgccctgtgggcccttgggcgcgccgccgtacacgcaggtgctcttgatgcgcgaggagctgccgaacttgaggcactcgctctggatctgcaccgccagctcacgcgtgggcgccagtgccagcacaatggggccgtcgccgggggacaggtggggctgcgcgttgatgtgcaccaccgcggggagcaggtaggccagggtcttgcccgaccccgtctccgcgatgccaatcaggtcgcggcccagcagcgccatgggccagccctgggcctggatgggggtgggctccttgaacccggccttggccacctcgtgcaacacgtactcggggaaggaggcctcctcgaaggtggtcacaggcttgggcacgccctcgccgccgacgtggatgtcgcgctccgcgcggtaacgctccacctcgccgtcgctgcgcgccgtcacgtcggggtgctcgtagtagaagttcttctccagggcggggacgtcccggaagtcctgctggggcagggaggtgaagttgatgtcgtcccggccacggcccccgccgaagccacccccgccgaagccaccgcctccgccgtagccaccgccaccgccgtagccaccgccaccaccgtagccaccgccgccgtagctggaccccccggcgtagcgactggaggagtcgtcgtatctgggagcgagcgcggggtagggcggggtgatcatttggggcggggcagagggttatgccccaaattctgcatcccgctgccttggtgacaccaaacaggtgctctcacaaagctctcacctggagctaccaccgtatccaccagaggagcggtagggtgaccgcgagcgctccnnnnnnnnnnggggcggggcgatcatttggtgccgggcagatggtaatgccccaaatgctgcatcccgctgtcctggtgacaccaaacagatgctctcacaaagccctcacctggagctaccaccgtatccaccggaggagcggtagggtgaccgcgagcgctccctgtaggccatggctggtacctctacctgtaaactgggctcctttatggttttgcgtcggttcaattactctcgccggcaagtaatgctgaaatatttgtgtcatgccggtgcgactgtcagttttctggactggagcagggcgctgaagcgggagcaatattcggcgggaagcgcatcagggtggatggattggttctcccctgcagcatcgagcattggtccaaagcgcaggccggaggactgcgatcatgcgcttgtacacatccttgagcatgcattgccaagtatagagtgcgctcaaaggggtgtttaggaagcccgatccagcttgttgcgcaactctcctcttccgacatggtggtctcggtcgctcctgtgcgccctgtggcgatgtctcctgactgcagagcctggagcgcttttactgtgcgtggcccttcacgcatgccttgccacactctatctcctggatacactgctcggaacactgctgtccgggccggtgggggtaggtctgtgaaaaggcaggagcaggtaaacgtgcctgacgccccaccagctccctcgacacctgggaggtccatggacacagctgacacagagacatcagacagggtaagtggactgccctgtggcactgtggtctgcatgggcaacagctatgaattcttaaaaatgtgatcctggaatgccaccggctctcaatgccacatcccctgcaggggcaagaagagaaagctgagactttcacgacttctcaaggtccagcagcagctgtcaagaccagcccgacctcaaacatcgtcctggtgcggtgatgcaatcgggtgcagttaccatcattcatgagggatgcactgctgtagatcaacctcgcgacttttcaaggcccccggtcatatagccagcatcatgtgagagcagtgagaagttgccaaccccgcctgaggtgcgtttattctcctgccacgacagggagcgctggaagaggtgcagctcatacagtggccaaccataccccaggcccttgtcaacacggtccaggtcctcatcattgtggggacgacgtctgtgctcttgtttgcagtgaactcgatcttgacggaactgtcacggagagcctatggatagcagcttgacaagtgcttgaagatgaagctgacggccgcctgttatttgattcaacttcactggaacctgggcagtagcacaagcgaatcacagctacagtcgtgggtcgttttgttgctagagttgagtcccagaaaattgtaagccgtgcaatcagtaacctgcaaagtnnnnnnnnnncttaattgatttaacttcactggaacctgcgcagtagcacaagcgaatcacagctgcagtcgtgggtcgttttgttgctagaattgagtcccagaaaatggtaagccgtgcaatcagtaacctgcaaagtctgcgcagtacagtcgccccatcgggatggcaactccacgagtagcttcgtgggaggagccatgcacctaggacagcagccggctatgaacgttgagcctgatggcgaccatgagcacgacgaacactgtattcccaaagacgtatcaagtgataaaatcaacatccggcaacttccagaacagatcggtgcgcggcaccactttacttagtttagcaggtcacgacgacgcgtgtcggcaggattacgacgcgtccggatcggaccactttggagagaaccgaaggctccctcggcatgtcccaatccttccataaccatcaggattttggcaccccgaatgtcgaggctggagaannnnnnnnnnctccttccacaaccaacaggaatttggcaccccgaatgtcgaggctggagaacccagggtgacaaccatgtttcgcatctcctccagggatgtccggccagctacggaaccctcgcccaacgttggacctgatgccgtctatgcgaaaaccagcccgcccagagtcaccgtgaaccgcatagtagaacccaaggatggagcggagaggagcaacatctccagcacgggttggaatagcaatggcgagagtccccgggcctctggggtgagtctcagcaagccctcccgcctcatgcgcaagctgcacgtctacagagaggagttccacgtcggaaatgatgaggtgcgtccctaaaaccaaaacgtggggcctgcagagagctgactggggtgcagaaccgggacggagagctggcagggcagggcggcacaaggcaagacctaacaacactggatgactcccaggccctgtgcatccttaagaccctgtgcaccatcccagtccctcgacctcccgttccgtaatgcagctgttcctcgaagactacctgtgtgctgtccagaagaagaccctgaagcagggacgcatgtatatttttgacaagcacatcggcttccatgcaaacatttttggtcaccacaagtactacagcatccccatcaaggtccgtgctgctcctcaagggattggagaggagaggagactcgtccaagtggacgtcatcctattcattcgatactgaagcactcggctcctcccttcccgccctcgcccctcatccttgtcaacacatcccaacatccatgcaggacatcaccaaggttacaaaggagtccaacgtgggcttcccaaactccgtaaagatatgctggggacacacccactcccttttcttcaccagtttcctgaaccgcgaggatgcatacaagtaagctccttgcaggtagagttgtcattccacacaccttgccaccgacttccaatggagttccagctcacactccccgacgcccacccctgcaggctgatcatgcacctttggcgccagctcagcagcagagctcccagcgaagcgggatcgcccgaggggagtgaggacgaggccctgaccagtataacaaagccggtgaagaagctgctctgcagcgtcggcttgagcaggagctctgcgaccagccagggtggaggtatgttggtgcgagcaggtcacttaatgctgatggggaatggcctcgtcaggatgagcggcaataggaggccatggatgcattgtccannnnnnnnnncgtgaccagccagggtggaggtgtgttggtgcgagcaggtcactttatgctgatggggaatgagcctcgtcaggatgagaggcaataggaggccatggatgcattgtccatttggcagctgaatacgacgctgacacagacagtattgaccgcctgactgcgccacttttctaccagccaggcggcgcccaccctgcaatggatttctgactggcaggttgacctgaccctttgcaagacccgaatcccggcttgagagccatttgtcctcgccacattcgcaggcaagtcagagagatccccaatcagggaggacagcagtggcgattcagacagcgactcctcggggagcagcgatgacgagtcctctgttgccgagggcggggatcccaaggtgggcaaagtccttggtgtgtagaggtctcccctgtgaacgcgagctgcctgctgttgcggcggtgagacctcaccacatcctcccttctttcctccacaggcggagagcctggacgttgccagggctgatgaggaggccccgagcgtgcaagacgatgccaagccatccctggtgagcctggcagggggaatgtgggtttggtgcatggaggaaaggatggagttggagatgggctcctgagatcctgcacccgcctcaaatacctctttccccaacttctccctcggtgcaggagtatactgtgccctgctcgccgcaggtgttctggacaaagttcctgggaaacaactccagctacttcaaggacttccatgagtctcgtggtgactcctctgtcaagctcacaaagtggaagaagcactccaaggtgctgacacgggagcaggccctggggagtacagggtttgctctgtggctttgcatggacctcgtggcatgaggacccctgcccacagagggtgcagcaggcatcgacctgccggcagtgcttgcgcttccgtaggtcctcttgaacacggagtggctctcggccacctcgtctccaccggcgagcctgtccaggcttgacccgcaccacacctccttgcatccgtagggcggcgtggtcagggatctgcagttcgtgacgccggtcaagatgaagatgggtccagacacgactctctgcaaccaaacgcagcgtttcacggtgagccatgatgcaccaccgccacagcatgcagagccgctgtagaaggagaatgtgcgggccatgtgccgctgcatcccgggggaggnnnnnnnnnnagtgagccatgatgcaccacggccactgcatgcagagccgctgttgaaggagaaagtgtgggccatgtgccgctgcatcccgggggagggcccttgtctcccttggcaccccctcctgcacacacctcactccgtcgtccctgctctgctccctctcccatcaggcatacagggatgaccatctggtgtttgagaccacccagaccatgaacgacatcccctacagcgaccactttacggtgagaagggaggacgctggggagacgtgctgtgcgcaacagcttgcattgttgtctgtgtcacccttctgctgtgatgaacatctcatccctgccaaagaactgcgttcatcatctgccgtgaccatccctcacccgtcaggtggactcgcggtgggatgtgacttcctccgaagatgacacgtgcaccgtgaggatctacatttttgttccattcagcaaggtgtgcaagcacatgggtgggtggtggatgtcgatttttggcaaagtccagatggcgacccaaatattatccttactttgaaatcgtgcacagctcgcttgatgcccttggcttccctcttcatcatttgcagaaaaccatgtggaggagtttcatcgaaaagggagtgaaggagggatgtctcacgtccttcaccgcatggagagacatggtgaggtgtggggtgtagcttcagtggggagctcttggtgtcgtgacgtcctgcctcgccgtttgggaaaccctgaatgttaccaaggactgcatgggtcccagcattttcactggagtggttctgcaacatcctctctccatctccgcacaggccaaggacgtcttggccggcaagaagggcacccccgcaccaaagacccaaaagtcgaggagtggcggagggggtggggtgagtgacagtgccgggacccgtcccaacaccgatggggctgaaataggcccaagctcacgaaccctgggcgcagcatcgggtctgctgtcnnnnnnnnnnaagtggcggggggggtggggtgagtgacagtgccgggatccgtcccaacaccgatggggctgaaacaggcccgagctcaccaaccctgggcgcagcatcgggtctgctgtccggcagcctggtcaacactgccttgctggcggccctggtagtcctgcagctgctgatcctgtggcatctgcgcagctcgacagcagaccctcgatctgagattggggctgaaggcctgcgtcctgtgctgagggagctgatcctggagctgaaggagatgcggttgcaggacacaggagccggaacgacggttgttctcggcagagcggcctgaatagccgcaccggggtgctgtgggcggagtcgccaacaagagctcattccttgtgaataaggcaccctatgacccnnnnnnnnnncgctactgtgggcggagtcgccatcaagagcttattccttgtgaataaggcaccctatgacccctgttactaatcgttttgtacacttccactcttttggcgccggccattgtaattttggaccaagagcagaaccaggcagccagcttttggactcttccgcctgctcagcgccgattttctttccttgtcacttgcctgggcgacacgacaagaggacactgcgccccacgacagcaagcaagaggaaagtgtctacacaaaatatattagtaagcacgtccttcatatgttgcatagattgcacnnnnnnnnnncgtcacttgcctgggcgacacgacgagaggacactgcgccccacgacagcaggcaaggggaacgtgtctacacaaaacatattagtaaacacgtccttcatatgttgcatagattgcaccacttcgaaccccgtcacattcttggcacgcagcccagtcttaccccatggcctgcctggttcgccagtggaagcggtggggcgggttgcagcatcaactagtctcactcacagcccagagcttacaaggtgaggtgaagcttggaagacgttgcggtactaaggccgggagcgtgctcgggtcggcatcgctcgactcagtggcgccggtcacctaaataagtgcctcctccctgtacacagagacctgcggcgggcagggcgctgtcgctgggtcagcactgcagctgcagcagctgaggtgggcttccaagaagcaggggggctccacacagaacaacaagggacagaacccacagaacctgggcatcaagatgtacggaggccagcgatgcatccccgggaacataattgtgcggcagcggggcaccgagtttcatcccggagcaaatgtcggcatggtatgtctcagtgggacgttgggggcaaggggttctgtaaacggaggggtggccctgccaccccacagggagctggattcttgagccccggtgtggattggccccttccaactccataactcacttcccccccccccccccggccccccccccccgnnnnnnnnnncacagggagctggattcctgagccccggtgtggactggccccttccaactccattactcgctcccccccccgccccctgggcctcccgaccacagggcaaggaccacaccctttttgctttgatccccggcaacatccagttcagcttcgacaagcgacgaaaacggagaatggtggccatcctgcctccagagacggcgagtgccagcgtctcagcaaccgcctgacacatgtagttggtatgcaccgctgtgctgatgtttgcagctctgtgcaaggcagttgctctgacagtaccaagtgctcaacaacaaaaaatatgataggaggaagaaaatggatagggaggctttgtcccaaacacatatcaggactcagcgccgacaagtcagggcctgatgaaggactagtcatgccgccgggatggtcgcgccctctgtgcggtgcacccccgcctgccgctcagccttttcttcgacgccgctggccagccgcctgcgctctgcctcgaccatgaggcgcgtcaggcgccggtccgcgccgcccagcgctgcgcgcttggcctccagcgatcgccccgcggtctccacggcggcctgcgccacccaagtctcgccctccagcgtctccagccagccggcgatgctgtcgcagcgcgccctcagctcggctagcacaccctcctgcagcggggtcagcaggaggggnnnnnnnnnntatgatacgaggaagaaatggacagggaagctttgtctcaaaacacagatcaggactcagcgccgacaactcagggcctgatgaaggagcagtcatgccgccgggatggtcgtgccctctgtgccgtgcaaccccgcctgccgctcagccttttcttcgacnnnnnnnnnngggtctgctgggcatgggtgcccggcggcttgtctgggcgccatcatgcacagtcagggtcagggagggagggatgcgaccgnnnnnnnnnnaggtctgctgggcatgggtgcccggcgccttgtcggggcgccatcatgcacggtcagggtcagggagggagggatgcgaccgcagtctcgctcccgccgcaggcatggttgcatggaagtcctggcgccgtcaagcccacaaatcccattccctgtttccaaacacacactgaccctggtggccttgagctcggagaccttggccagctgcagctccagtgctgccagcagagcgccctcgccggccgcgtcttctcccgcacgctcggcgccgggcccctccaaatacacctcgcacgccacggtgtggcggcgcannnnnnnnnntgcgccctcgtcggccgcgccttctcccgcgcgctcggcgccgggcccctctaaacacacctcgcacgccacggtgtggcggcgcagcagctgcacgctggcttccagcgcgcgccggggcgccgccccgccgccgtcccgctcgccgaagcagagcgcgcggggctgcacgccctcgaccgtgctttcctccccgccccgcggcgccccgcgggccagcgcccag

SEQ ID NO: 33916 - DNA, 61 bp, Chlorella protothecoides
catatttatattcagtccagtcgcgtgaagagcgtattcccacatggtgatggagtgcagg

SEQ ID NO: 33917 - DNA, 6112 bp, Chlorella protothecoides
  modified_base (1425)..(1460): a, c, t, g, unknown or other
  modified_base (1876)..(1885): a, c, t, g, unknown or other
  modified_base (2140)..(2149): a, c, t, g, unknown or other
  modified_base (2514)..(2523): a, c, t, g, unknown or other
  modified_base (3314)..(3323): a, c, t, g, unknown or other
  modified_base (3936)..(3945): a, c, t, g, unknown or other
  modified_base (5563)..(5572): a, c, t, g, unknown or other
  modified_base (5769)..(5778): a, c, t, g, unknown or other
cccccccccccccccccccccccccgcccaaatcctcactcaattcctcccccggccggccatccccccgcacagaccagctagtaatgaagacacggtcaaggaggcgggatgatcggttctggtcgtccccgttccactgcaccacccgtgtgggcctggaggctgccaacgacctgctgcccgatgggggctgcagcgtcccggtacgccccgcccgtgacacgagacccctagaagccgcagctgaggcacacagccttccagtccccaggttgcgggtcgagggtccgggttttcccgctgcgcacacctcgagcgggttcgggtggccggacaacgaactgcagcggtgctcctcctgggtgagtccggtgccctgactcggctcgagaggtgctttgacagcgatggagtgccaccgtactgttggacctcgtgtcatggtgcggtgtgtgccctcattggggacgcctctcgcctgccaggccccagggctcctccctgccagcctggcctgagcgtccccgccccccccgccccgccccgccgcgcagggcatgcccaaccaatccgccagtgccctgcgcctccccagtctcccctccatggatgcggacggcatcgccaccctgcccgaccccaaggagctggagcagtggctgacggccaccgcccagggggccaagcagggtgccccgccccccgcccagccggcgcaccaggtggcgaccccggggcgggggcctgtaccctcgcgcgaccccggtgcgagcggcacccccaaacccccgcacatcgtgggcgtggacgtgcaggcgacgccccccggctcgcaggccgctgtgtgggccgcggtgcaggtccccggcccagggggcagcccccgcgtgttctccggcgtgcccctcaaggccagccagctcgtggcggtgtccagcggctcggccctcagcgcagacagcgcgccgctggccgccggctggcaggtgcccccggcgcaggcccagcccagcgtggagagcgtggcgacggccgggcgaggcggcgaggccgccgtcccgcagtggcactccttcagcggcgtcccggacagggccgttaaaggccccccgtcccgcgcctggcactccttcagcgcgcggggggcggccgccgcgccactgccggcacggccgctggcctcgcaggcccctgtcctctcccacccccgcttcaggttcgtggtcgacccctcccagtgagcggctgggtgtaccacatgtgccagcagcccagcacatagcatagaagcttgacggttgagagacgcgtcccgacaggccaaaccctctgagactccccgtcggccaaccgactgtgcacgcggcacccttgctatcccaacgcctcaacccccccccccccccccgcggcgccgggggnnnnnnnnnnnnnnnnnnnnnnnnnnnnnnnnnnnngctgcgggcgtgcatgctgccatgccaggatcccccagccctggcagacactctctttgctctggctcacgcgcgagcaacacgcgtctcgatgacgtgcttagcttttgccatacctcacattcttgattcatcccctcaacccactcatagagccttgcctgtgggactgccatcggcactccaccttcagaaagtcctcagttgagcgacaccttgtcaccgtcgtgcctgcttgcatcccactgttgagtcagcgcgtgtccccaatctgtcctggggagccctgtctgccacgttgtatgccgctagtactgcaaacacccctgtagcctcgaaacgtgaaggtatcgggtgactggaggtgtgccccaggcagcatgctaaggatgagaggtgtacacagctcggggggnnnnnnnnnnaaggaggtatcgggtgactggagatgtgccccaggcagcatgccaaggatgagaggtgtacacagctcgggggggcagaactaagatacaaaaggaaggggtaaaaacatttggtcttagtcgccagatatggtttgctttgcagtgtacagggtctgcacaggccagacgcaaccggggccaaaccaataccaggcagcacaaaaatcgagcccccacttgcgctcggaaccccttggagcatcacagctggannnnnnnnnngagactaagatacaaaaggaaggggtaaaaacaattgttcttagtcgcaagatatggttgggtttgcaatgtacagggtctgcacagtccagacgcaaccggggccaaaccaaaaccaggcagcacacaatcgagcccccacttgcactcggaaccccttggagcatcacagctggacaccaaagtagtcctggggggtgatctggcgagggccgccataccaggccagtagctggatctgctgaatgaagagctcgtacctgcattgtcgggtgtgctcacattgagtgcatattctctgatctctcggctacccaggattgaagaagcggatgggcctccgcacatgtcgcaggctgcgcacnnnnnnnnnngatgaagagctcgtacctgcattgtcaggtgtgctcacattgagtgcatattctttgatctctcagctacccaggattgaaggagcggacgggcctccgcacatgtcgcaggctgcgcacattgcatggccggtctgccatacatcgcactcacatgtgaaattcgtggccagcaggccaatcctgcatggctgggtgcctgggaaagagaaggtcctgcggcacaggttttggggataccattccttcttcaaatagtccaggggagcgccacacaggcaaagctgcgaatgtgcacccaggcaacccaagttcactctcgaactcccaacaacaggatgaggcactggtcacagcaagacgccctgctcctcagaaacctcacccgtgcagctccctcctcggacgcaggtacacggtgaagctcccccaagatggagatcttggcgcaaggggggtcctccgcatccagcccacggcagctgcccggcagctgcgcctcggacaccgtcagcatggccgaagcgttggcttgcgcgtcatatgctgttgcatccagggtggtgagatagaacagcaggcgccctgtcgagttgcccctcgggccatcggcatacgacaccacattcctgtgcagggagatggatgggtttggagggtgggcccgctgcagatgctcgacggaacccattgtggcagaccctgagggccattttggatgaacaggtctgcaggatggatcatgcgcagattcaaccgtggaattcaactggggcgaatggctcatgccnnnnnnnnnnttttgcaggatggagcatgcgcagattcaaccggggaattcaactggggcgaatggctcatgcctgtgcaccacccaacgcccggtctcacccaaacggagctccattcaaatgccgacttaacgtcgacacaacaccccagtctgcctcgtggatcaaccaacgcgccaggcgattgatgtcggaatgatctggcctgtatgtgatggatatatcattatcagcgttggcccgaaaggcgatcgcattctatgctgacatgtagtcatgctgaccagagcggaccccggtaccttggagacacattcggcatcctccgaggtgtaactttcgtagctaccggccctcccgcggccatcagtcccagcactataacaaagacgaggcatgtgagggtgaggcaacgcgatgcgcgatcggaccacgagggtttgtccgctgtgctgttgggagcctctgccactccagggagaggctggtacatgccatgagatgcagcagccttctgattcatcttgaatataacatttcgaatgggtgtgtaacggatttaaggtagtcacttgacaggccatggaaaaatggcgcagggcgtgtgcccgacactgtccannnnnnnnnnccatgtcgaatgggtgtgtaacggatttaagggagtcacttgacaggccatggaaaactggcgcagggcgtgtgcccgacactgtccaaaagaccaccactcccgccagcgcgcttccatatgctatgtcgagagcgagactagacacatagtcctccagcctggccaggaatggactggtgcatagaattacatggcaagatgaacaaggacaagatactgaagctcgcaaagggcttccgcggcaggagcaagaactgtatacgggtagctagggagcgtgtggagaagagcctgcagtatgccttccgggacaggaaggccaagaagagggacatgcgcgctctctggatccagcaaataaacgctggtgcccgacaatatggggtgcgtggggacgaggagggtgcatggggtgagctcggttttctcaagcatactgcactccagccttatgcctttgggcaggagccgactcagactccggctggagcactgactggatgagattgtttgattccttgtgtgtgagtaatcattgcccgaaagcacccgtatttccttgaacccttccaccaggtcaagtattcctcgctcatcagcgggctggctgctcagaacgtgggcctgaaccgcaagatgctgtccgagcttgccaggacggagcccttctccttcaaggccctggtggaccaggtggctcacatgcggggcctgtctgcccctcatgccggcgccgcacttaagtgacggctgtgcggccgtcatgccaccctcgtgaggggcgtgctgcccgtgtgtcgtattgaatacacggtcgaggcgcgcggcgctgcagttcgcccgtctcttcacacctcgccctccaggttcctatttattctgttgcaatgcgcacttacagcatggcggcttggccatgggccatggttggggagcagtggccaggccagaggatggctggcaggactcggcactggaacaagggctggtaccccaaggttggaatctacagagggggtgggaatcgttatagggacgggcagaggctctgggttccaggacaaagaggtgccagcggtgcccgctagctgtggcggagggacgcccacggcgctcggcagggagggcgccccagccgggattcacttgcagcaggtttcatagctcgctcatcagccctcgtgggaggtcgggtagtacatgcccgccgctcccccgccccgcgccgcgccgcctggggtgcccgccctgcctcccagccggctggggctggggctgcccctcccctcggccgcgtccacctccgccagcatggccttgaagctccagcgccccgacgccgctgccctgcccgccatctcccccggcaggccctccagtgtgaccagggccgcgcgcagcgcgcgcagcgcgctcaggcaccccgaccgcttggccgccacgtcctcccgctcggtcatcagctcctcgaacagctcctccctgggtgttggtttcattttgtggagggtggtggttgttggtgtggggatcatgcacgttcagaatagagttgcggtgggccctggagagacgcaagcatcacctggctcacatggttgccttccaggaaccnnnnnnnnnnagtttttttgtggagggtggtggaggttggtgtgaggatcatgcaggttcagaatagagttgcggtgggccatggagagacgcaagcatcgcctggctcacatggttgccttccaggaacctccctgagcgcccccccccccagttaacccccttgttcacatgatcccttcctccagaatgaagagagcagaacannnnnnnnnnaagttcccccctgttcacatgaccccttcctccagaatgaagagagcagaacacaaggtcccctcgccgccctcaccgatacagggtgtgaatgaggtgctgctgcaggccgcgctgcaggttgttgaccaggaacagcatgagcgccttgggcaccaggtcctgcatgttgcgccgcacgatgttgaagtaggaggcgaccaggaggcgcgtgacgtccacctgcaccgcctcctggtccgacatggcggccggcacgcgcagcgtggccggcgggcgcgccaggccgccaccctcgtacgcgccggtgccggggaccgggctcgcgcccggc

SEQ ID NO: 33918 - DNA, 61 bp, Chlorella protothecoides
cgggaagcggggtcgtgagccattgggaggtggggaggggggcacccagtctctccgttcc

SEQ ID NO: 33919 - DNA, 109 bp, Chlorella protothecoides
cccacaccatgctctggccgaatccctgcttggcgaatgcgtgacttggcatacttgacacaccatgcaacgttcgtgggacctcgagctgtggcaatgactccagggc

SEQ ID NO: 33920 - DNA, 88 bp, Chlorella protothecoides
accttggcggctggagatacagccgcgcatcacgctgggcgggctgatgcgggtgtcagcaagactttgccgctggagcgcccacacc

SEQ ID NO: 33921 - DNA, 68 bp, Chlorella protothecoides
ctcatgctcatagtggaggagcacatgcggacgagcgctgggcctggagactcggaggctggggcggc

SEQ ID NO: 33922 - DNA, 115 bp, Chlorella protothecoides
tgtcagacttgtgccccttgaaagtgctcccgaagatgcctgtcagtgacaccaccatggcctgtactgtcagaaaccatgcccttgctctctccctcaaaccactacagatctc

SEQ ID NO: 33923 - DNA, 92 bp, Chlorella protothecoides
gagcatggagctgcgcagctctggcgcccatggggtgaaaagctcgagaacaacctggttgtgcatggaatgcttgctccgtgtcttgcaag

SEQ ID NO: 33924 - DNA, 62 bp, Chlorella protothecoides
tttgagggaaccaagtgcacatgtgcattggccatgtgcattggccagagtgcattggcacg

SEQ ID NO: 33925 - DNA, 75 bp, Chlorella protothecoides
tccttcttggcggccgcacgggccttggagcgcaccgtcgtggaaagcacggcggttgggacctgtgagggggtg

SEQ ID NO: 33926 - DNA, 63 bp, Chlorella protothecoides
cgccgctttaccacaccaccctacaacaacaagctgatgtccttggccgtgatgtggtagtcc

SEQ ID NO: 33927 - DNA, 115 bp, Chlorella protothecoides
gattttattcatggcgtggagggaaagggctgcagagcttgtcgatgggaggttgcttgagggtgggcggcatgtgtggaggatcacatgcctgagagatccaggcgtggcgtgc

SEQ ID NO: 33928 - DNA, 107 bp, Chlorella protothecoides
cggcgagcagcctgttggttgacattcgggtaggagcgaggagctgagctgacaagaagggcaagcctctgtcagatatacaagtgttttgtgtgtcattcctgagc

SEQ ID NO: 33929 - DNA, 61 bp, Chlorella protothecoides
aaagctgtagcacttgggcttcgtggcgggagctgaatggctacatggagtgctgacgtga

SEQ ID NO: 33930 - DNA, 78 bp, Chlorella protothecoides
gtgagatgagggagtgggttgggctgagattccgcagctctcatagactgggcaagaaggcgtttgcaaaggatgcac

SEQ ID NO: 33931 - DNA, 71 bp, Chlorella protothecoides
ccccggcggccacatgggcagggagatccatgccgcattgtgtggcgccctcggtcgcccggaccgctgga

SEQ ID NO: 33932 - DNA, 61 bp, Chlorella protothecoides
accatggcctcgacagtgacaccctgcgggttggtttgtggaactatgggtgcggggtttc

SEQ ID NO: 33933 - DNA, 120 bp, Chlorella protothecoides
tccttgagatgcctgatgggggtggtggggttggggatacgccttcgggggggagcgcgccctgattcctctgaccccaaaccccaaaatcccttacgcacagcttctggacggccaccg

SEQ ID NO: 33934 - DNA, 166 bp, Chlorella protothecoides
tgggcggagggcaaggagggtgtgaggcagtcgggaatggccggtctccacaggtataggaggagctgtgacagacgttcttttcttcaatactgtgcatgccaatgcaacgttctcaggtatgcccttccagatcggtcaatggctctgaacgtccgccacctca

SEQ ID NO: 33935 - DNA, 562 bp, Chlorella protothecoides
ccgggtgggcgaggcggtggccggccccgccgccttccgccagcgggggggagaggtggggctgccagcactggccgccgcgcgcgccgcgctggacgacgcgctggcctgggcggaggccctgcccccctgcgccacagacctcctgggtgggttcagggtgcaggaatcggagggtgtggcaggatttccttggtggttgggggttgatggattcccacttggaggttgaagacagtgagggccacggtgaccggcagggcgtggctctctcacatccgcccccctcccccgccgtgagggtggtgcagcgacccgaggtgcccttgcagagggggcgaagatcacctcacctcatgcagcagcgctgccgcgctgcccggtccctgcaagccctccctcgtcaccccccttccctcgcacaggcatggccgagaacatgctgggccaggtgctggaggcggggcagggcgaggtggagagcgcggcgggcgagctgggcgccggcgccctgggcgccagcgcggcctgggcggcggccatggcgtccgagcccgccgcg

SEQ ID NO: 33936 - DNA, 78 bp, Chlorella protothecoides
gggtggaggtggtctgcatgccatgcccagggggggggtgcatgttgaaggtaggcatgaacattactttacgatgaa

SEQ ID NO: 33937 - DNA, 165 bp, Chlorella protothecoides
accaaacgcgcccgctcaccgccaccagcaatgggaccagggacgccagctccttcaggtctggtacgtgggcatcagatgggggggagatatgttaggacagggaaaaggttggcgcaatcttgggaaaaccaccgacgcactcagcctggcagcgttggagat

SEQ ID NO: 33938 - DNA, 93 bp, Chlorella protothecoides
tcgacaactcctgcgctgtaaatacccagatctctgacgaattaagtcaatattcggacagccatccttatgggcaagaagatcgtccctccg

SEQ ID NO: 33939 - DNA, 101 bp, Chlorella protothecoides
tcccaggacattgactcatccttgctccctcaatcagaaccctcaccgcacgagcagggcaagcagggacattgttgctcccgagaacgtggccgcctcgc

SEQ ID NO: 33940 - DNA, 130 bp, Chlorella protothecoides
ctcggtgtgccccagccgcgccttggcgctgaccaggtgcacgccacgtgcggggggcgggtccccgccaccgctccccagggccgaacccagggcctgacccagggcagccacctcgatggggtccccc

SEQ ID NO: 33941 - DNA, 113 bp, Chlorella protothecoides
tgctgctgggtggccctgcacaggtcgggtaacggatgggtgtgacttgggggcggcgttgtgatggaaaccatagtgcggagatgtacccagtggcgacatcgcttcactgt

SEQ ID NO: 33942 - DNA, 108 bp, Chlorella protothecoides
agctcacctccatgactgtgccagcagctgtagctttggcattgcccggtggcgtcgtgagagctgaggggccagagctgcgctgtccctttcctgcgcccagcacca

SEQ ID NO: 33943 - DNA, 9302 bp, Chlorella protothecoides
  modified_base (216)..(225): a, c, t, g, unknown or other
  modified_base (432)..(441): a, c, t, g, unknown or other
  modified_base (1152)..(1161): a, c, t, g, unknown or other
  modified_base (1400)..(1409): a, c, t, g, unknown or other
  modified_base (1884)..(1893): a, c, t, g, unknown or other
  modified_base (2097)..(2273): a, c, t, g, unknown or other
  modified_base (2363)..(2372): a, c, t, g, unknown or other
  modified_base (2932)..(2941): a, c, t, g, unknown or other
  modified_base (3115)..(3124): a, c, t, g, unknown or other
  modified_base (4142)..(4151): a, c, t, g, unknown or other
  modified_base (4464)..(4473): a, c, t, g, unknown or other
  modified_base (4852)..(4861): a, c, t, g, unknown or other
  modified_base (5737)..(5746): a, c, t, g, unknown or other
  modified_base (6321)..(6330): a, c, t, g, unknown or other
  modified_base (7508)..(7517): a, c, t, g, unknown or other
  modified_base (8720)..(8729): a, c, t, g, unknown or other
gggggggggggggggggggggtggggggggtgctctgcgctgcaccgccacggacaaggttggcgcgtgggcgtgaggggggcccgcagatggggttgtgggcgcatgtgccagtggcaactggggttgcaagcgagctgattgggtcggacagcattggaccgctctgctgccccgccacactcccctgcagatgccagtgtccacaatcgttgnnnnnnnnnntgagtggggttgcaagctgattgggttgaacagcatttgaccgctctgctgccccgccacacttccctgcagatgccagtgtccacaatcgttggcgccacatgtactactccatgaccgaggacatccggtgcgcctgggagtgcagggctgtcaccctggggccttggtgtcccaccccggcgccggggaccagcatgagatggnnnnnnnnnnctgcagggctgtcacagtggggccttggtgtcttaccccggcgccggggaccagcatgagatggcgtcactggagcacagggcgcgggctacacgagccccgacgcaatcaccccgcctccctctcgcgcccagggcccctcctcccctccgccctgcaggagcctggacgacatggaggggtactgctaccgcacgctgatcgtgggcaagacctccaccctcaacttttaccaatacaacaccgccaacatcacctcggaccacattgttagttgggagcggagaagagggggaagaggggggttcaccagtggggttgggtgcatcttgggaggcccaatgccaggggagacaccgccgagtgctcccaggtggagggcgtggtccgcatctggatcggatgaggatcgggacgtggccgactcccttgccagcacacacccttgccagtcatcgacccccaccaccaccgccgccctggacacccgcagacgcagcgcaagagcgccatggcggtgttcaaggcctacataatgaccgcccagcagcaggccatggccgagcagcgtgcgcgcgaccccgcctccacgcagttctgggtgagggtgatggggattggatgcgtgaagatgatcggggagggggggagcccagggatggcggctggtgaagcgcgttgggtgggcagacccttgccagggtcaggttnnnnnnnnnnggggatggcggctggggaggcgcgtcgggtgggcagacccttgccagggtcaggttttggtaggtgctgagggctggggggtccggagcgggctggcaagcaccttccccgaccctgagcctgacgagggtgcatggagaaccggctgccgtggctccctctccacactggcccggaccacaataccccagcgacccactccatcccgcagggctacgcgccgccggcaatggagctgnnnnnnnnnngcaccagcgacccactctatcccacagggctacgcgccgccggcaatggagctgctgcgccgcggcatcggccccgagaacattggcctggcagacgccattggcgagctggaggtcccgcaccagggcgtacgggagaacatgggcacgctgagccccgggtggcaggcggcggcggccgccgcggacgcggccatgggcgtcgaggtgggagtacaagcggaggcgagcggggcgggagcagcggcgacggttggtgccggggcaggaagcgcggtggcagctccagtggaccctgtgaccactgccgcggcgactggagcgggagcggcgggggccgtgtccgtggaccctgtgacgagtgccgcggcgacaggtacggggactgctgcggcgacggcggccgaccctaactctgcggccacgggaacggcggcgatgattgcggcggcggcgggcgaccccgtgcgtacgnnnnnnnnnngactctgcggccacgggaacgtcggcgacgatcgcggcggcggcgggcgaccccgtgcgtacggcggggggtgcggagacgctggccgcctccacgcccaccctgccgggaaccgcggcaagcggcacgcagccgggcgccactggcgccgcagctgtcgccggcgtcgctgggggcactggcaccgcagccacggcgaccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgcagtcgctcagcagggggctgcgcaggttgatgcaggtgcgcagggcgccgcgatggccggcggcgcgagcgccggccagacagcnnnnnnnnnngaccggcacgcagccgggcgccaccggcgccgcagctgtcgccggcgtcgctgtgggcactggcaccgcagccacggcgaccggctcggatcctggcacgagcagcgcctctggcgggggcctggctgcgtccggcagccagggcgtcgaagcggccggcgcgcaggctggccaggcctccgcggctgacaccgctgcggctgctggcgacgcagtcgctcagcagggggctgcgctggtcgatgcaggtgcgcagggcgcggcgacggccggcggcgcgagcgccggccagacagcgcagcagcgccggaggagcggccgccgcatcatggccgccgctgcgggccaggtggcggggctggaggccagtgcggaggatgcagccaccgcggcggcggccgagacggcggaggcgatgcgcgaggcagcccgggtcgaagcggccctggccgccatgccccggctcgatgtgccggtgagcttgggcgtggacgttgtgaaggaggggtgaggtcgttgcatgccggaagtcttgcccagatactccctgttcaggctcnnnnnnnnnncctcgatgtgccggtgagcttgggcgcgaacgttttgaaggaggggtgaggtcgttgcatgccaggggtcttgcccagatactccctgttcaggctctcagacctgcctccacctctccctccctcccgcctccacctccctcccacctctccctctctcccacctctccctcnnnnnnnnnntccctccatcccacctccacccctcacctcctccgtcaccctgcacacagaccgacgcgcagcaccggcacgagcccttccgccccgtggtcacgtacatgtgccgccccttcttctcgcgcggcgtgctgaacgaggtagacatcctgcgctacatcctgcgcaactacaacgtcaccctgcgtgtgaccaccttccaggtgcgaggcatgagaggggtgaggtggcctgggaccagagtgaggctgctgcccgggggaggatgccatgctcagcctcgccatgggcatgggccatgggagctgccgctcgtcaaccacaggtcctgtcgccccagggtctttgaacccacttcatcccccccccttgacacgctacacaggagccgctgctggaggtgctggacctcatgggccacaccgacgtgctggtgggcatgcacggggcgggctggaccaatgccatgttcatcaagcacggcgccagcgccatgcagatgtacccatacggttggcggctgagcaacggggccatgatccgcgggtgaggaggtggtggttggcggagggcaagtgcaggcctgggtcaacactgcgggcccctcacccacgcccgtctgctcccgaccccgcgctgcagggccaactacagggagatcgtgctggcgtccgactgcccctaccacgagtgggtcaaccacaggccggggtacgctttcttccgcaagatcgacttccaccagcggctggggatggagccctttgagcaccccggaccagaggtgcccaggcccaaggatgggctgcccggctcgccatgggtctatcagaacacatacgtggacctggagaccttcggcagggagtttgatgcgctcatggccggagctcgcatccccaagatgggcagcgccgcagttggcgcgcccaccacgccagccgcctagagtgctctcgtgatctagcctgtgtggcagtgtgatgaccgttgaaaatctaccgcatccaatggcagcaannnnnnnnnntcgcctagagtgctctcgtgatctggcctgtggcgcagtgtgatgacccttgaaaatctaccgcatccaatggcagcaaataggcagatgatagggcggtggggctggccgtacttggcgtcgcctgaacctggtttcccatgatcccacccgcaacagtttcctcggtttgaaatgtccgccagggacgagagacactttcccgcgaggccagtgtcacggaccaccacgtcccgcagggatgcatgaaaggatgaaatactcgagctcggtatccaaaagtatcggatctcgatcgcatttaccgccgccnnnnnnnnnnacacgtcccacagggatgcatgaaaggatgaaatactcaagctcgatatccaaaattatcggatctcgatcgcatttaccgccgccatggacgctgccgcccttaaatccatcaaggtcaagaccggcaccctacgtcggttgcgcaaggagctggacatgtacatccaggagcaggtgaaggagtcggcaaacgtcgagaaattgaaagcggatggcgcggacatccatgatgtcaagtatgcggtgagtggcaatgtacttggatggtgggattcatccatctgagcacggtacaccaccacattgaccgatggctcgcgatgcactctgaaggagccctgcgctgcatgccttctcctgcgacccaggagaacatnnnnnnnnnntactctgaaggggccctgcgctccatgccttctcctgcgacccaggagaacatcctcgcagagtcggtgggcatgatccccgacacccggcagcgactcagccaggcgctcgagcagctccagtctgccctggtgggtgggtgggtgctgcggcccttgccgagctgtgatgtgatgtggggaaatgggacgcgccctcctcaccactcgggaccccagcacaccgtgagaaaaccatttttcacatggctcaggatcaagctggcgatgacagctcacccgaggtccgggcagcgcgtgaggaggtggaggcagtcgcgacactggcttgaggggcaggggagcgggggcagcaggggaggggtggagcagcgaggctggtcaaggcaatgcgtcatgtcaaggcggaaagcttcagtaaaaagggtctgtggttctggggtgcgagacgggcggagcctcagggcgccgggaagtggcccacaaggatgtcgcacgcagtgggactgcgggcgcatccagacccactcatgcccgaccggccacggccgtgcgccgcccctgctccggcgcagcggcgcgctgctgctgctgagggttgctgccgccggttcgcgtgccccggctcgccctcgccgcctcccgctccttcatccggcgccgcatctccttcttcttcctgaggatctccatgtacagcttgtcgcggtactggtggatcatatgctgcaggggggagagcggtgtgggctgtgaatgtgactcgtcaccttgaagcatcatgtagtagcagcaccacagggaggtcaaagggatcgatgcaggggtaggcttgacgacgcaccaccccagcatgcggcggcacgggatctgcgnnnnnnnnnntgggtatgcttgacaacgcactaccccagcatgcggcggcacgggatctgcgagcaggaatctctggagcatcgctccatcctgcgatcctcagcaaaagacgcctcacacagagatgcacacccacagccgcgcccggcacccgccttggtgttgtcgtcgatggggatggtgatggtgttgggtgccaccggctcgtccaccaggttgtggaaggggaggcagtaggggtgacgcagcgcctcctccgcactgattcgcttctccgggttgaactgcagcagcttctccagcaggtccagggcctcgggggaggcagaggggaaggcggcctccaggcggggcgtgtcgggcgcgcgcatcgactcgagcatcgtggctgcatgtgggagaggtgtcggggcatgctggagatgctgtgccaggggacgtgagccctggcatacaggtgtgatcaactcccgtcatggattggtgaaggccgcgacacagcgacggaatggcgagccggccagggcagtccctgcgatgaccagccggttcttctgtcccattgcatcggcgagacgaggccnnnnnnnnnnaacacaacaacagaatggcgagccggccagggcagtccctgcaatgaccagccggttcctctgtcccattgcatcggcgagacgaggccagcccgttccatccccacctcacccccttgctcagcctccggcctcacccgcaaacggcgactgcaccgcctcgacgtcctcggcgcagggccgacccgtgatctccaggatcctgtccagctggttcatggtggaggtgccggggaagaccggcttcccattcagcagttcgcccaggatgcaccctggacagtggttgatgaaggctgagttacgtgccaggctgaggctgggtcgggatgggtgggtgggtggacccatgcatgcgcaggagagtcctgggacgcagcagagcaggccagagcctgtccagacaggaccccagccctgcgccacccctgaaaaccccaggggccacactcaccgcaggcccacatgtccacgccgtaggtgtatcgcatggaggacagcaggatctccggggcgcggtaccatcgcgtcgccacgtagtctgtcagcacggggttcccctcctcggctgccagctgcgcgacggagcgggccagcccaaagtcagccatcttcaccaggcactccgagttcagcaggacattgcttggctgcgggaggggcaaggacggtgtggtccgggtcatggtaaggagaaggtggccggggctgcgcctaggggatgtgaaaggagggaagaaggggcacaggaaatctacaacatacacaggatacctcaacctccgtcccacaacaggggacgatgcccaaagtctaatggccctcttagagacatgccttgatgtcccggtgcaggagctccgcggagtggatgtacttgagagacctgaagatctggtacattatgtactgcttgtggatctcctccaggatgtttgaccgaatgacggcgtggagatccgtctccatgtactcaaaaatgaggtagatgtcctgatcattctcagccttgaggacattgagtagcctgaattggatgtggggtcgaggggtgaaagggagcacgacagtatggcttttatgctgttgccaagcccatgatggtggctgtgcaataaaccatcgtcggtggcttgcaggcctcattgaaagagatcaggtgtcctgtagccacttannnnnnnnnnctgcaataaatcagcgccggtgccttgcaggcctcatcgaaagagatcaggtgtcctgtagccacttattgcgaacctgatgatgttctcgtggttgctcagctcctggaggaacatgatctccctgaatgtcctctgtgaggggggcggttcgcggtgtaagccaggagatctgacaaaggaggttggcctgtgctaggagaaatcaccgcaggacgccaatgtaacctcgcccaggcacctgtgcatccgtggcgttctgaaaggcgtcgaagatctttttcagggccaccacgtcacccgtacgcttgtccacggcgcgccacacgatcccgtaggcctggaggttggggggtggtttgtgtgctcctcacttccaggcccctcaacaggcaggcatggggaatggcacacgtagttgtactagtcgcaaagctcgcttccccctggcctcacccctttgccgagcttctgctgaatttcgtacttcttgaggacatgggcatcgatagcctccgtcatctcggccaacgggccgataccttccgcgagtgcgcgctctatcaatgctgctccagatctgttcactttgtcagacttcgctcccgaacgatcccgctgtccggtcaattgcactcaccagttgaaatttcaagcagcggaaactcgggttccctgtttccaaccgtccgaccacgtgacgtgaggacgggggtgctggcgtggcctggttcgggttgggtattgcgttgcgtaaaaccggcacgtctcgttgtccacagggaagtttacatacaagatcgctctgaaaacccattcaggtgcagctgcatatcagtttcctccctaatcggtgcgtgggcagatccttcttcccattcgctacctcgccatgtctcggacggtggacgctcgcacgaaagcgctggtggagcccgtcgcccgcgagatccgggccgcaacttccgatcccaaggctgatgcagtcgcagagcgtgaacaggcgtccttcgacgccaacgagctggcagtgtacatgcaggggggccagagcgttctggaccgcaagtgcgtttggttgggggtctgggctcggaaaccgatggtttattgatggaaccctggcctgccctgatttgtactggcaatcacaaacatgctttgaagcacctactacgtcactcctttcagccacatcagcannnnnnnnnntggtgtctgggctcggaaatcgatgctttattgatggaaccctggcctgccctgatttgtactggcactcataaacatgctttggagcacccactacgtcactcctttcagccacatcagcagtgtcgttgcaacgaccctctgctcctgccttccccctacagtgtcaaggccatccagatgctcaagcagttcccctggggcgacaagtccaagcgccccttcctcacccgcaccgaagaatatgtgcagggcctggaggcctccgtgaccatctggaagatggccaacgagggcaagatcaccaacgaggaggccatggccatgcgcaagcagctcaactggcccgcaggcctagagctccacctgggggtgcgcagcgcggggacttggcggtcctcctgtgttcatggggggctggcgttgatgatgggttgatgcgcaagggcgtggcctgggacatgctcgacccacaagcctgtatccaaccgtcatgcctggctcgtcccccagcacagcgcccctctggccaccgcacgcccccccccaccccccccttccccccctttttac

SEQ ID NO: 33944 - DNA, 68 bp, Chlorella protothecoides
gtcaccgttcgaacctctcactttatgcaacctgtgagttgtgcgagcgctggtgacgtcaggtcgca

SEQ ID NO: 33945 - DNA, 10653 bp, Chlorella protothecoides
  modified_base (399)..(408): a, c, t, g, unknown or other
  modified_base (1955)..(1964): a, c, t, g, unknown or other
  modified_base (2816)..(2825): a, c, t, g, unknown or other
  modified_base (2935)..(2944): a, c, t, g, unknown or other
  modified_base (3167)..(3176): a, c, t, g, unknown or other
  modified_base (3459)..(3468): a, c, t, g, unknown or other
  modified_base (4019)..(4028): a, c, t, g, unknown or other
  modified_base (4832)..(4841): a, c, t, g, unknown or other
  modified_base (5239)..(5248): a, c, t, g, unknown or other
  modified_base (5565)..(5574): a, c, t, g, unknown or other
  modified_base (5833)..(5842): a, c, t, g, unknown or other
  modified_base (5918)..(5927): a, c, t, g, unknown or other
  modified_base (6080)..(6089): a, c, t, g, unknown or other
  modified_base (6713)..(6722): a, c, t, g, unknown or other
  modified_base (7512)..(7521): a, c, t, g, unknown or other
  modified_base (7601)..(7610): a, c, t, g, unknown or other
  modified_base (8741)..(8750): a, c, t, g, unknown or other
  modified_base (8981)..(9022): a, c, t, g, unknown or other
  modified_base (9212)..(9221): a, c, t, g, unknown or other
  modified_base (9315)..(9324): a, c, t, g, unknown or other
  modified_base (9425)..(9560): a, c, t, g, unknown or other
  modified_base (10028)..(10037): a, c, t, g, unknown or other
  modified_base (10541)..(10550): a, c, t, g, unknown or other
ctcaggggcgcggagggcaggggcggcgccgcggcgcccgccgcccgcgccgcgccttccagcagcgccgccagggccgcgccggcagccgggtccacctcctgcccgtttttcccggagcggacaggccgaccgtcgtccatcatgttcctggcggggccgggcggggcgggggaggaagggtgacaggccaagaggggcaccagcaacgctcacatattaccggtcaggaggtcagaaggccctgcggggcccccattccttccccttcagaaaagaatgtgagcattcgtacacatggaagggggcgccccacctgcactcgtgcccgtgccgtggccgtccctccgcctccccaacgctgtcgtgcttcccttccccaaccccccaaacgccccnnnnnnnnnntcccattccatccccttcagaaaagaatgtgagcattggtacacatggaagggagcgccccaactgcacttgtgcccgtgccgaggccgtccctccgcctcccgaacgctgtctcgcttcccttccccaaccccccaaacgcccccttccccccccctcacacacacctgatgtgctcggcctcggcaaacggcacatcgtgccggaagaaccactcgagggcgcagggcggggcaaggtctcggtcgccctcccacggcacgttctggccgagtaggggcggcgaggccagccgccccatgcccgcaaagttgccggtggggcgggcggagaggaagacgagcaccggctccggtccctgcagcgcgtccacgaggcgcacggccacaccgggggcgcaggcccatccaccgcgcgcgacggaggcgcgcaggttgtccgccttggaggtggtgaggaagaagaagcgcggcatctggctcgggaggcctcgccgcctggcggtggcgatggtggtgggtgggacgtggcttgagggagggagcgcgaggtgagggccgtgaggtgtgcccgcgctcaggtctaccccggcaccggactcagaagtagttgtcacagtgcccctacaccagaatcccgccgtccccgtctagctgctcaccttctaccagagcaggtctggagctaacccccttccctctgctgctaaccccaggccggtatgcaggcgtaattcaccacgaggcggccgtccacaccgaaagcttcgtacaggacggagatgcgctcctccagagaaggagagaatgcctccttcaggtacaggaactgtggatgagataggagaacggaacccagtggaggtgggtgctgcaggtgaggctgcgcagcgctccctggattcagcgatgttgccaccacactcggcgacgtcacacaggggatcagtcttagtgccaggactcaccacttggtccttgcccagcttcttgcgcaggaactctaccagcttggagaacctctcttggccgtcgacctgcaaagtggcagggaatggcgtcttcaggcgtccaagagcatgcccactctcggtggcaacagcaccgacttttgcccctcccttcaagattccgagccctggcaccttgactttggcttgtttcagcaatggagcgtccccggtttgcttgaacagaatcacgactgccacgtgaagggtgggtgaattgttcgagtatctcgtcccgattgcgtgcacctggggtgtgagtcaagacggcgcccagctcggcgttcctacagtgcaaagtctcacctttaccatcagacatgacgctaatcacggcagcacatggtcgtgacaatgctagctggatcgcatgcgtaacggagtatgcaccagtgcagccgatgcgatctgatgacctggcggcacgtccaggctggaggtgcttgggacccacggcttatacatcgatcacaggcatccctggtcaacagtcatgagcctgagcaacagtatgtttaaatactgacgaggacgaaannnnnnnnnnatatacatcgatcaaggcatccctggtcgacagtcatgagcctgagcaccagtatgtttaaatactgacgaggacgaaatgtcgggagacaaggcgctgaggggctgggtggaggagaggctccatgcccttctcggtgagtgtcgctgcttgcaatgcgggcgcgatcacgaagtcttctttcccctgtcaacctgatgccatgtgtgtgcctcatcgttgtaattgcaggcttcgctgagcgggcgttggtggactacgtggtgtccatcgctcgccgtgccaagcaccccgacgctctctgcacgacccttgaggctcaggtaaggcttgtgggacgcgagtcgatgagggcgtcccgcctaaggcacacgatggggtgcacctgcatcaatcacaagcgcagctggaggcataggaatcccctttccccccccatgcgcaggggctgccggcttcccaggccacccgcagctttgcaatcgacctgctgtcgagatgcagcggcgcaggtaccagcggcgcatctgctgcggtctcggcgcagaggcaggcccacgcagaggccgtggcagccgcgcggcggaaccaggcctacagcctgatagtcgccgacgacgacgcgcccggggagcagccccgcaccgccccctcccctggtggccccctggagggcagggatgggggttcagatcgcgggagcaagagctccaagcggcgcagcacccgcaaggtgggctgctgagccgcgtgaagctctggagcacagtgtctccattgctctgcattgtgtgctgaccgtccctccacacccccgaccgcttcatgcccaaatcttgccctcctccaccnnnnnnnnnncgagccgcgtgagggtctggagcacagtgtctccactgctctgcattgtgtgctggccgtccctccacaaccccgaccacttcatgcccaaatcttgccctcctccaccnnnnnnnnnntcgcgcctcaaagtcctccttcgctgccttgtcggcctcgcgcgccgcctcgcgtgcctccaactcggccgccgcggccgccgcttcggggtcctgcccggccggatcctcctcccacgcgcgcttcctcgccggcctggcgaccagggctccctctgcaccgccgccatcatcgtctcccggccgtgactgggtggaggagggcaagatttgggcatgaagnnnnnnnnnngaggaggcccgcgaggcggcgcgggaggccgacaaggcggcgaaggaggactttgaggcgcggctgcgggaaaaggacgaggcgcggacgcgcaagctcgccgagaagaagatcccgcgggaggagctggaggacctgcagaggcggcgcgccgccgaggccgccgaggaccgctcggccgtcaccgggatgctcaggtgggctgggtttggcgggaggtctaaaggagagcgttggctgacaggtattgtcctggcaagcaggcaggagctgcttgctttgnnnnnnnnnncgtttggcgggaggtcgaagggagaacgttggctgacaggtattgtgctggcaagcaggcaggagctgcttgctttgcgctgtcagtgtggtggtggtgggcctcggggcggatcgcagggagttttgcacgtcgaggctccctcagggagaaccggaccaggaagatctggcgctctgccgctgatgtggcagagcgccgttcccccttggtccttggttcgctgcctggtgcggtccccgacatttccaccacacctccaccactcgatccgccagggacatgtcgaggcaggagtacctgaagaagcgggaggaggccaagctccaggagctgaaggacgcgctggaggacgagaagttcctcttccagggcaagaagatgacagagaaggagcggcgggacctggcatacaaggaggaggtgtatcggctggccgtggagaggaagaagcagctgggtgaggcaggggggtttggcgtccattcatcatcaaaggatgggagggtttgggtggctgggaggtgccatgaaagggctctgctggagcnnnnnnnnnnacagggggtgtggcgtccagggatcatcagaggatgggaggggtttgggtggcttggaggtgccatgaaagggctctgctggagccaggactgtgcatgcaaggcccttgcgtgtgcggagtgtaaggccaccagtgcttggggctgcctctgctgcacgatgctgcaccacacagcgagactccacacaagctggaggggtgccatcaccagatcagccctttgtttgggtagcctgatccctattacggcctcaccatgcgctcaaacagcccttccctcaacccccgtcctgcatatcctttctcagacgagctggagcacgacgatgcctaccacctgcccggcagctacgacgcgcccggcaccgcgccagacaagcgttacgaggtgctgacgcagcggtaccgcgagccggaggaggacgaggtgccggacgcgccctgggcgcagcaggaggcattcgaggcagagcagatccggaaggcggtgaagaccagcgccaaggcggcgcaggcaccagcctatgactatgtgtttgaggaccaggtggagttcatcgtcgaccagatgctgggaggggagggcgaactcctggtgagcaggggctttgtgggtgcccgaggagttggaggaagaggagtgctggggaagctgagggggggggaacacctcctgcccatgcctgggttcgtaccggtcttcgactgctccctgagcgtaggatggattcccgtgactcggaagtgcaccgatgacgggtctgggtacctgcgcaggtcaaggaggagacgagagaggagnnnnnnnnnnagggaacccctcctgcccatgcctgggtttgtaccggtcttcgactgctcccagagcgtgggatgaactcccgtgactcggaggtgcaccgctgatgggtctgggcacccgcgcaggtcaaggaggagacgagagaggagcaggcggagagggagcggcaggagcgggaggcagaggcccgcaccgagttcgagcagatacaagaggaccgccggcggctgcccatgttcccctacaggcatgtgtggggggtcgggctcacagaggcccaggtagcctcgagacgcagcgcacgagccgtgtgcagctcaccattcttgtctgtggcggttgttgcaccaccctgtgcctcattaatcagtggccacctgggtgcagggaggatctgctgaaggccnnnnnnnnnncgtgcctcattcaccagtggccgcctgggtgcagggaggatctgctgaaggccattgcggagcaccaggtgctcatcatcgtcggcgagacggggtcggggaagaccacgcagatcccgcagtacctatacgaggcagggtatggcaaggccggcaagatcggctgtacacaaccaaggtgcgggaatgggctgggcctggagaggttttcttgagggggttgtgtgggaacccctgcacaccggctgtctcctggtgtgacgcagcgcaagcgtggcgcgcaccagtggaccttggttcttgagcatggtgatgcnnnnnnnnnncgggcctggagagggtttcttgagggggttgtgtgggaattcctgcacgccggctgtctcctggtgcgacgcagcgcaagcgtggcgcaccggtggaccttggttcttgagcatggtgatgcctgcccatgccagccaggtgctgcggagatcaacgtacactcacccctgtcgttgagtggccttgtcgtgtcggatgcctcccatctccacaccgcccccattcgtgcaccctccgaccaggcgtgtggctgccatnnnnnnnnnntcttggcgtgtcggatgccctccatctccacaccgccccattcgcgcaccctccgaccaggcgtgtggctgccatnnnnnnnnnntgagagttgaatgcagcggcaattgccgtggaagcgcttgggcagcaatgcctcctgggagaggccgctgcgcctctcatcatgctgctgcggggtggaactcgaacctctgaatctcattgtgccttgctcagtcctgccctcgcgaccctnnnnnnnnnngtcggtggcggcccgtgtggctgtggaagtcggcgtgaagctgggggccgaggtgggctactccatccgcttcgaggactgcacgagcgacaagaccgtgctcaagtacatgacagacggcatgctgctgcgggagttcctctcagaaccggatctggccgggtacaggtgagggtgtgcctcgagagttgactgcagcggcaatcgccgtggaagtgcttgggcagcaatgcctcctgggagaggccgctgcgtctttcattatgctgctgcggggtggaaccttgaacctctgaatctcattttgccttgctcagtcctgccctcgcgaccctgcagctgcatgatggtggatgaggcgcacgagcgcaccctccacaccgacgtcctctttgggctggtgaaggtacgccgggcagggtttttaaattatgtctgcagaattaggagcgcgatgcttggcagtgtgcggctagagtgtaacttagatgggcactctcaccaccacataatacgggcctctccagacgtccagcccctcagcatactcatccccgtcacatccggcgtggtcgcaggacattgcacgcttccggccggagctgaagctgctcatctcctctnnnnnnnnnntggctagagtgtatcttagatgggcactctcaccaccatattgtacgggcctctccagacgtccagcccctcagcatactcatccccatcacatccggcatggtcacaggacattgcacgctttcggccggagctgaagctgctcatctcctctgccacgctcgacgccgagaaattctccgagtactttgacaatgcccccatctttcggtgagtgtttgtggggtgtgtaggagaagaaattggtttcagtagctgtttgagccatgtttcaggctcttgacacatccgtgcacctgctgcaaagcgtggccagggtggtctgatccccaaactgcggcatcgagcaatcaatgctgccaaactccccttgtcatcgctccttttcctgtattccatgcagaatcccgggccggcggtacccagtggacatcctgtacactaaggcccccgaggcagactacctgcacgcggcggcggtgaccacgctgcagatccacgtcacacagccgccgggggacgtcctcatcttcctgacggggcaggaggagattgaggcctgcgaggagctccttcgccaggtgggagcatgtgtccattttggtgaatcgggccttggtggttggccttgaagggtgttcctgtgccggcaagggcaggtcccactcgttttgatggggccatcaccagccctggaccctccccggctgctcacctcctcgcccacctgaccccctacttcaccctctgcagcgcactcgcggcatgggcagcaagatcggggagctcnnnnnnnnnnggtggtatgggagggtttttgaaaggggttgtcttactgtggattgataatgatcggagattgtggatcgtgatcggagnnnnnnnnnntgggcaatcaccagccctggaacctccccggctgctcacctcctcacccacctgaccccctgcttcaccctctgcagcgcacccgcggcatgggcagcaagatcggggagctcatcatcgcccccatctatgccaacctgccctcggacatgcaggccaagatcttcgagactaccccccccggtgcacgcaaggtggtcattgccaccaacattgccgagacgtcgctcaccatcgatggcatcaaggtcgatctgtggtatgggaggggttttgaaagggggttgtcatactgtggattgatcatgatcggagattgtggatcgtgatcggaggtttgctgggaaaagggcctagcctctgagaggatggcagcatggtgctttcctggttggctccacccctcccatccttacccagatgagggttgcccaagactcacacgcacaaatatccccttccccggccaatgcagtacgtgatagatcctggcttctgcaagcagaactcgtacaacccacggacagggatggagtcgctgcaggtcacccccatctccaaggcgtcggcgctgcaacgtgcaggtgctgacaacgagtcgtgatgttctgagggttcacaacacattcagtcacgcgcctgtatagtggcgctgcctggtcttgctttgggtggggcaagccatctcgggcttctgtaacaatcatgaatgccttgcctgtgacaggtcctaaattcagccccccctctctacctcagggcgcgcggggcgcaccgcgccgggcaagtgcttccggctgtacacagcctgggcgtatcagcacgaactggaggactccacggtgccggagatccagaggactaatctggggaatgtggtactcatgctcaagtcgctgggcatcaacgacctcatcaactttgacttcatggacccgccgcccaccggtgggtggtgaacgggcgggggggcctctggcggcagccggggcagggggagggaggattgctcgaggctccagggtaacacccagcgctgtattaccccctgacgattgctggacgtagcatacgctgatgtgccatgcccactcaagtcaatgggaagcgcagcattgaatcaggggagtnnnnnnnnnnagtgtgccacgcccactcaattcgatgggaagcgcagcattgaatcaggggagtttggctgcttggccaccctggactcctgctggggcgtgccttgcggctccatgcccgcaccaaaccctggcccgcacccctctctgacacagagacgatgctgagggcgctggagcagctgtatgcgcttggcgcgctgaatgacaagggcgagctcaccaccatgggtgaggggtnnnnnnnnnnnnnnnnnnnnnnnnnnnnnnnnnnnnnnnnnngaatctcctatcagattaaatcctcttgttgctggatgtccagtaaggggcagctttggcgataaaattgcttctggaacaacagcacccctctcacctggcagggcatgctgcatgctggggactagcgtacgtcaccttgcatccctctcgtttgttcccctctccatcccatggcaccctgtcgccnnnnnnnnnntgtgtggctggggtggttgtacatcggcggtgcatgctgcattgatgcctgcctgggtatgggaagcagatttggcagagcgcacaggattttnnnnnnnnnncaggggttgtgtggctggggtggttgtgcatcggcggtgcatgctgccttgatgcctgcctgggtatggaaagcagatttggcagagcgcacaggattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctggggactagcgtacgtccccttgcatcccctctcgtttgtccccctctccatcccatggcaccctgtcgccacgcaggccgcaagatggccgagttcccggtggaccccatgctggccaagatgatcatcaacagcgagaagcatggcgtgtcgggtgcgcaaggaggaatggagtcacgagcggccaggtgtcgcgtgcacatgcgggggttcccattgatttggatgccctgcgccagccccatactcatcgccgctgcctgctggcctctccccctgaacacagaggaggtggccaccatagctgccatggtgtccatcggcggctcggtcttttaccgccccaaggacaagcaggtgcacgccgacaatgcgcacaaggccttctacagaggcaacgtcggtgggtgtagggggtggatgatgtggaaaggggtcccttcagccacacattagaaagannnnnnnnnncaggggatggatgatggggagaggggtcccttcagccacacattagaaagattgaaaggccggtgctggggtgcccattgttgaactgggcacgcattccgcagcctccttggctgcagcgatcccacgccagggccgtggttgagctctgatcattgcgcatgcccctgttttgtcatcgtgtacctccgcccccctcatacaggggaccacattgccctgctgaatgtctacaactcctgggccgagaccaattttgctacgcagtggtgctatgaaaactttgttcaggtatctgatgggtggaaagggcggtgttcagccccggaatagcctgaggatcgacggccgtgcgcggtcgcatggctggaggaagcgtcgaggggattccgcctggtcaggacgcatgggcgggaaacacgtgtccatgctgccgtttccaccctcgcagcacgcccttcacagatcctctgcccccccacggtctgccccccctcccccccnnnnnnnnnntctggtcaggacgcatgggcggggaacgcgtgtccatgctgccgttcccaccctcgcagcacgccctccacaaatcctctggtctcccacggtctgccccccc

SEQ ID NO: 33946 - DNA, 66 bp, Chlorella protothecoides
ctttgccactctgtgcatcgcccagaatctaattttcccttcaccccccggtgctttcctccgcga

SEQ ID NO: 33947 - DNA, 67 bp, Chlorella protothecoides
ggtttggtgtcagaagaggggagacattttgacgttctggtgcgaggagggtgagtttcacgcttgg

SEQ ID NO: 33948 - DNA, 73 bp, Chlorella protothecoides
ggcgcagggccgatggcagaggactaggaaccaggatgataaaagtccctcagcaccctgcagtctgacatgc

SEQ ID NO: 33949 - DNA, 79 bp, Chlorella protothecoides
aaggatcgtggggagagggggtgggcatgagggagcgttccggagggtggctgacatccaccgccgcacagagcctctc

SEQ ID NO: 33950 - DNA, 671 bp, Chlorella protothecoides
  modified_base (135)..(254): a, c, t, g, unknown or other
ccccaaacccccacccccccaccccccgatgcctgcgccatgaccgacgatgagctgtcgcgcctgcgtcgcgtggcccagtccctgctggcagagggctcccggcgcagggaggagaccctggcccgctggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggtctggaggcccgcatcgcggcgcgcgcccgcaccgacctcagcggccgccccggcgcggccaacgccaccaacgcggccgtcttttccggcttcaaccccatccagagccgggcagggccggacggcgcgcccctgcccatccccgcgctcgccgcggagcgggaccgcctcctggcactggtctcgcgcctggaggctgacgcagcggagtgccgcgcggaggtgctggccgcctcgccccgtcggcgtgccgcagaggccgccgtctgggagacgcggctggtggcgctggcggacacgctgcgcgtgttgcgctccgagatcagcgcggtggaggtggagctggcggggcgcgaggcggccgaggcgctggtgggggcgcggcgcgcggccgaggccagcggcgcggcg

SEQ ID NO: 33951 - DNA, 61 bp, Chlorella protothecoides
gccgcacccatgcgcagagggaaggatcctcttttgtctggagggcggctacaacaccgag

SEQ ID NO: 33952 - DNA, 104 bp, Chlorella protothecoides
gatgcgctgagccaccagcgcttcccagggcgctgctcctcgcgtcaccagctcaagcctctcggctcagagcatggtgagccagccatcaacccaccgcctca

SEQ ID NO: 33953 - DNA, 76 bp, Chlorella protothecoides
tacccatcccaccacttcctcacattcacaccattagtgccatgcatgctgtcgatccacacagggcggccatgcg

SEQ ID NO: 33954 - DNA, 61 bp, Chlorella protothecoides
acagagtgagtgtgtgcatctgtcatgggagcccaagaggtgggcaggtccaggggtgcat

SEQ ID NO: 33955 - DNA, 61 bp, Chlorella protothecoides
tggagcgctgtggttcaccaaggtaaagaggttgtggtaccaaaacatcgcaaaaggtgga

SEQ ID NO: 33956 - DNA, 1194 bp, Chlorella protothecoides
  modified_base (153)..(313): a, c, t, g, unknown or other
  modified_base (765)..(774): a, c, t, g, unknown or other
ggcgcccggcgcctgggccgcggccgccgcggccgacctggacctgcgcgcgctcatctcgacgctgccgcggcacgcgccacgcggcgcgcccactctggacctggtcctggcctgcgccgcctcctccccaggcgcgggcgtggtgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccgggatctcgccgccggcggcgggggttgcgcctcccggcggggcaggggcatggaccccgacaccgcgggcgcgtacgcgggcgacgggcggcgcagtgccgcgcacgggctccactgccaggtgctggccgcgctggcggtgctgggcgaggggggccgggggcggggcgcggccgccgtgctgcaggtcgccgtgctgagccacgagcgcctgctgctggccctggagccgccggagggcagcgcggagcagccactcacgctggcgggtctgcaggtgggtgaggggttcgggggccgaggagtgggcattcatgaatgggggacctgggccgccacggtgatcgcggcaggctggcctgctggtggcgccgtgtgaggggtctcgcagctcgtcgtcgttggaggctcgtcactccattcggcgggccgcacctcgcgaccannnnnnnnnnctgaggggtctcgcagctcgtcgtcgtgggaagcccgtcgctccattcggcgggccgcacctcgcgaccatccgcgagtgccctcgtcctcccacccgaggtgcggcacagccgacctagacccctcgaacctgaatctctgtgccacacacacacccacatcgtggcaggaggccagggccacgctcttcctggccagcgcgctgctgcggcaggaggggcactggcgcgcagcgctgcccggcgcactgcccgacctgcgcgccgccagcgcgcgcttcctttcttgggcggcccagcccgacccggaggtcgtctgcgcggcgctggacccctcggagcgcgcggccgcggcccgaccgccgccgcacgcggtggacgggggctggcaccgggcgctggcggccgccacgcccgcgt

SEQ ID NO: 33957 - DNA, 63 bp, Chlorella protothecoides
gttccgtctacaacaagacctccccctcccccacccaagacaacccctcctcccacccccacg

SEQ ID NO: 33958 - DNA, 74 bp, Chlorella protothecoides
agaccctccacaacacaccccatccatgcgcatccccgtaccttaaaccatcagcctgtcggacctcgagcatg

SEQ ID NO: 33959 - DNA, 79 bp, Chlorella protothecoides
ctgccggtcgggggccctgtttcggtggctttggagcacagccatggggtggcaggcagtgctgccggcgcggggatgc

SEQ ID NO: 33960 - DNA, 116 bp, Chlorella protothecoides
ggccatcccactgcatcccgcctccttgcatgaggacgacctccacagggtgccgcccacccaccacaaccccatcgaccacgcgttcagcctcccgagacgcccgcttacctggc

SEQ ID NO: 33961 - DNA, 166 bp, Chlorella protothecoides
gccgtaccaaggcacggcttctgaatcggatggctgcctcttcaactcgcgccccgatgcattattcctagatccctgcccggtcacccacctcccacctctctccttcctgtttgacccaggcggactgacgctgcacctgggctccggcgccgaggttctgacc

SEQ ID NO: 33962 - DNA, 61 bp, Chlorella protothecoides
gtagccctccacttgactgagatgtagcccgggcagtcgaacatcaggcttccttggaatc

SEQ ID NO: 33963 - DNA, 74 bp, Chlorella protothecoides
gtcgatgatcaccacgcgagccacttgcgcgtcctggcatgagggttgaagggggggggggggggggggggggg

SEQ ID NO: 33964 - DNA, 61 bp, Chlorella protothecoides
cgctgtgaacgcgatcgccgggcacataaactcctttggcttctccacccctgtgcccaag

SEQ ID NO: 33965 - DNA, 61 bp, Chlorella protothecoides
ctctccagcggccagccccgcgtcctccccatctccagcatccagccccaagacatccact

SEQ ID NO: 33966 - DNA, 127 bp, Chlorella protothecoides
gcgggtaccgcagcgctgcatggcacgtaaggagaacgggcctggtatttcggcaccccgcatgcgagattgaaggaaggaatcttcagcatattttaaatcacccgcgatatgtataactaagctt

SEQ ID NO: 33967 - DNA, 61 bp, Chlorella protothecoides
ctccctccctcgctcccccatcatttgttagcccctgcacgcacacgacgcaagcgagcgt

SEQ ID NO: 33968 - DNA, 112 bp, Chlorella protothecoides
gttggcgggcacccaccgaaccctgatcagaagatgatcgcatgccgcgccggggccctccgctgcaagtttatcggagttggacacttccaccagatcatctcgtgaattc

SEQ ID NO: 33969 - DNA, 26335 bp, Chlorella protothecoides
  modified_base (1263)..(1272): a, c, t, g, unknown or other
  modified_base (1404)..(1413): a, c, t, g, unknown or other
  modified_base (1596)..(1605): a, c, t, g, unknown or other
  modified_base (2657)..(2666): a, c, t, g, unknown or other
  modified_base (3133)..(3142): a, c, t, g, unknown or other
  modified_base (3197)..(3206): a, c, t, g, unknown or other
  modified_base (3430)..(3439): a, c, t, g, unknown or other
  modified_base (3507)..(3570): a, c, t, g, unknown or other
  modified_base (3672)..(3681): a, c, t, g, unknown or other
  modified_base (5222)..(5231): a, c, t, g, unknown or other
  modified_base (6278)..(6287): a, c, t, g, unknown or other
  modified_base (6364)..(6373): a, c, t, g, unknown or other
  modified_base (6790)..(6799): a, c, t, g, unknown or other
  modified_base (8114)..(8123): a, c, t, g, unknown or other
  modified_base (8191)..(8200): a, c, t, g, unknown or other
  modified_base (8401)..(8410): a, c, t, g, unknown or other
  modified_base (8579)..(8588): a, c, t, g, unknown or other
  modified_base (10617)..(10626): a, c, t, g, unknown or other
  modified_base (11763)..(11772): a, c, t, g, unknown or other
  modified_base (13898)..(13907): a, c, t, g, unknown or other
  modified_base (13993)..(14151): a, c, t, g, unknown or other
  modified_base (15466)..(15475): a, c, t, g, unknown or other
  modified_base (16829)..(16838): a, c, t, g, unknown or other
  modified_base (17375)..(17384): a, c, t, g, unknown or other
  modified_base (17823)..(17832): a, c, t, g, unknown or other
  modified_base (19111)..(19120): a, c, t, g, unknown or other
  modified_base (20163)..(20172): a, c, t, g, unknown or other
  modified_base (21088)..(21097): a, c, t, g, unknown or other
  modified_base (21722)..(21731): a, c, t, g, unknown or other
  modified_base (22070)..(22079): a, c, t, g, unknown or other
  modified_base (23856)..(23865): a, c, t, g, unknown or other
  modified_base (24928)..(25051): a, c, t, g, unknown or other
  modified_base (25867)..(25876): a, c, t, g, unknown or other
gcgggacgcgcgcccatcgccgccagcacctcctccagccccgcgtgcgcgcggcggcgcaccttgggccgcgcgtcggcgcaggcggccagcaccaagccaaaggagggcagcgcggccggccagtcagccgggtcggcggcggccagcacctggcacagcgcgcccagcgcgggcctggccagctgcgcgtcggtccctgcgccggccagcaggccgcgcaggagcgcgctggcgggcgcgaacttggcgcgcagcacggggttgggcacgcgcgggagcagggagttgaggagggtggccatgcccgccagcaggggcggggagcgggcgacgtcggggcgctccagcgaggccatggccgcggcaaagagggcggtgggggtggggtccaggccctcctcccgcaccacctccagcagggcggaggcgatggctagcagctgtcggctctcgggctggctggagtgggagtgcttggcccgcagctccgcgatgaaggcgccgtcaccccggatgaagggtgcggtgggccgagaggaggggtgggccggcgcctcatccagcgcactgcgcagggaagccagctccatgctgagacgagacggtggaattgtttgaacttagcctgggtgctaccctcaggctctcgctaggttcaggctgcaggtgatgaccgcggcatggcggcagcgggggcgagcggcgggctggaaggggggcaccgagatattcccatatataaatgtgcccttggagaagcgtgctgctatctgccagcgcatgcaaccgttccttgcacatgtcacccaacatctcggggcgccagcgccgtcccgccactttggcgggtgcatgaaaaagcacagctgtgcggctcataacacacctccctctcggcgcccatgccagacacataaacgtttgaaagtctgacataagatagtcaagggaatggggggttgtaacgtgttgtgatcccggtgccaagtgctcttattgagctggtgtgcagaggacattgctagctgcttacagcttcggcgctggtcgatgctgaagcacaaaaacggcacattcggaacacgtcgcaggcaataaatatatataattcggccttgactccatcaagggccttgccgacaactgaacttccaaccatagtaggtgccctgacctcaccacagctgcattgccccgatgctgttccaatctggcatcaaacaaccttacaaacttgaattgcaatgagattggccactnnnnnnnnnntaaaacggcacatttggaaacacgtcgcaggcaacaaatatatataattcagccttgactccatcaaaggccttgccgacaactgaacttccaatcacagcaggtgccctgacctcaccacagctgcattgnnnnnnnnnntcaatgcaacaaggcatcagatcagatctgcgggggaaggatcctctgccacaaagtgttccaccagacttctttgcagatacagagcgtgaacatggtaatatcatggcacatataattgccacatcagagcatacaccatgcacacggcatttaccgcgcgagtagtggccatccccctgnnnnnnnnnngtaatcgccacatcagagcgtacaccatgcacacggcgtttaccgcgcgagtagtggccatccccctgccccgccccttccgctgtgccggccctgggccccgctcccgggctcgtggcggactgcttcgcggctcggacaagcgaatagaggtacctgagtctgtgaggccccaatgggacgcctgcgccgaggctctagaggtcctaggactggagcgtaaggatgccgacaaggcgattggctccgctttcggctggggcaagaagaagaaatactggcagggagccaagcaggacgaagtcccggatgtgcagcgattggcagaggcactagagttcctttcgtcggtcggtattgccgctccagaagatcaggggaaagtggtcaaggacttcccccaggtgctggggctgagtcctgatctgatgcagcacaacgtcaacaagctgaagcaggcgtaccgaatgaagggctctgtgctggcgtcctctgtgaagaggaaacccaaagtgctaggggccatcaccgattgcgagggcgactgtgaaggcaactgctcgcgctgctttgcccaattttgagtcgcagtgtccctgctgtatattctatatggactccttaggtgcagtgtttgttagacctgttgtattgtttggtgctcggagatggctgggatgaggatgggtgcatcaatcttgtccatgttctctctgccgctgcaccaccctctgaagcccatgtacaatccttgcacaacaacccaattctcctgtacatacagagaatggtatcagagcttacagaggtacagctgctcttggtcagactgaagctgccgactgatggttccgttctatgcaggacctgagaccgccgcgtgttccgtgatgcgcgtcctaatgtttcgtgctgctactgactccttgcccgcttcgtacagcattcattttccaaagagcaggaaaatccgattaacaaccttgtcacgactccaaaacaccagcggcgggtcaccacaatgggtgccggtgccatcttcgcgtccatcnnnnnnnnnngaattttctaaagagcaggacaatccgattaacaatcttgtcacgactccaaaacatcggcggcgggtcaccaccatgggtgccggtgccatcttcgcgtccatcctggaccagcgtaagaagatgttcaatcggttcgtcaagaacgacaaggacagggcagatgtgtaccgcaaatccatggagcgacggcccgggccgtcagtgaaggacacgcacgagaaaaaggaggatgcccgggaatttcccaaactggtcacccacccccaccatgtgagtgcgctgtgtttcaaggagcatgcacatggagtccataacacattccgggcaatcataacgaagccttgctctcccaatgacatgctccatgcagcgcgacagccatcacaagtgacgtggggacctgaggcatcttggagctttgggcgcacagcatctccagctggtctttcacattctgattgtannnnnnnnnntttggagctttgggcacactgcacctccagctggtctttcacattctgattgtannnnnnnnnnctctgaatgtatgtttgacactgttctctcttctccccatggtgggcacagaaacaatccttatattacatgaccctgaagtgcccaagtgtatcactacaatgcttttcaggccttttgctttgtggccgggacccactcccccacacccgtctcagggtttacttgccagacctcttcatagtctacaaactgcatgcctggcggggctccgccctgtaagnnnnnnnnnnttttgaatgtatgtttgacactgtcctctcttctcctcatggtgggcacagaaacaatccttatattnnnnnnnnnnnnnnnnnnnnnnnnnnnnnnnnnnnnnnnnnnnnnnnnnnnnnnnnnnnnnnnncgcgcttcctactggcaggatcctcggtgtgcaccgagttctccaggtcatcactgtgggccattgtagcttgtttgcagctgcagctgacattcatcacannnnnnnnnnggcgctccctgctggcaggatgctcggtgtgcaccaagttctccaggtcatcactgtgggccatggtagcctgtttgcagctgcagctgacattcatcacaggcccacactctcgtctggcagacaggcaggcatagccctgcagaacaccttctcttccccccctgtgaacaatcggcacactcagcctgagtgtctgggccctcaaacgccgcctcctgagacctgcatctgcaaacccatccttctccttccccactcacagcgaggatggtgaggaggtccatctccaccttgctcacgatctccggctccacatccagcgcctgcctgaagatgcgctcccgcgcattgcgcatggggcgggtgatgccgtcgcgggactcgccgggggggccctccaggggcacagcgtcccccaccaccagcacctggcccacgtcgccgctcttcaccagattgacgtcgtcgtaggtcttgtaggtctccgcgacacacggcaggttcagcaccttgagggggtatggcttccccctgaacacgaaggaaccatgctggtcgctgtctgcatggtgaagtgaccagtgggaggctcggtgggaggatcgggcggcaaggggggggatgggcaggcttcaggaggtgcatgaagaggctctcattggccctccatcgcccacgcacgcatgcgtcgataccaggaagacatgatcatcgtaccttcaaacacaatcttggcggacttgacatcctcctcggtaccagtgtccaggcattcgcgcagagccccggcgaggtcagggtcagtcacacggaggatggagtgctcctctgtcacttccgccattccagcattgcgcagtcgtcactttgcgaggtgctgctattgaaaatggtgatgaggctgttgtgcaacagtcgtccattgacagcccgaggtacaacattgtcgatgggtctcattccgacttcgcgcccagggcgaagtggggaggggtgctgcgcacatgcagtttgcgtggcccccgagcagggcatgcggtgtttgcgatccggtgagagcctttgcaacccattcattcataaattacatccgtgcgattcggcgcggcgactggggccggcagacgtccctttctccgccaatcccgtggggttcagggctacgcccgcactttggggctggccaggggcgtcatggcctgcagacagtgcagatctctgctggcctgggtgccgggcctcagagcctactccaccgctgccgtgggccccttgggcctcgcgagcgcgcaggtgcaggaccccgcccacgccagacgcctggcagccgtgcagggcatgaaggtggagcacgccctctccgccgacgaggcctccacctccgagctcgaggtgcgtgggtgggtggcatgtactcagtgggcatttgctgagactggtggagcagttgtctggccgagggtgtggtgcactcctgaggttgcaccggggggggcagacacagcagtgccagatttcgtctcagggatgatgcgctnnnnnnnnnngtgccccggggaggcagacacagcaatgccagatttcgtctcagggatgatgcgcttgattcctttggagtgctgccatgccccccaaccctacaacccctggaccgcccggcctgcagtagattcatcttcccgtcggcccttcatcccaccctcttcccctgctcccccccaccctaccaaaactgcagcacgagcgcgcgctcttccggctgcacaactcgagcatgaagctggaggggtccatcatccgcgcgcgcgtggtcagcgtggaccgccagcgcctgctggtggacaccggcctgcgcatggcctcgctggcccccgccgacgtcacgcccgacagcatcgtggtgcgcgcgcccggcccccgcgcctcgcccgccgcggtgctgcccggcgacgtgctgcaggtgtacctggagtacgtggagacgcccgagggcggccccctggtcagcgggcaggcggcggcggggcagcggcgcctggcctcggtctgggcggagctggaggcacgcttccgcgaggggcgcaccgtgcgcggccgcgtgctgaacgccctgcacggcggcttcgcggtgggcgtgggcggcctggtggccttcctccccgcccacgccgccagctgggccacgcagcagcgcacgggcgagctgcgcgagttcaggatcaggtccatgaacgccgcgcggcgcaacgtggtggtcgtggacgcgcggggcggcgggccccgtgaggccgcgccgccgcgcccgctgcgcgaggggcaagcgaggagcaggaacgtgaggcaggaggcggaggccctcaaggccgccctgggcatgccggtgggggcggggccgggcgatgcgaggcccagcgaggccaggcccgccggcgcagacccggccggccctgggcccagcttgagtgctgcctgatggcagggatggggcccagtccccactgtgaaatgcaaatcttgcaatgcccgacaaggttccggaaatatcaggactgggagtgcactcagggagtgggggggggggggggggggggggnnnnnnnnnnaactcgtcggcgatgcaaacagaaaatctccggccctaccgtgctgtgcatgcggcgctcaattcacttgttgcatnnnnnnnnnncatggaaacctcgtcggcgatgcaaacagaaaatcttcggccctaccgtgctatgcatgcggcgctcaattcacttgttgcatggacgaggataatgcagggcctcgaaaaacttgcgccccagaacgattcccagagcagcgaggcacgctgcgccacctccaacaatcctcacccctcacccgcattgctgcacccaaccaaatcaattgccggcttgccgagcggggtcccgagctgagatgcgcggttgcagcgctgcggccccccgggctcagtccctggcccagcgggcagcctccgggcatcgagcccccgccccagctctgcccaggcccaggagtgacgtgcaaacgatgtgggcgcacaggcgcggacggcgggcgtgtcgcctgcgagcggcgctcgttgagccannnnnnnnnncgcaaacgacgtgggcgcacaggagcggacggcgggcttgtcgcctgcgagcggcgctcgttgagccagtaatcgacttcacacaccaccgggaggcgtgggacgactggcccgacgatgcagaagatgagcccagcgttggggacgaaggtttcgatgaggacgtagagcccgcagaggaggctttcggacctcaggtaggaagtgccgagtggcgggccagggtttcacgggaagggagcccggaaggccagcgtcgcatttagaactcatgatctggtgcttcactcggcacccccccgccttcccctgtgaatatccatctcacaaccagcaactcccatgcactcttgcagatgctggtcgccgcggggttccttgctgaggagctggcgcatctgcgcctgatgctcgaccaggcagcagcatcagacttgccactcatacccgccacgccccagctcctggacagccgggtatcttctctgagcagcgtgaaggagccggactgggaggtgcccctccctgactctttcgttccaggcggaggctggggcggcacgcgagtgctgctgtgctctggtctcctcggggaggcccaggtccagttgtggaccctgctccagaactcaggccttgggaccatctacctcgcggtgatctcccctggcaatgcacatgaacgcctgggagacgtatttgcacaagcagtccaggtacgaggatgaagtgtgggagtgggatgtgccccagaaactttggggatgtccatgtccaggtgttgcttaggctcttgatgcagccggaacaggaacacatctcagctgtgtaacgtgcttttatcctcaaggctgagtcaccctcctcctgtaccccgacactcctcaaacaggagcagcagggggccgaggcggctggcgcgtcccctcccgtgaacgccgggggcggcggctggaggtggaactcggcggctgcgccgggcgcgggctctgacggcttcgacccagggagcgatgaggaggaggatggggacgaggacgagggggagagcgatctggaggaggagagtgaggatgaggatggcgagggtgcagtgtttgacgtgctggacgccgaggcctccggatctgacgaggaggaggacgaaggtgatttgttcggggacgaagaagaagctggcgagccctgtgccggccctgtcgtcagcaggcagcaggttctggaggccagccagagctggggtgttgacaccgaggccttgctggccgaggtcgaggccaaggggttcaccttgacgccctgagggaggcaggannnnnnnnnncgacgaaggtgattcgttcggggacgacaaagaggccggcgagccctgtgccggccctgtcgtcagcnnnnnnnnnnccacatctgacgcttcacaggcttctcaacgaccttcccacaagaaaagccaaactttcttccggacgttccggcacatctcccgatgcctagccaagagtggcaagggcagcggcagggtgcatcgtacactcgcacccaatgcaacgcgaacccagcaggagaatatcccagaggaaggctgggtggggctggaggggnnnnnnnnnnaccttgccgaatcccactctgtctctgcgctgccacatgcgcacctcacacgtctgtaatccgcctcaaacgctgggaagagttcacatctgacgcttcagaggcttctcaacgaccttcccacaagaaatagccaagctttcttccggacgttccggcacatctcccnnnnnnnnnngcgggggccgcatcgccctccgagggtgcctcccgccccagcaccccaagaccgtccgatgttggtgcgggggatccggaggatcccccttatgacccagatggagagggcggtccagctggtgcacaaatggatgaaaggctggccgacatgatctcctggctggctgaggtgcctgaagtggtgggtctgctcgacaccagacccctgcctgagtctccaaccgacccgggatcaatagccctggcccccccggtcgccccaggtgaggggaggatcacacatggagcctgcagtcaggccggcagtgaggccctgggcgcacttccggatgctgctgtgcttttcatccggaggacgcactccctcagggtatgagtcagaccatccctgcccgctcagccacaccccagctggaagctagcaacccgctaccaagccatgttccgcccccagatgtctccaccctgctgggcctgcctgacatcgaggacacaggattgactgatggaggtggggtgccctccccacccctcctcatccctagtctcgtccgacaacccagaagtgagtgggaaagggacggcactgactcttttggtagcagctacaaccacgttcgcaatccctggttcctcctgccattcgccctttagctgcctgcaacagctgcatgcattcgttggctcaaactgccatccgatcgttgcagagaggagggcgcatgtcctacgcgacggcgctctgacgatggtcgcctacggcgctgacgagatcctcttgtggcacaagagggttgccactttccagcaggccatgaggtgctcttttgtgggggggtgaaaggggaatttggaccctggacaaatgcggaccagggttttgctactgggtgctgctcctgctgctcatctgtgtatttctagtgactgtcattcgggttttcttcccctgcccgttgtcctatccttgcattcccatcccctgcaccaggttcaaaggtacacagtgtctcaacttgattcattcatccagcacacccttccacctcccctacaccctttcttggaccacttcacagggctgtgctgggggatcgacgccgtactttcctctggtccggctccgttctggactccgtcataggcgccttcctgacccagaacgtggccgaccacctctccagcagcgccttcatgatcatggctgcgcgctttccacccgccgctgacctggcacgacacgaccactccgattcggtggactgggaggcggtgcgctgcgctgacaaggcccaggtgggatggaacggcatggtgtcgtggcggcggaccgtgttttctccgtggctttccaaatattacatgcttggcatgagtcgccatgctgacccgacctctgaatatcctctcccatccaggtggctgatgccatcaagggtcgtgggatgcaaaatttcctggctgctaggatccacgactgcctgaaccacatccggagagtcaactgggcgcgctccaagggccaggactgggcgagcgtcggccatatttcggcgaagaaggaggctcagggccctggccttgagcctctgtcagttgcagcagatcaggagggtgccaacgcagggacagatccagggaaggccctggcggttgggcttccactggacctcgaggcggacgctgacgagctcgaggtggagggcatccctcgccctgagccgatcatgacgctgacgagcacacccatgcctgatccctgggacgaaccctgccctggcatggaggcccaggagctgctatccctggagtgggtgcgggacctgccaccaaaggaggcgcatgacttcctttcctcccttcatggtgggttgagtcgagtgactggtattctggagctgcgctgcctgccttatcctatgtttgaacctctaaccagttgcacagggtccacagaggctcccacaaccttcaaaacaccacgttgccccttcctggcctctgtaggtctcggaagaaagagcgtnnnnnnnnnnaggctcccataaccttcaaaacaccacgttgccccttcccggcctctgtaggtctcggaagaaagagcgtcgcttgcatcgtcctgctcaccctccgaaacaaggagttccctgttgacgtcaatgtgggccgcatcgcagcaaggtgagctgggttggcagggaaagactatcacactcacgcaggcatttactgtctaggtagtttgcacaatgaagctgaattagcacagcggcgagctcatcctccctacccgtcactgccagacttgggtggatccccctggactctgaggatgccgtggaggccttggacgactatgcgcccgagccagaggttcacaagtatctgcacagcaggtgggtaagacggaccatgcagagtatgaatccgcggaggagtgcagaggcatcccggctgggaattgcaggggctgctgagcgttcaaggtacaaaagcctctgcccagacgcccacgcacaccatcgccctatggtaatgaacacaaaccacttgaagtatctacacacgcccaggctggtcggctttgatgtggagacgctctacgagctgcactaccaaatgatcaccctggtgagggccagtgagggagggcatccaggaaagcagacgacctggccacctcttgcgggctcacccatcccctgcactgcctccgtgcaggggaaggtgttttgcaacaagctccgccccaactgctctgcctgccctctgcgggacgcctgcgagtttgccctgaacgggggcccagagaagaaagtcaggagggccgcggcccaggcgacgggtttcgcgctcgctcctcccacgccggacaagcaccgggagccccctgcacggccgcagcccgcaatatgccgcgcgtcgctggccatgcctggggagctggaggcctccttacccaggcccaggccggcgcacaagctgcactggaggcaggtgcagcgcctgcagcgcatgcaggcagagcaggacccggagcggggagcggggctcgatgccgtgctgggctcagtcaagcgaggaaagcgcagcaggcggggcggggctggcggagagccgggtgaagttgttgacctgacgtctctcggcggcctggccgaggacctgtccannnnnnnnnnatgggattgttgacctgacgcctctcggcggcctggccgaggacctgtccatggatgccgagtcactgcagcccatgattttgcactccgtcccacaaggtacgaagggagaggcggcgacttccacaccattcgagcaccggcattggatggcatggcacacgcctccctgcagctggctgcaaggtcgcgagggtgtgcccatattcttttgcttccggcgcaggaccactggcgggtcccccagagagactgggagacctggacgctgatgattcagacacccctgcgccatgtgtggagaaagggcagggggcggcgccggtgtccatgcgggacgaaatcagccccactccgcagaccgaggaggatcggcgaccggcgccgatgtctttgcaagacaacgtcctccccagcccaccttccaatgccgttcatggcgtgtgcagcaccctcctccagcccgcccatgcgctgttggaggctgtcgccagccaagccgctctgcccaaggatgaggatgaggagcctggaggggaccttggtcctgtgaaggaggacatcaggtgagacgcatgagttgcagccagccctgcaatggaatacacaccttccatcgagtccatgggcgttcatccaccgtcaaatctccatccaaaaaaacagccagctggcgcgggctttgcttggcctgccagaggacagcgagccccttgccaggcgccagcggtacaggcagctgtcccgccacgtgcaccccgatcgctgctcccacccggacgctcatgaggtgttctcggccctacagctggccctggaggtgctgcaggaggagatggtgcccgcccctgatatcgcggtgggggagcaggtgggctgcggcaaggaggatgctgggccccgcttccagagcgtggcggagctggggcggagcaatgatgaggctcttgggggcgtgcggaaccccgcccgtctcgtcctgcactgcttggcggtgccctggggcatgctgccgccgcgcctagcccgatacggcagcagccaacgccgggagcagcttcccctctttcttcctgagccgtgtgaggtgtcggcgcaagggagcaggactgcggcaaggatgttcgagcccgaagtgctgccgccagtggccggggctgagggcgcagcgtccccggtgccagttagacacgtagacatggaggttgatgctcacctggagaatcctatgagcttggcagccgagcaggggctggaggtccatgcaggggtggagactgacgcagtgctaactgcagacacaagcctggcggccgacgactctgtcgaccaggtcgacagatgtgctgcatgcttggaagaagcctcagacggtgcctcaccgggcaccatactggcatccaaggaggcagcctgctcgcctgccacccactgccgtggcatcgtcctcctcccagcgtcgacggccctcctgggcaggttcccgctgaatgggacctactttcaggtcaacgaggtatttgcagaccacagcacggtcaccaaccccgtagaggtagcccgagggagtgtggattatggtaatggttcttgcaaacgccatgtctatgacatgcccatgcggtccttgtctcgctgcaaaccggggaggggctcctaccaggccgagggtgattatggggacagcactctctactcccagccctaccctcccacaacccgtctccctgtagattgaactgtgtgaccttgaaggcagggactcagtgcctgtattcatcgggcactccatccaccacatggccaaggtgagggacagtggctgggtgtcttatgcgctccctgctaaaatgagttcaacttcgattgtcgtgtggtacgcagcactcacaccacatccgccagggcatggagtatgaggaggtcaggagcatgtttggaagaggccacgtctgcttccgggcgtgggactctgggacaggtgcatggaggggaacggcggggcaggaaggcgttcattctgcgcactgcgattctctctcgtcctagctgtgcactgctacgatgatagattgtaagaatgtgacgaaaactgcgccctcctctgcaggcaacccggaggcccnnnnnnnnnnatgggtgtcttatgcgcgccctgctaacatgagttctatttcgactttcgtgtgatacgcagcactcacaccacatccgccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacgatgatagattgtaagaatgcgtcgaaaacttcgccctcctctgcaggcaacccggaggccctcccgacgtggctactggcagggtcgggcctgaagaccaagaccaaatggaagaacagcgtggagagagccgcagatcgagcggcgaggctggcggctctgatcgagaagcatgggccccttgcggccgcagcactcggcgtgcaactcacgtcgccgcgggcgcgcgtgccagcacccccccgccccaaggcgccgccgcgagtgaagccggaacggcctggtcagcggcgccggtccttcttccccaccatcaggtccatccagaagtgtggggtctgcgctgcgtgcctgaatcccggctggaagaaagcgtgcctgaccaggagggcagagatggaggctctggcacagagcatactggaggctgatggcgcggaagagatccaggctgggccgggggctgaggtggacgagggggatgcggatctggccggcgaggaggaaggggaggatcttggattggcatctgaagacaaaggggaggctttggaaccattggctgaggaggaagggaaggcgcgagaccctgtggcgatgcatcctgaagacatgatacctgcgtgagcttctgggttcttcctcactgagcagccatagagtgctccttctgtaccatattgtgaacacattgatgccgtcccaagtgtcccccgcttgctggaattttcaactgatcgggccatggtgggaaccctcatctccaggcgctgtaaccattcccgttgtttgttccatacgccagcggagcttgctcaactctgcaagtttgcactctcacccccgacaccaagcaggttgcctatgacgggttgcttggcgcgttacaaaagcgatacagtcacaggcataatctggggacacaacggtaacgcaaggcgaggaatgccatgatctgaggaccgcttgtctttcggatcagtcttcatcgttctctacgtcagctgcacggcaagcagcgtgcgacgcttgctggcctgcaggccgactctgttggagtcaatctcagtaggatacacaaaaatccttgcccctaaagccatacgtggaggggatcgacccctctacgtccacagcttgtgtggggcgggtctgagaagggcataccgcatgcccactcagcggccacccgccgccgcgtctgagctggatcgcgccttgggccgggtggcctcgtccacgaggtacaccagtcccctgaaattaaagccggcctgcttgctcagcgcaatctcgcaggtgcggctggnnnnnnnnnntcggagcagccgtccacacccaggtgctgcagggaggagccagtcagctccggcagccgcatcccgcggtcgccggccatgccgcagcacgggatgttggagtccacgacactgccggcgcacttggatgccacctgggtcaaaggttgtgtgtgtgtgtgtgtgtgaggcggtggggggggttgtcgcacatgtgtgtgaaaggagggtcctaggcgcagccgttccaccagtgcaatctgtgttaggaagcacactttcctgcacctgccagctgaatgcaagaccatttgtatccagccctgcaactcctcacacatggttgtggcccatgcaacgacctggctctgtgcatccaccctccttgtctgcacgctctgcgcaccttggcgaagtgggaggagacccccatctgcttgctggagcaggggacgtggatggccaccttctccctgacctgctcccactccagcttgtcggtgaggaaggtggagatgaattccacaggctcgtacagtgcaaacctggacatggtagggaggaggatggcagggttgagtgccagggagggtaggggggacagcgtcgccagagagtgcttggcaatctcaaaccacctgacataaccttctcctgcagaagagacattggcaggctgcatctcttctgtcatgacccacctcagatccttgttcttcaggtggcccttgatgttggcaaggcagggggaggtgtccacaacaatcgggtacttgccgccctctgcgaattgattcagggtgatgggatgtcgtgtgaggaggagggagaccaggatggcatcaagactttcggtttcctccattgtttgaaggcattcactctcccaggcccagccaaacactcgtgactacacatgcctgcagctgacatgcatcctgcctccactccatccaaaaccactcaccagaagccttcacgagcgactcctcaaggtcgttggccaggccatcagccacatggttgaagccacgggtgttgaacatcatgccgcaacagctgccagagaagccctcagggtacaccacctcgtagtcggccttgttgaacagagacagcatcttctcgtgcacagagtctgtgggtatgtgtcaggtgggaggtgtcgagatgtttgtgaggagttggaaccattcccaaagaagtgcaccactttgccacatggtgttggtcatgtccatggattgcctctatcccatgacatctagacccggagtggctcacagggcaatccccaccacgccatgcacgtccagacccgccaagccccaccccttcgtcagaagccaggtatccactcaccctgctggtcgtnnnnnnnnnnaaggtgttgagatgtttgtgtggagtttcaaccattcccaaagaagtgcaccaatttgccacatggtgttggtcatgtccatgggttgcctctatcccattacatctagacccggagtggctcacagggcaatcccctccacgccgtgcatgtccagacccgccaagccccaccctttcatcaggagccaggtatccactcaccctgctggtcgtcgccgcgcgccggacccatgatccgcgtcacgcaggcgggcaggtagaccaccttgcgggggatgccacggtcggtgaccagctgctcaggctgggcgggggacatgtccacgttggccgcgcgctgcgaaggggaagggggggcttaggagatggggaggtagtaagggaggcggtcacagaagtaggatgactgaagagcggagcccggcggatgcaaacttctccggccacgctagtgtgctcgttgacacacgccaatactgcaataccgaggacatcatttttgtgagccgacacatccctccgaacagtcaccaannnnnnnnnncactgcaatactggggacatcatttttgtaagccgacacatccctccgaacagtcaccaaacgacccgcaccttgggcatgtaggggttccattcgggcacgagccgccccgaccaccggttcagcaggcctgtgacgctctggaggaaagagggaccgagcacgccgtgcgccacgtcagccaggcccagcacctgccgcatcgtccaggccagggacccaaaccgccgcgccagcacctgatgagggggagtgaagggggggcgagtcagcgatggcagaaaacatcaaggaaagggtctattcagaggatccaccactccggtactgggcctcagcatcccccctcctgcgcctgcatcccccctcctgcgcctgtatccccgcctcaccccagcaacggcatcgtagcgcgggtgctcatcctgcatctcgtgcnnnnnnnnnncgggggagtgaaggggggacgagtgagcaatggcggaaagggtttattcagaggatccaccactccagtactgggcctcagcatcccccttcctgcgcctgcatccccgcctcaccccagcaacggcatcatagcgcgggtgctcatcctgcatctcgtgcgcccggatctccttgatcagcgccccggtgttgatcttcacggggcacttctccttgcacatgccgtcggcggcgcaggtgtccttgccgtcgtactcgtagatggtcttcatctccttcagactggaggcggatgaagaggaggatgttgtacttggtgggtttctgggcggaggaacattctgtgtcgctgctttcaaggaggcactgcaaatctcggaccctcctgggtctgcaagtccaaccataaccttcctctcatcctcatcctcaccggtgcgtctgctcgtcggtcagcagctccaggttctccagcctgaagatctccttccagacagcaatgcgctggcggggcgtcagcgtcaggtcgcggctggggcagttggactcgcagaagccgcactcgatgcagtggttgaccagggggttcaccggcggggagggcttcaggttcttcaggtggatgtgggggtcctgtggttgatgcggggggaccagagagggaatgagtgggaggggggggcagaagtgtgtgaggagggcaagtatggcacaatggcccctcctcgtcagacaggcatgcaacacttcaaatgcatgggaagcaattcccgtgagtttgcaatagctatctcgatcctctggggcggcagtctggggcggcagtctgtgccaggtgctgcattcaactgccgtcctgacactggcatgggactaaaaccagctagctcatgcttcccctgagccccctcccaccaacaatgctcaccttgttcaggatgacgcctgggttcaggatgttgtcgggatcaaacagggccttcagctcccacatgagctccgtggccttggtgcctgcacggcgtggacgttgaggagccaggtgactctttctattccttggaaagggagaacacgaatagcaaagaacgctctgccatctgaacctcatttgcattgctgtgtcctcgatgcattctacaatccccatcccctgtacttaaaactcccgacatcttaaaagcggatgctaggctcactctcaatctcaaacccttcccccccccctcccacccctttttttctggctcaccccactccatctccacgtagggcgnnnnnnnnnngtcgaacccttgccgccccccctcccaccccctttttttctcgctcaccccactccatctccacgtagggcgccatgttgcgcccggtgccatgctcccccttcaggctgccgctgtgcttgttggccacgatgtcgcacatctcgtccatcaggtccgagaagcgctggacctcctcgggcgtgcggaagccctgcgcaacaggcagggcgggttgggtcaggttggggtcaggttgggtcgggttcggtcgggtcgggtcggacatcaatcaatggacggagatcccccctactcacacactcgcccaatcacccacctgcgaaaagacgaggtgcaggttgccctccagcgcgtgcccaaaggtgtaggcatcgtcgtagccccagcgctggaacatgtctatcaggtcgcgcgtcatggccgccaggttgtccacagggcaggccacgtcctccagcagcatggtggtgcccggctctcttgcgccgcccacgatggggatgagccccttgcgcacatcccagtagacattgtacttggccgggtcctcccagaactcgtagtcggtgacctgcatgggcgcgtcggccttggcgccaaagggcagctccgcgcgcttcagcgcacactggatctcgcggatgcgggcgtgcagcgcgtcgtgcgtctgcccccggcactccaccagcagcgcggcggcgccaccatcggcgcccaggatgtcgggcgtcagcttggccaccgcctcgttgcactcgaactcgcggatggaggggcggtcgaagagctccaccgcgtccaccgccgtctcgcggcgcaggaccgccgccgccacgcatgctgcctcgatggtggggaacatgaggaaggcgctggcctggcgggggcgggtggatggggggggagggggtgtgagtgtgtggggggccggggcatgagagggggagggaatttgacctgcaacccccaagaacgatgacatgcagccgcaatggcactaacgccgtcggaaagcccgcaagagggatgccagaggaggnnnnnnnnnntcgcaatggcaccaatgccgtcagaaagcccgcaagagggatgccagaggaggagcgaaacacacagggaagctctgtgacactgtcaaaaagcgtgttccggccagcaacagcaggggtgtgtccccgcagcaatggatcagcccatcccagatcagaggccgctggaagcagcgaacagcagcgcgccttgaagggccactcggggacggtattgtaggtggcctgggagacaaagctcagggtgccctcactgccgaccatgaggcgcttgatgatctcgatggggtcgtccacagggaagtcaacctgacagtcagagggagggggtatggcaagcgtttggcagggacatggtaagcactggcctgagcatggcatggagagccagaagccatactaccctttcaaaccctctttgcaatcctaaccagcattggggtactgtgatcagcgctactttgactgtcctccgctctcccaacaagcggcagtacgtccaccctggccatgctcccatggcacacgaaagcaccacccaccaatgtctctcaccagggcattcaaagagtagccagtagtgcacttgatcgcaaacttgcggcggatgaggctgaccagcaggcgatcagactgcaccctcttcaccagcgcctggagccccttgaccaggtcggcgtgcgactgagcaagtgtggatgtggagaggcaatctcagccccaggctcctcaaggtgctcggccatgcaaacagcccatccatcctccccttggccctccctgatgccatcagcaaacctgttgtcctgatacagaggcacacagagtcccagccctgcggccttccagatactcgatgacctccctgcatccccactgtcgccaaaggttcccacctcgaggaacgcagcgcggnnnnnnnnnntgatgacctccctgcactccaatgtcaccgaaggttcccacctcgaggaacgcagcgcggctggcttcgtccccggtgtccagcacggtaccgtcggccagcaccagacggatgtccttgagcgtgttgtacgtgttctgggacacgccacagcacatgccggaggagttgttgttcaggatgccgccgatcatgcagctgtcgatggaggaggggtcggggccgatcttgtattggatgggatggccccccttctgcttgtaggcggccaggatgcggttcacctcacccccgatcagccccggctggagcgtgatggaggagccatccccctgtgcatgaggcgatgtatgaatggaaggtcaagtgggggtgatgagagctgagacaccaccagcatcctgttgaatggacgtcaagaagggtatgggaccatgcatgggcaccgcccctcgctgtggctgccatggtccaaaggacaggagtcgcactctttgcaatggggccaccttgaagtcctttctcgactctcccagaccagcactgtgcagccagggactcatccccactccctttccccctccaccctctgaggcctcacgtgcactttgaagctccgaaagtnnnnnnnnnnaactctcccagaccagcactgtgcagccacggagtcatccccactccctcccccacgccaccctccgaagcctcacgtgcactttgaagctccgaaagttcttgcccacatggctgatcttcagcagcacgctgtcggtcagcgcctgaccggaaagagaggtccccgccgctctgaaggtcaccggaacgccgtgcttcttggcgacgggcagcaggcgacgtatctcctcctcagaatgcacctggacgacacacccacgcaagtgtcagaatctggatcggccaagggaaggccttcacagcgcaatgaatgacatgccatgcatcaaggcaaacnnnnnnnnnntaatctggatcggccaaagaatggccttcacagcacgatgaatgacatgccatgcatcaaggcaaacgacgcagagagccagcgtggcggtctgctccgctcccaagagcaggcatcccaattggcctacttaccttgatgaccatcttggggtttaggcggtagaaactggcatccgtaccgtaggcaaaagtcctcacggggtcggtgtactggcgggacttggggatgaaggctgcacgggtgcatgacagtgaagatgaggtggagaagtcctgtgcccaggcagctcccaaggcccctggtggcccctatcggccaagccagatcaggcatcgcaacttccgcaatcagaggcctcaccgctgatctcatctgcgaaggcggtgtaccgcccgtcgtcgatgcgccgtccgtcgatgttctcatacttggtgggaacgaagtcgacgttctcctcctccacgacagagatggcgccgtaagcgtccgtcctcgtcaggggtaccgagggctccgccactcgctcggcctgggctgctgcgccagtcgatggggccgagtggtaggcatgagtacccttcactgctggcagaccagccatggccaggcaccccacagaggcgacgccatccctcgcgaaaggcagggctcggtcctggcagtgccaggcccaggcccggctcctcgaccggaggagggacgtaactttacttctcatgagaccaggattggtgtaatgaatttattttccaacaaaccgctggagcgtcacttgcctcagcatgggcacaggatgccggcatgtggcatgtggtggtgagaaggacatgggaaatccgagtaagcatgcgcagcagcagatgccgaggcaggggatgggggtcatcggcagtgccggatgaggtggctcagcgttttcgggcgtgtccaccactcccacattcccaaggtttcctcctcaatctccccgaaccgcgagcttgacagggtgctgctcctgagcccttaacccagatgcagaacctcatccgggccacggggcatcggtctcgatcacacctctccgccctgtcgatccctcttctccagcgggatggggtgagcacacgaggctattgagggtcgatcgaggcgaaagatgtcctgctttcacgacaccatgttccgcaccccattccgtgcacctccatgccctcgcccccgcagaaacgtggtttcgccacctcatcgggcgaggatttttcgttcacccccgccgggcgcaaccatctcttcgtgccaggcgagtcttctttgggaagtttcatgtgttggcgatccactcaccgtattttatctttcgtcggccagggattgacgaccggatcagtgaacctcccacctcaaataaccccctggctccacaggcccagtgaacatccatgacgatgtcctccgcgccatgtctgtgcaaagccaaaatcatagggacgcttggttcgcccccttcttcaagtgagagcaactcaaggggaagagtaggggtgggtgggcatgaactgagatgcgcatctgctcagggtctggtgccgatttcttcctggcaatgcaccccagagccttcctctgacacttggtcatggagccggggccattgcagtgaacatcgacaccgctgcggcaaactcacctatgctctctgcttgaaaccctgcaatcaacttccacattcacgccttcctcctcaacccccccctcaccattcagggagctgctggcctcggtgaagccggtnnnnnnnnnnctgccgtggaccctgggccattgcagtgagcatcgacaccgctgcggcacactcacctatggtatctgcttgaaaccctgaaatcaacttcccacattcacgccttcgtcctaaatccccctcccccccccaccactatccagggagctgctggcctcggtgaagccggtgtttggcacgactgcggctacgcccttcatcttccccggcactgggacagggggctgggaggcggccctgtccaacaccctctctcccggcgaccgggtggtgaccttccggtacggcatgttcagccacctctggatcgacatgatgcagcggctggggctggaggtggaggtggtcgaggggcgttggggcgacggcgcttacgaggacaagtgagcggcgacggggccccgagggtttcggcccgaggtgttgcagtttggtgggcgcgcttgagacctcctcaccctcgacggcacagatgcatggcctgctggctcgtcttgctgtctgtgttcagcgggcctgtggttgccctcggcacccggctgccaccctttcatgacccagttcgtggcctgggtcctctggcagcacccgccccccccagctgagcgtagccccccgcgcactccccgcctccacaaaacaggctggcggacctgttggagaaggacacgtccaagggcatcaaggctgtgtgcgtggtgcacaacgagacggccacgggcgtgaccagcgacatcggccggatcagggagacgctggacgctgcctcgcaccccgccctcctcatggttgacggcgtctcctccgtgggcgccctgcccttcaagtttgacgactggaaggtggacgtggcggtgacggggagccagaaggcgctgtccctgcccacgggcctgggcatcgttgccgcctcggacaaggtgcacagtggctggtgtggtgtcggacacagtgggaccagcttgtcacggtgtggcactggatgcctgagggaagggtggctgtgcctcgccagtcgtctgcgaaggagtccagcatcgcattggagccggtggatgggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacccgtaggccctggatgcccgctcgagtgccaagctgaagcgcgtgtacttcagctttgacgacatgctgaagaccaacaagaatgggggggtgccctacactcccatcctccccctgctgcacgggctgaaggcgtccctgggcctgctcaacgcggagggcctggacaacgtctttgccaggcaccacaggtgtggggctgcaaggcaatggtgtaggctggtgccggggcaatgggggggtgttttcctcgtgcggggacatgcctctgggctggtgtcgcaaggcacgtgtcaggtgggctttgctcaatgcagatgacgtgcttgactcatgacccatccgccacatcttgcacaagccctccagccccacatgctggctcccttcctcccccgccatgcagactggcggaaggcacccgtgcggctgtcgccgcctggggcctgaagctgctgtgcagggagcctcggtggcagtcggacaccctgacagtcgtggaggtgcccgagggcgtggactcgcagaagatcgtcgacaccgcctttgccaagtgagagcagtgggtgaggggtctctggacgtcaatcggggcgcaggtggagatcccctttcccaagcttcccttgccgtttcggtgcatttccatgcatgtcggtactctttccactggtcccccccccctcctcctttccccctcctgaccatcctggcccctgccgcactccttctacccacgcctccccgcccacgaccctgccccccttcccgctccacacacaggtacaacctgtctctgggtctggggctnnnnnnnnnngtcccaagcttcccttgccgtttcgctgcatttccctgcatgttggtactctttgcactgggccccccgcccccctcctccttccccctcctgaccatcctggcccctgccgcactccttttacccacgcctccccgcccaccaccctgcccccctccccgcttcacactcaggtacaacctgtctctgggtctggggctggcggaggtgcagggcaaggtgttccgcatcgggcatctgggcaacatggatgagctgatgctggctggcgcgctgggcggcgtggagatgaccttgcgcgacgtggggctgcccatcgagctgggctccggcgtgggcgccgcgctgaaggtctggcaggagggcacgcccgtcattcccacgcgcgaatgcctgatggcgtgagggggctccaggtgtggccctcgagctggggccctgccccccctgccccccccc

SEQ ID NO: 33970 - DNA, 61 bp, Chlorella protothecoides
gtgggcgtggaggctgagtgcggcgcgctcgcccggcgcgtggcccccagctgcggccgag

SEQ ID NO: 33971 - DNA, 76 bp, Chlorella protothecoides
tgtgttcccttcagagtaccccttcacatctttctccacaaaataacccacaggactgcctggactttgttcggcg

SEQ ID NO: 33972 - DNA, 78 bp, Chlorella protothecoides
acctcaatgcggtgagctgcacccatctctcacggctgtggggagtaaacggcgcatccctcacgataaaacagtgct

SEQ ID NO: 33973 - DNA, 75 bp, Chlorella protothecoides
aaggtcagtcctctttgttgcgtgagggggttgaaagtggggtgattagatgagatcggtgcccaagaaaccctg

SEQ ID NO: 33974 - DNA, 61 bp, Chlorella protothecoides
cggcgctgctgccgttgtacagcggcaggggcagcgtctccaggccgccgccggtgagcgg

SEQ ID NO: 33975 - DNA, 85 bp, Chlorella protothecoides
atcgtggggtccgtcatggggtccgtcatgggggccatcatgaggtccatcgtggggtccatcgtggggccctttgtggggtccg

SEQ ID NO: 33976 - DNA, 3963 bp, Chlorella protothecoides
  modified_base (110)..(135): a, c, t, g, unknown or other
  modified_base (1051)..(1060): a, c, t, g, unknown or other
  modified_base (2830)..(2839): a, c, t, g, unknown or other
  modified_base (2964)..(2973): a, c, t, g, unknown or other
  modified_base (3651)..(3660): a, c, t, g, unknown or other
gtcggggccggcggggggcgggggcggggctggggacccgctgaccagccagacggtgggcgcgccgaagcccgaggcatccagggaggaggagatggccgaggccacgnnnnnnnnnnnnnnnnnnnnnnnnnngggggacccgctgaccagccagacggcgggcgcgccaaagcccgaggcgtccagggaggaggagatggccgaggccacgctggatgtgccgagcacgctgtcgacggaggtcgccggcagggtggtggtgtaggacaccgtcagcagcagggtctgtgcgccggagggcacgctgcccgtgtacccgtactcgctgggattgatcgacgtctgtttgtgtgggtgggtgggtgtgtctgtgcgtggtgtggtggtcgtggtcgagggacagcgtgggcggcgtggcgcacgtgatgggtctccatcctgaccccggatccggcaaccggcccgtcgggtccggccatgcccagccaccctccctcgatccccatgccctggccctgctagcgcccatgccaccccctgccccctctcctcaccgtggcgctctccagcgtggtgtcggcggtggtcatttcgtaccccgcgtcctcgatcgcggcctggaaggcggcattgatggccgccaggaagacggtgcggtccgaggtgctggtcaggcggaaggtggccaccgtcccgccgacgaagatgagctgggaggtgagggtggcgccgccgccggggggcgggggcggcggcggcaccgccagcgccggcgccgccgaggcgaaggcacgcagggtggtgaaggacagcgtgccgtccgacgcggccagcaccaggtaccgcccgctcagcccggcgcaggtccaggcgccggcgccgctgccggcgctgcacgccgtgctggccagcagccggcggccgactgcggatgccgtggtggcggcgcgggtctccgcaccgagccgctccgttccagcctcgccgcccgccccagcgacccccgcggcatcgacacccgagggcgccgcgcgcaggaggcgcctgnnnnnnnnnntgacgcgggtctccgcaccgagctgctccattccagcctcgccgcccgcaccagcgacccctgcggcatcgacccccgagggcgccgcgcgcaggaggcgcctggacgagggcgaggtccccgccagcggattgctggcctgcagcgacacaacgcccaggcccgtcggcgagccgaccaccaccgaggccaggctggcggtgtagcccaggtccagcacgaaggaggggctggaccccgcgatgcccagcttggcggcggtggagaaggacgccagcgtcgcggtgccggaggccgtggtgtacgtcgccgccttgcccagcgccgcgtcggagacggcggggtagacctgcaccccgcacaggcccagtgtggtgccggacacggtcacgtagcgcccgctggcggcgcaggtgacggccacggtacccgcgcccagcaccaggcccgaggcgcaggtggtggcgtcggagccgtcggccgcgacgccgaccgacaccgcgccgcccgccaggccgttgcccgtcaggaccagcacgacggaggccagcgcgtagctggctgccaggtccacgcgcacgtaggaccccgtgcccgaggcggccaggcaggaggaggtggagtgcgacgtgaccgaggccgcgcccgaggccgagccccaggccagcgcgccgtaggcggcgtcgccgcccagatagctgcccacgggcgacccggtgccatagcaggggatggtgaccgagctggcagtgccctgacccagcgtcagaaggttgccgcgggccaggtcccaggcggtgacattggcagccaccgccacgtcaaataggttggtcccggtcaggcctgccgaaggaggcgggggagggggggatgatgaagggcgagtggaagtgtgtgtgtgggggggtgatgctatgtagagaggttggagtcgaggggcttcacgaccgcccccccccttcccacttccggcgccagaatccaggggctgtggatttggggcaagatctgcgctcacacatgaacccccgggccctcaccaggcctccaccggcaatgcagccgcaccccagcacgcacgagcccattctctcgctcgccacccctgcgacgcactggtggtgacggtctggctgcagggcacgaagcaggagcccagggagttggcgagcgcgaagctggtgccactcgaggagtatgtcaggccgggggaggccggcacggagccgcacaggctggtggtccccgtctgcggcagcacggctacgctggcagaggagggcaagcccttggaccaggtggggatcgagcctgggtgggtggggggtgggggggccgcgcatgggatcgtgcgcgcagatcgcgcccgggcgcgtccagggacgagaggctttggccaaggaggcagcgttcggaatccgcctcgcgaacacctctcaacccgtacccgtcagtgcgttgcccacaaaggtggccgccttcagcgcggtgagggtgagcgacccgggcaggctccccgtcatgccgttggagtcgagggccagggtgaccaggttggagcagcctgaggaaaggaggaagtccatgggggtaacatggatatgcggccatgtggccgggtggatgcatggaggggagcttgcgcacgagtgtttttagaaaattgcagagggtgggcaatcattcagtgacccactcccccttgagcaggtgctgagggtgctgacggggcgccaaccccacccagtcgcccacctcccgccccannnnnnnnnnttggcgccgctcaagttactggcagggggggaggtggatgggcagcgggtgagggtggatgccgatgtgccatgcaggaaaaggggggagggtaaaccgtgtactgccggagcagtggcgccagnnnnnnnnnngtacatggatatgcggccatgtggccgggtgggtgcgtggaggggagcttaagcatgagtttttccagagaagtgcagagggtgggcgatcattcagcgacccactccccctcgagcaggtgccgagggtgctgccgggcgccgaccccacccagtcgcccacctcccgccccaaagttggtgggcagtgccgagatggcgttggccgtcaggttgaggaccgtgagcgagcccagcgcagcgccggtgttccaggcggagggcacagagccggtgagggagttgccgcccagcagcagcgactgcagtcccgtgagggcggcgagtgaggccgtcaggctgcccaccatccccgcgccgctcaagtcactggcaggggggaggtggacgggcagcgggtgagggtggatgccggtgtgccatgcaggaaaaggggggagggtgaaccgtgtactgccggagcagtggcgccagacccagatcaggcatggatggaagtattcgaagccatgggcgcagcacgatggtacagcagcgcaggggtccgacgaaggagcgcgcgcgcggccaggctcccacggcagattcgattgtcaagctgtggaatccgcacgagaatcatgcaagacacagaacccccaatcccgcccgactcacagcgagatgacagtggtgtcnnnnnnnnnntggtggtacagcagcgcagaggtccggcgaaggagcgcgtgcacggccaggctcccacggcggatttgattgtcaagctgtggaatccgcacgagaatcatgcgagacacagaacccccaatcccccccgactcacagcgagatgacagtggtgtcgtcgctgtcgcaggtgacgccgctggtcgtcccccagctgcacgggtttgccacggtgctgctccaagtcgtgagcgcagtaatgctcccggcgttggtgatcgcggccttgaaggtgagcagcgcctggccctgggcattggtgga

SEQ ID NO: 33977 - DNA, 78 bp, Chlorella protothecoides
actgccacagcccgggcgatgggtgcgcaacctaggccatgggtgcttgggtcgccaggagacagtggctcctcggcc

SEQ ID NO: 33978 - DNA, 72 bp, Chlorella protothecoides
tcagacacctgtgctgccgtccgtccgtggccaagcaggtggcatgctttgcaccagcccctccctggcgtg

SEQ ID NO: 33979 - DNA, 121 bp, Chlorella protothecoides
gtcagagggcatcccgaggcctgttcccggtgggaacaggagtcgcacgggcggcggggcgtgcaccatgacacaccgtgccacccaccggggtcgcgctggtgttgtaccctctggcgca

SEQ ID NO: 33980 - DNA, 61 bp, Chlorella protothecoides
ctgacaatttacattcataccatcatctgtacctgccaccctggcatccgcagcacatcat

SEQ ID NO: 33981 - DNA, 74 bp, Chlorella protothecoides
cgcacacagacatgttacaccccgctccgcgccacgctcgagagcctggaactcgacaagccctccgctgtcct

SEQ ID NO: 33982 - DNA, 73 bp, Chlorella protothecoides
gaccgccgaggcacgcgagaccgaggccccccgagggggtgtaggcccacgaaggcaggccggaatgaccgac

SEQ ID NO: 33983 - DNA, 66 bp, Chlorella protothecoides
tgagctcaaaaagcagggcagcgcatgcgcaccgcacccgccgcttccctccagaacacctcacca

SEQ ID NO: 33984 - DNA, 61 bp, Chlorella protothecoides
cccggcctccaccacgcgcccgccgcccacgaccgcgatcacgtcggcgcccaccacggtg

SEQ ID NO: 33985 - DNA, 309 bp, Chlorella protothecoides
atgtccttgcagccctcctctgcggcggggcgtggcaggggatggggagtgaggcaaggccatttgaccccaggaggctggactcacatgcgccacgcacagcccctactggcgggacggtgccaccgggaggcacgctgccgcgccaggcgagcccttgcgctctgcgacggcgcctcccgtcccccacccacgccggggcacgctccagcccacccgggtcgcccctggggcgcggccggccccccgtgaccgacgcgaggcacacatgcactcgcagagggcatggcacggcagggtgccgcctgg

SEQ ID NO: 33986 - DNA, 61 bp, Chlorella protothecoides
ctgtggcgacaacgccgggggtcacgaggaggcggtagatgagcagcaacgccacggcacg

SEQ ID NO: 33987 - DNA, 80 bp, Chlorella protothecoides
gcggctgggcgtgggtggtggaggtgggtattatctttctttctttcttggtattttgttttgggggatgggggccatgg

SEQ ID NO: 33988 - DNA, 70 bp, Chlorella protothecoides
gggcatgctgtgcgcgtacgacgtggcgcgtgcgcaccctggcctggacgtcagctgctacacctttggc

SEQ ID NO: 33989 - DNA, 111 bp, Chlorella protothecoides
cggccagcagaccatcaggcatgcaggccctgagagggagggtgttgtgtgggagctgggcgatggtaggtgacatggactggatcattccgactcccagagggccatcct

SEQ ID NO: 33990 - DNA, 92 bp, Chlorella protothecoides
cagtgtgtccaccatatacaagcccaatctcgtccctgtagaagcacgcatgtgcacactaacttgtcaacttgcgacagatcatgctgacc

SEQ ID NO: 33991 - DNA, 61 bp, Chlorella protothecoides
ctcggcggctgagggcccgcagccgagcggtgaggtccagggcctgggcctgggcgttgcc

SEQ ID NO: 33992 - DNA, 109 bp, Chlorella protothecoides
catacacgtttgatgatccgggccaggatctcccatctgccgcagccccacccagccagccagcaagcccccccttagtgggcagtcgaccacaagcccaacctcgaaa

SEQ ID NO: 33993 - DNA, 239 bp, Chlorella protothecoides
ccccccgcgccagcaagcctgggtggcgggggaggttgggcggggcagaagggtttcatatgtgggaggcgagcagggatttggagtctgtgaccggacgccacaatgtcgtccccgaatgatccccggggctcccaatgccggttgaactcgccaccctagcttcccccccacccaaaaagaaaagatccccaacacctcccctcacacactccgccgccgctcaccgtacttggcct

SEQ ID NO: 33994 - DNA, 77 bp, Chlorella protothecoides
ccagctgcagggcctgcccgccgaggtgggtgggcgggtgggtgggaccgcgagggcagaggggcgtgggcatgtgc

SEQ ID NO: 33995 - DNA, 443 bp, Chlorella protothecoides
  modified_base (172)..(333): a, c, t, g, unknown or other
tcgaggcggagcgcatggcagcgtgaggagctgttgtaggcatgggtcattgggtgtgcagctgagtggccctggattccggggaccatgcccagagcaccactgcttgggagcgacgccgtggtttctcaccgtcacgcttgcaggttcttcagggctcccactgctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcgtggatgagggggcggtgtcaagcgctcacaggcacccaggactggcgccacgcatgtcacttgcgtgcagagccccagagcctggacgtggggtgaagcatggg

SEQ ID NO: 33996 - DNA, 77 bp, Chlorella protothecoides
gctcaatgatgagccgatggccctcctgtccctgccccccccgcctctgtaccccacctctggcgaccgccgctcaa

SEQ ID NO: 33997 - DNA, 61 bp, Chlorella protothecoides
tgccaccgtgcctgctccggcggctcccccggtgcccagccctccgccaaagccggcgcca

SEQ ID NO: 33998 - DNA, 61 bp, Chlorella protothecoides
tgcgatgtcagtgttcaaggtgccctgagcaggttcactcttggacacagggtcgtcaccg

SEQ ID NO: 33999 - DNA, 11018 bp, Chlorella protothecoides
  modified_base (380)..(389): a, c, t, g, unknown or other
  modified_base (495)..(504): a, c, t, g, unknown or other
  modified_base (1789)..(1798): a, c, t, g, unknown or other
  modified_base (2005)..(2014): a, c, t, g, unknown or other
  modified_base (2193)..(2202): a, c, t, g, unknown or other
  modified_base (2676)..(2685): a, c, t, g, unknown or other
  modified_base (2942)..(2951): a, c, t, g, unknown or other
  modified_base (3665)..(3689): a, c, t, g, unknown or other
  modified_base (4373)..(4382): a, c, t, g, unknown or other
  modified_base (5044)..(5053): a, c, t, g, unknown or other
  modified_base (5781)..(5790): a, c, t, g, unknown or other
  modified_base (8167)..(8176): a, c, t, g, unknown or other
cggcccgtcgggcgcgccgccgcggccgccgccgcgcgcttggctcagccagtctggagcgcgggaccttcgctccgcgggcgctgccggctccagccggccgctggagggcgacgtgggcgccacgggcaactccgtgcacagcgtctgagccgttgcgccatgccctgcccgccagtcactgcagctcacataacccacgctgctcggcatgttgaaagcacagcaaactcgggggcggtggtggttggtgacagcgcaggcgggatgatggggatgtggtgacggaaaggggggttgggtgccgtgaagcatccagccgcggccgggtggtgagggtgtgggggcttggaaaatgggcagttgggttgggggggggnnnnnnnnnncggatgacgagacttggtgcgctttgcaccacagccaagctgcacgtgccttggcagaggcacacgacatcatcactggcagtggcgacgaaccatcccccggaannnnnnnnnntcgtgccatcgcttgggcaggcaacagcatctgatgggctcagcaggaagcaggtgtgaggcggcaggccaggccgaggatctgggctacgcctgcgatggggagggggtggcaaggagaggtggatgacgagacttggtgcgctgtgcaccacagccaagctgcaagtgccttggcagaggcacacgacatcatccctggcagtggcgacgaaccatcccccggaagacagtgcgaccccatggtcgcgcgcacccgacacataggcactcgagaaccctgcaaagtccactgcattctggatctccctgcaggtgtgacgagaatgctcgaggtgtttggcacgctctcccatggctcatcactgcaaacgtgaagcgtcagcgatctagctggagttcctggctgccattctcccagcatacgtcccacgtactgggtgcacaggcacttcccgaccaacacaggccccaggccagagcaacacctgtgagggatggcaggaactgtttgggcaacagaaagtgcatgagcatcagcctcggtatcgtgaaatctgccactgcactcctgcctcatccccttcccctccccccagacccaagcatcaacataccctgggctgggctgtgcggctgccaggagggaggacagggagtccaggatctgctgctggtcaggtagggccgtcgcattccttgggtagatgagggacacagtgtccctctccgcgttgcacaggtcgctcacggtctgtatctgggtcacgcagtcgctggacgggccagctccctctggcacgacagcatcaacctccccttgggaagtcgcaattatccagcagcttgccatgacacacgcccacaggtatttcggagccattacaggattatgagacgaccttggtgcgctgaggagggcggggtcgaggatttcgcgctctcaacgtgcccttggagtcccgcagcacgtccggtcggtttgccccggcacactctttacttctaccgggagcaaatgaagtattcctccgatcaatccacaagcttgatactgtatgcgcgcaaccagtacggcgctccgactttctggctcctccaagtgaggaggctgggggcgaagtaactgcacctaggcggcagctaggtcggaccgacggttatgtaggccagctgtgacaacagcactctggagaattcgcagctttagaacatcatgcccgactcagcgggttttcgtctcatgacgcactccaaagggtgggtgctctgttgccagcctggcnnnnnnnnnnaatcatgcccgactcagcgggttctcgtctcatgacgtactttaaagggtgggtgctctgttgccagcctggccctgtgcactcatggcaacctggtcacactcagatcattacagaatatgagcacctgcaaggatgaggatccacccgcgtgcggtgccctgcacacaccaccatacaccatcagcagcgggtgctgatgtgctnnnnnnnnnngcgtgtgcagtggcctgcacacaccactgtacaccatcagcagcgggtgctgatgtgcttgttgtcaagccagtggaaatcgaagtctgtatgtgagcagcatggcgcgcggatactcggtgcaagggtgaccaaggcgacgcattctggatttcttcctataggcccacgatgctgcnnnnnnnnnncggcgcgcggatgcttggtgcaagggtgaccaaggcgacgcgttcaggatttcttcctataggcccacgatgctgcgcccctgcccagcggacagaccaacgtcaatgtcctcctcgatgcccaccctgtccagcgccagcaggggcacgccgtgctttccagaagggaagcatggcccgtccaccgaggcccgcgcgggtttggtggtgcgcttctttggcatgaacaccaggcccctcttcttggcggggaccggggcggcagggtctggccggacgtttgccgccacgttctcgtcgccagcctgtgggtgctggtgatgagagggggcacacatgttgatcagacctcagagctgatgggcgcctctgacagtgcgtggcacgcatggcgcgcgcgcccggcggcgcatgccagcgggacctgtcggccctgcccctcgtcaggcatgccccgccctgcctcctctcccnnnnnnnnnntatggcgcgcgcgcccagcggcgcatgccagcgggacctgtcggcaatgcccctcatcaggcatgccccgccctgcctcctctcccagacagcgaagccgggatgccctgctggatacctggtcagccgaggaggggacggacgggaccctgcgcgccgggcttgctgccgaggtggcacctgcagttcccagcgcaaggggcagcttcaccggggaggtggtctgggagcgcgactcggcgtcccgtgccttgggnnnnnnnnnntcgaggtggcacctgcaattcccagcgcgaggggcagcttcaccggggaggtggtctcggagcgcgactcggcgtcccgtgccttgggtggggtgaccagcttccgcgtaggtgctcgtggaatggcagacctttggctggagcgaggtggtgggcatggtgtcaggctgctgctcagccgagccgggcacccgccatgcacaggcgccgcatgatcagggtggggcatggtgcttgaatcgcatcgtctcctgctgcagcatgctccaccccccaatgcaggatgagtcacctgggaacactgcaggctcctgattccccccggcccccacctccaaaacctcccgccacctcgcccacctgtcctcggcatgcccagcagaagccatgagacggagggcgcgggtggtgtcgccgctgatcagccggacctggtgagcccagccctcgcccaccgccagttccacatgcttgagcgatctgtgaagagggagtttgggggtctgtatcatgcgcaggaaagcggcatgcagcagaaagactgcgtggtagaacatgacgcattccctctgaacaatcagaggggtgctcgacagccgccactggatggccctcggcgacacgaatgcaggcgcggcctcccccaacccctcagcctggccatgggtctgcccgtgcattacttacccccccccccccccccccccccccccnnnnnnnnnnnnnnnnnnnnnnnnncccgcagaggaaaaaggaccgagcctcactcactccacgcgctcctcccggctgcgtgcagagtcgaggcgggctgtgaggctgctgtcggatgccgcggtgtcgtccccgtgcaccctcagccccaccccgctggccgacaggtactcgatcagctgctcggcgctgatgtcccccgccgtgaactgggcaaacatggagaccacgcgggtcttcagcgccgccagctccgcctggaagccggcggtctcctcctcataggtgagcttcagcctgtcaaattgctggagcagcgtgccgttctccagcttcagggactcagcggccgcctccagcaggctctgacgctccagcaggcggtcggcccgctccaggagctcccggttctcttcttgcagtccggacttgtcgtgcagcagcgtctcgcagctggcctgcagctgggtggccctggcctccagtccgctcagctcggcatccactgcttgtttctgctgccgaatggcagacagctccgactgtgcatcctgcagagggcagggtgcggggcatggagggcatggaggggcccgtgccaggcctaaaccaccctcggaaggtacgtggcgggtcactcgcagggaaggcgacacaacaggagacgccaggcacctaaatcatgccatcaacctgccttgagttgtnnnnnnnnnnaggcgggtcactcgcagggaaggcgacacgacaggagacgcccggcaccaaaatcatgccatcaacctgccttgagttgtttcaggagggcggcttcggactgcctgagccgtttcgcgtccttggccccgggttgcagagcccggtgcacctcgagcacggcagcgcctcccagcacagcgaggaacagcatctcagagactgaaacgatactcgacgtgatttgggtgcgtctcgcggtccatcacgccgtgctatgcagggctgtcgaaatctcttcgaaattttcccgtcggcttccgggcacagcacgcagcacacgaacctcttgcgggactcatgcatggcacagcatggcatggatccttcactgggtatgcaatagaaggataattctccccatttaaaggcgaaccgagatcttaacttccatctggccgcaccctgtacattcgatgaccgagcggaaggaggagggtggccagggctcgggggaggagcgtctgcgcaatctatttggctacctcacagcgcgacacaatacagataaacctgtgagaatacattcggatggtggagttggtgtttgctgtgttccaacggcggggttgtcgccgacatgatgttgttttgtccactactctagtatgtataagttcccnnnnnnnnnnaatggtggagttggtttttgctgtgttccaacggcgaggttgtcgccgacatgatgttgttctgtccactactctagtatgtataagttcccacctttccccgctgttcccagctcgccccggtccccgaggagctccgagaatgggcgagatcgacctcgcagatggcgttggtgggcatctcgctgggtacatatatgcaatggaagcaggagagggcggcaggtgaggtgggatggtctgttcctcaggaagagggtgcatcgccacggccgtgcatcaacgacgtgtacgttccagcaatcgctcatgtacgtgtacggtgtgcctattgccgtgcctactccaaccctctgacaggtgccctggtggcccccaccgatgccccctctcccgcccacgctgcgcggtacctggccgaagccaagacccagcgcctcatccgtttggccaaccgcgccaccaggtagcgcagccgacattcctggaacctgcttgcttgtgatcagtatcagtcgtagtgacttgtggggcctgttgcagtcgccatcgtacattgctgagccagtaggacatgcgagcgcaagaggcgccctccatccagggaactgccccccctccggcagtccagcatcgccctcctgctgacccgggctcttgtctgccgtccacctgtaccatgattcacatcgtcccctgtccaatgcgcagcgtgggtttgcgggtgnnnnnnnnnngcccgggctcttgtctgccgcccacctgcaccatgattcacatcgccccatgtccaatgcgcagcgtgggtttgcgggtgggggctctgagcgctgctttcttctccaccgagctcctgctgcgagtgtacgacggcgagaggcgcccccgacagacggcatgggcaggggcgggtgccggggccctctatggcctggccaccaacgtcggactgccctcaggtgacagcccccagcaccacagggggctggatgagcatgttggcgctgcatcttgctgtaggcttctttgtgacctaccccccacttcaatgactcaccctgtctgcctcctgtcaggactgggagctacccgcttgataagcaccgtgctggcgggcagcctggggtccctcctgggattctgtgttgggtgggtcgatcgagctacggacgcctggcttcccgacgacctcaaacgacagcgtcaggaacagtggcggcagctgcaggacatctgcgagggcagaggtgggtgaacgggagcatctggaggggcggaggactagggagcagtgcattgttgcgctcatgtcgtcaggagcgtgtgcagagtcaaagggatcagttgttgcactttcagcagtaggttacctcttcatggcccccactgaagctgctcatgtcggcatccccaccacagacatgaccccgcaggcgccgcctcacccagccagcgactccatggatgtcactgcggcggtgattgcatccctggaggcgagtctccaaaaggtaccggtggcgccgcccacagagggagagcactccataccatctgtggctggggtcacaagggctgagcctgagggacgaagagcctggtggcgaatcctgggatgagcctgatcatgcttctcatgtgcatccgcagtgtagcatgttgcagcgatccagaatctcgcgagccgcagttccaagcctgggacggtgagatggggggggaacgcccacggtggaaagggtggtccgacaccccccatcctcgcaccacaaaagcaatcgggcacggccagctgacttcgaagatcgcgtgattggacactctcacgttccgatcatccctgcaccatgtctctccgccacagtatcgccagcctaacccgggctgttaaccccctccttgcggcgaggtcgaccaccgcgagctcatccctggtaagttgggggccgatctccacattactagcgccatcaggatcgtttcacatctctccgccccgcaccgccccgcagtgcgcaagggttagctatcgagccttcactgccgagacctccgagagcctgtcagacctacctgagcccgagacggtggggtggggcgccaccaagatgtccgatatgcttcaggagaaggtaggtgtgtgtttctccatgttctggatggtggtgcttctcgcaaagccttccgaccttgcaccccgagacctagctccgaaaccctttgtacagggccaggaagctggcgcctggctctgggtgtccagggacgaccacgtcattgacgctgtgcggaaggtgcgatgctcgcgttgatccgcctatggaatggtgcctgccgcaatctaggctaagcaccagcgcctcagtccctgctaggagcacttccccactgtcccacccctactcgccctgcccctgctccagatgaccaaggccaacgtgggaagcctgctggtctttgacccctccaagatcgaggagcccaaggggacggacaagatcctgcacgcgtcaagggaggccgtcgtgggcatcttcaccgagcgtggtgaggcgcgccagaggggtggtgggccagcctgccggggagtggctgctgtttgcactcggggtggtagcctgttggtacaagttcccggagatcaggaggcttccatgtgcacaccggcaaccggaccgatctggggtcgggtggcagcatcagactctgtgcttggtgccacctggcgtgcatttcgtgcctctgtcaccctgcgcggggcatcagccgcgactatcacgagggttgccctttgccaccgcgtcacgccgtcctcacccacttccccgccgctcgccagattacatgaccaagattgcagtccagggacgaagctcccgcgacaccaagatctcggaggtgatgacgcccaaccccatcaccgtcacgcccaagcacaggtgtgggcgggaagtggggaacagcggctgtgcgtcgggcaagggaggcttcatggcgcctggggcctggccgtctgaccctgtcgcgtgcggcagtgtgctgcagcaggggatcacgtccgaaattcccgctccccactctggtttcctgccccttcccacctcacccctcccnnnnnnnnnnacgtgctgcagcaggggatcacgtctgaaattcccgctccccactctgctttcctgccccttcccacctcacccctccccctcttccctccccctttttcccgcagcgtgctggacgtaatggagctgatgatcaacaagaacttccgccacgtccctgtggtggacgaggggcgactgctgggcatggcctccatgcgggacgtggtgcacgtcatgctgaaggaacaccgcgaggaggtcggccggctgcaggagtacatccagggcaccttctgagcggcgacccctgctcaccgcgagggcggcatcaggcgcccttgcccagaatcggaaagggccgccgcgagcgggcgcaggctgcccggcggctgggcgagcagggtgccccgcacagcggccatcgaacccctggggtcccatgctccgcgcccacgaccggcgcgccttccccctgagctcaggccagtagacctgagcggggcgggacgcgcgacgtacacctggtgcgccgcgcggcggggacgtggcgcgagtgctgccgccgctgcctgagcggatgaaaaacccgctcgcgaggactgactgtcaaaatctcacacatgtatcattgccacggcacacttttagcgagcatggatccctttcacctcagttacccacatttttgttcctgcctcatgatgtagcgtcaagcacagactgggtgccctgggacggaggtcccagccagggccggccggccatggagttgattacccgagatttcccgctctccgcatcgggggtgcttatcgatggtggcaggcatgaagtgctgcgacacacagcaaagtagacagacgttgacatatacatgcaaatcaagtcctggtgcctcagctgtggcttcacggaggggagagcagggcggagagatgggtaccgaactggcaacggccaaggcggacgccgggtttgcacttttctttgcccaggagctgcacctcttctttcagcacctgcaccatgcagcagagaccttcaacatcaccaaggagctgccccagtccatcttcaaaggtgtgcacgcacgatcgaggcctgggcccacgcctcgcaagtgccaaggggtgctaagcaatagcactcccccatgcttggcgcagccggaaatgggaaggactccggcgatgatggaaagaagaagaggcgcggaaagaaggataaggacaggcccaggcggaaacccacgggtgagggttgggagaaggaagggggttagcctgccattccccgagtcttgatagtttggacttctgctgttgactgagctgtctctgttcgcatccatcccgccagcgtacaacgactttgttaagaaggcaatggaggatctgaagctcaagggtctggccaatggcaaggagctctttgcattggcaggtgtgtgattcgagctaaggatggggcgggtgggcgtcgctttcacgctcgtatccaattttctcaccacattgtcaaggatgcaaggggaacctgtctcaatccatctcccccccctccatgtcaagtggctgaatggagcaagctgagcgatgcacaaaaggcaaaggtgacggaagacttcaaggccaagggttctgcggagcctggatcatcctctggtgaggaggaggcagccgcagcaccccctgctcccaagcctgtggcacccacagtggtcagccccccgccgtccgagaagaaaaagaagaagaaggggcaggatgacgatggcgagtccaagaagaagaagaagaagaagaagcatcaggtgctgagggggttcgccagtgcgggcatatttgaggcgattgtgattgcacagcatgccaacaaatatccgttataatcagaccctcccaccacacgcccactcccaccacacgcccactccctcacaggatgcttcctcggactgaatgcgcgggtggcgtggcgttggcgtgccagatgatgacaccatgaccatgacaatgactccaacactgacagttcttgaagtcaaatccattaactgagcggagcataccaaggaggtgcatgagtgcagtgaaggaaggtgccgaggctttgaatggtatgcttgactcgtcctcacgaggatcaagactttcagcagagtgggagacgactccgactcggtcggaattctgagagcgaggccgtgcttgtgacgcgccaatcgtcaagcggtccggccgattgttcgtcgcatcgaacaatggctcaatgatggggtaaagtactctgcgtaaaccgcaccacccgcactccaggccaacctgtggcccccatgctgaggcgtgccacagcagcggcggtgctggcgacaggggtcgccgcgggtgtgtcttactacaagtacagcaccacagggaggctctggggcggagcatggggacccgaggagatccccggtctggaggaggtgccggcctcggcccccgcccacccccctccccctcaaccgtcaggtaggcccctctccgaccgccatgatcgcttcggaaggtgctggggacctgtggggtgaggcatgcatgagcacccaatcgcccacgcccacgtttccccctcctccaggccgcgcccccgcgcacctgcacccccccacccgcacctacccctccccgcacctcctggcggcctccaaccctgaggcggtgcgggcgctgcgctccaactccccctcccccaccgcggcgggcgggaggttcaccgacgcagagctcatgcgctacgcggtggcggcagggtggctggccgccgcccccggctcgcccgccgccgccaagtgcctggcggccgcggcggccgcc

SEQ ID NO: 34000 - DNA, 65 bp, Chlorella protothecoides
acacgcgcatgcaatccaaccccgcctcgccgtccacacacacacacaccttccaggcgggggtg

SEQ ID NO: 34001 - DNA, 71 bp, Chlorella protothecoides
aggcactgcgcaagcaggtgtgtgtgcgccgggttgggcaggcgcctgcgtgggtcgggcgggcacgctgc

SEQ ID NO: 34002 - DNA, 97 bp, Chlorella protothecoides
atgaggctgagaggagtggaagtttggaggagttccctgcctgcttcgggtgggtaagcatggcaatccccgcgtcacagcgtctagatactcaggt

SEQ ID NO: 34003 - DNA, 101 bp, Chlorella protothecoides
aatccagaggaggcagcacacgcaacccacccggctcagccaattcctgctgcatgcgcacgccctctgtgcaagcccccccccccccccccccccggggg

SEQ ID NO: 34004 - DNA, 76 bp, Chlorella protothecoides
agagagcaaggtggggagggagtggagggatttttggataccaaaattgtccgagagatcatctcagaagtatggc

SEQ ID NO: 34005 - DNA, 147 bp, Chlorella protothecoides
ttgcacaggtccccgctagtttgcagccaggctggcggtgccgggtcccaaaaactagagcactggcagcagaggttgggttgcaacaacacacatctaccaccacaagagatgcgataccctcagctcagaaggccccgccccccc

SEQ ID NO: 34006 - DNA, 123 bp, Chlorella protothecoides
agcaccacggtcacctacagggttgacatgaggatggaccatgctttggcccatattgtcttgctgttgcatttcccgattcccatcagcacagggatggtcatgcagccgatgtggggatgc

SEQ ID NO: 34007 - DNA, 119 bp, Chlorella protothecoides
ccaggtctccatgcaggtgctgggggcggggttcatactggaggggtctgtaggctgtgggctcgaccgcttgatcatccaacaggaagtgctggtgattgtgtgcacctggcttgatg

SEQ ID NO: 34008 - DNA, 179 bp, Chlorella protothecoides
gaggtcaagcgaggtgggtagggttgtggggggtggggcctgggtgccctgcgcattcggggccttgcatcccatgcaggcctgggtggcgcaggcccggggccggccctgccggagcgcgcgtgtgctacgaccagacgccctccaacatggcctcaccccaccgtccaaaacctcca

SEQ ID NO: 34009 - DNA, 115 bp, Chlorella protothecoides
ccatggtgcgcaggggggggacaccatggcagagtgcgagttggcatgccccgccgttcctggtgctcccctcacccccatagcggcacatttccatgcacttcatacaatcatg

SEQ ID NO: 34010 - DNA, 73 bp, Chlorella protothecoides
ctgccggcccaaggcacactgcatagccaaggcactgcattcgcatgccgtcccatgctgtgccggaccctat

SEQ ID NO: 34011 - DNA, 75 bp, Chlorella protothecoides
ccccataggtgctggcccgctcatcgcccaccgacaagcacacactcgtgaggaccctgaagcggctgggggagg

SEQ ID NO: 34012 - DNA, 2942 bp, Chlorella protothecoides
  modified_base (1636)..(1645): a, c, t, g, unknown or other
  modified_base (2339)..(2348): a, c, t, g, unknown or other
  modified_base (2457)..(2672): a, c, t, g, unknown or other
ccccccccttccccgcccacccaacctggaggccagcagggtcaggaggtcgtcgtccggctgccgctccgcaggcagggagttctcggggcgcggcgcggggaggcccagtgcgcggcgcagcgtgacgaccagacgcacacggacgtcgtgcttcagccccgcggcatcgatgcccaggtggcgcgcccaggcctgagcgttgagggggagatgtgcatgctctcgccctggatgctgtcgtcacgtgagttccaccgaggggtgcattgccgacccgcggttgtatggcagcccgcagggtggcgtgaacgccttcaggcaagtcggttgaggcggggtggcgccttgacctgcactacaccaggtcacaaccttccagcaacctcccctggtgccctgcacaagccagcgtaccttggtctcggtgtagtccacctcgttctcccccagccgcagcaggaggtgctggatctgctgtggggtggacaggtcatgctcccctcgcggcttggcatgcacaattactcgccgtgccaggcgggtggcgtggagagcgggcctggggagggggtgcattgacccacgtcgtgccccacgcgcatgggcgaggatgatcaggccggaggagcagggacgcccacaagcagcatgccgcagcgcatgcgcgccatgcccattcctgtgcattacatatttcatccggattgtacctgaatggggtgaaagcgcgacgcgcggcaggcgcccgcagggcgtggcctggcgcaggcacgaggccttcggtgcgcaacaggagtgaccgcctcatcctccagccgttcgctttaccccattgaataccagaatatgtccaggatgcaagattcgtatatgccaggagagcttcgcgagctgcatgaggaagatggtgggagtgggagacacaggtgggatgggtgtgtggtaccgatatctgggtacggcaaccgtgaactctttatacagaccgaagatcagagtctagacctccatctgagagtgcgctcaaaatttagctccctttgatgcccaatgctgcactaaagtgttccgtaagacactgccgctcgtagtgttctttcctttgggggcggtaatcccgcgcggaatatggtagaataacagcttgaggccactcaacccctgccgggctggcaccggctgcatggagtattacgaggatgacaatgggacaaattcagtaccataaaagggcaaatccttaagggaaaggagtgctgaattgggagggagtttagggcaggggtccaccaagggttgtgcgacatgtcgcaccagcaagaaacaggtcggtcatcatcaggaactccacctccccattgatgtcacaaatcacaagagacacatcgcaatgtctgttcatgcaccgcggcacgactaagttgtctcggccagcatcagcagagcagagacacgacaaattgctaggtctcaggaaccacacctgccgtgggacccctgtgatattgccctggctgcggtatgccataagaagctctgatcccgtttaaaatgcgagtgggacgcggctgattcgcgcaaaggacagcggagaagggtgaaagggcgaccaccgacaccttctgctgtatannnnnnnnnnctcacatgccggtgagcacatggtgaatgatatgccatggcactgtctggcgcggagggcagggcaaatggggctagctaggatcttgaattttcctctccatatgctgtgtagacacagagagagtggaatactgacaaatcgagtcccctttggttgagtactcttcatttccaagaatgcagtacactaacacgtgaagcaggaccgggtcgttcttgtcttgatgttgttctgcgagtgataaaatctgaggcagatgggatgtcaggtcgcaggaaacatagggaggcccctgccacataactcctgtgatattgccctggctgcggtatgccataagaagctctgatcccgtttagaatgcgagtgggacacggctgattcgcacaaagggaagcggagaaggaggggatagggcgaccaccgacaccttctgctgtataacaatctcctgaaaggaggcactgcaacggagtttgcacatattgacagcaacttggtggattgaacacctgcatccataatgattgaaggtaagggccggtggctcaacctcggtatgtcgcgatgggaaatgaagccgacttcccattgttgagcaggccatagcaaatgtacctgacccacagatacatgccagagtcttcctcatcaataaactttatcctccgcctctgacggcccgagaaannnnnnnnnnccttgaaagcagataatatcgccgagtcctgcacatattgacaccagcatggtggattgaacacctgcatccataacaattgaaggtaagggccggtggctcaacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggccggggcatgacctgcagcccttccattcaacacttgatgatctcattgtgcgatcattgcatgtttgaatctgatgtctaaccaccgtctcccagtttgcaagggatgctttgaaatcccggagttgcgtcccccaatcatccccggaggtgtacaaagctatgcacagctgctgcggacgctcttgacattccctcgacatgaggtgtcatacctggtgagagtgatggaatctgcacatgaaatttccagaagaaccaccaa

SEQ ID NO: 34013 - DNA, 80 bp, Chlorella protothecoides
gtccaccttcctggaggagctggggtgaggggcagagagctgtcgtttttgctgcggggggggggggggggggggggggg

SEQ ID NO: 34014 - DNA, 61 bp, Chlorella protothecoides
ttccgccaggtccaggtccagcgcctcctcgtccacccgcttcaggttgcggatggtcacc

SEQ ID NO: 34015 - DNA, 106 bp, Chlorella protothecoides
tccactgaggggtgggttgggcggaggggacttgtgagacgcaaagagggggcgtcattgaggcggacgtctgggcgagggtcaacaaaccctcgtcccgctgcgc

SEQ ID NO: 34016 - DNA, 2113 bp, Chlorella protothecoides
  modified_base (151)..(160): a, c, t, g, unknown or other
  modified_base (696)..(705): a, c, t, g, unknown or other
  modified_base (1012)..(1021): a, c, t, g, unknown or other
  modified_base (1091)..(1100): a, c, t, g, unknown or other
  modified_base (1818)..(1910): a, c, t, g, unknown or other
tcccccagccccagcccatccccgccggctgtggtcctgtcccagacctcttctgatccctgcgagggtggggtcaccgtggacagcaatggctactggacctacaccaacggcaagtcctccatccgtgaggtcaaggtgatcaagtatnnnnnnnnnnatgcctgcgagggaggtgtcactgtggacagcaatggctactggacctacacaaacagcaagaagtccatccgtgaggtcaaggtgatcaagtatgatcccaacccaaacaattacaaccaggagatcctgtgcggcgtcaactacgcgcagcagaagggcctgtgcacgtctgggtcatggaagatccccgtccagtatggctacaagggctgcatgatggtccagatcgactacaacggcggctgcaactcaaaggaccccgtcttctgcttcaaatgagcaacaaaaggcaagctgaatacccaattccataggccgtcctccacaaggaagccaatatgcacatggatatatacatattagcacttgctgcccatatcaagcctgcatacataaatatttacatgttgtcttcctagcatctgccaagctctggaaatgatattcccctgcacttactggtctacaatttgccatcttcttttcctattccctcctggaaaagtgcaacacttgcccaaccttactgacggnnnnnnnnnnctagtaaaggaaaacccatgcatcccaaccgaaaatctcgctccgcgctgcctgcggaccaataggggcatgtccccacccatattcccccactcccaccccccttgctcccgctggctactgcccctccccctcttccccattctttgcccaagatgtcggcacacggcatctgcagcgcccatgtacacacatcgcgaccactagatgagctggtccatgtctggttgggtctgcgttgcacttacacacgatgcatgcttggtgggcacaagcggggggtcccaggccaggtttcacaaaagannnnnnnnnntgcaaagagtggccaagctcctgatgcacagctctacactatgcctctcagggtcatcagcccttacaannnnnnnnnnattactggtctacaatttgctattttctttttctattccctcctggaagagtgcaacacttgcccaaccttactgacggggccttgaacattgcatcaataagtgtgtaaattttgagtgcaacccagcagataggatgggccaaagctggcggctgcaacatagactatcaggtcactttgaacggcaaggtgcttgctcttccacggcgtgtctcagctgtcacacagagcgcaccatgggtcgagacttaacctctttcgggtatggtgacgcaaagagtggccaaactcctgatgcccagctctacattatgcctctcagggtcatcagcccttacaactcgtcacccttggtaagagtcatcaccaaggggagctttgcccgtcgtacgaaataggtatcacccaagcgcaaaatgcgtggcttctggcaactctgatgtcaggtcattgcaccttattgccttcaccaggtttaccgaagttgcgggttgtaaggaaatcggcgcgaaatactcgggaagatcacattttcgaatttcgactgcgaaatttcgtgctgatatggcagtggcccacggggctgagcccgccagcgcacagtgaggatggtttgggcgggctaagtcagtgtgtacacaagcactcatgtaatctgaaaccaaccccaaaggttggcaagcaatgtgcaagtaccatgaagacatttcagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgttaagacttgcagcaagactccggaagcgctcttggtggcagtcaagcgtgtcaagcagctcaacactccatgcaagcgcagtcacacatccatgcccacgagaagttcagtggccgacagttcagaacctcataggaaccctgatcggcagaccagaattacatacttcatggggagccgaagtgcagcacaggcca

SEQ ID NO: 34017 - DNA, 7615 bp, Chlorella protothecoides
  modified_base (2828)..(2837): a, c, t, g, unknown or other
  modified_base (2896)..(2941): a, c, t, g, unknown or other
  modified_base (4020)..(4029): a, c, t, g, unknown or other
  modified_base (4247)..(4256): a, c, t, g, unknown or other
  modified_base (5913)..(5922): a, c, t, g, unknown or other
  modified_base (6559)..(6568): a, c, t, g, unknown or other
  modified_base (6825)..(6834): a, c, t, g, unknown or other
  modified_base (7155)..(7274): a, c, t, g, unknown or other
gcgcgcgcgcgcgggcgcgacgcgtcagccgccaacttggtccagtagacgctgggcagctggtcggcggccgccgcgtcggcggtgatggccagggggtcggcggagatgacggagaagaggtgctggaggagcgcggcgggcatgggctcaccgtcgttggtcgcgtcgttcatgcggcggaagccctccagcgtcatgcgcggctggcggtcggtgcgctgcttgtgcaggtcggtgttcagcatgatgacggagaaggccaggacgtaggcggcgtcgggggaggccaggcccgacccggggcaggcggcgtggtaggcgccgccaaaggcctccatgatgcggtcgatgcgctggccctcgcccggcaggcggaaggcgtccaggaagaggcgcagcgcgacgtcaaagtccagccccgccaggtcgaaggtctgcaggtacgccgcgcgcacgccggcggagaagtcgtcgcgctcgcccagcgcctcgcccaccgccgcctcgttcaggcccgggcagcagcgcaggaagcgggccagcgtggccgggtccagggtgggcggcagcaggcgcgccgcctgcgcgtactgcaggcccttcttggggtcgcgattgtagtgctccgcggccgaggccagcagcgacttgagccgcttctcggcacgcgcgcggtccgcgggcgaggtggcgcggggccggggggtggtcggcgtggcggctctggcggggccggcgcccccctcgatggcgacgcccgtccggacgcctccgtcccgactctcgtcgctgtccccctccccgcgaccctcgcccccttcctcgggccccacgctccccaccccgccccagtccaggaactggtcggtcggcggggccaggcccgcggccagcggggtccacacgtccacgtagtgcccgggcgagtcgagcagtctgggcaccccagggtcgatgtccgaagcgcccccaccctccgcgacgtcgtccagggaggccaggagggccagcagtccttccagcgccagggtctgggcgctgtcgccccccgcccaggcctcgccgccgcccccgccgcccggctgcgcggttttggacagcagggcgcagatgtcctggagcaggtcggcgcgctccacgcggcagtcggcagccaggtacagctcggccgcgaagcccggctggcggcataggtccagcaggccctccagcgccacgcgctggcgctcaggtcccgcgccgccgcgcccctcggccagcggcagcagcagcaggcgcaccagggcctccacctggacaatggcacgcgcgcccagccgcgcgtgcagcgccagcgtggcgcagcacagcgcggcgaggcgggtgggcggcgcatcggcccccgcctcgaacatggcgcgcggcaggtcggccgccagcagcgccgccaggtcggcgtgccgggtcagcgcggggcccgccgcgtccagcaccaccagcagcaggcgcaggccctgcagggggaggtcctgggaggcggaggcagcgggggcggaggcgccgggcgcggcggcggggccgccgccgcccttggcccggatcaggccgatcacgaaggccaggatctcgcgcacgcagtcggggccgtagcccacgaccccgggccgccggccggcggttgaggggctggcgccgccgtcctgcgacgcaccgcgtggcgtcgtgctgatggtcggcatggacccggcgtcggtcgggacagggttcgtgaccggcgcgaccgcgccgcccgctgacggaggcggcagcagcgacacgatgctgtgctgcgccggctccaccgcctccgccggggcgctgcctgcgtcgccggcttcggtgcgattgccaccggccgtcagcgcagcatcgctctccgcattcccggcccccgcgccctgcagctcgacctcatcctcgaccaccaggtggtgaccgccggcggcagcgtgggccgccgcggcaaaagggctgctcagctggctgcccaggtcggcgggcaggctgcccaggcgcgagaagaccgcgcccaccatgacggccagcgtgtcgcgcgaagcgtgggccagcacctctgtgcagggagtggggtggtgggggtggtgggttggggcatgtgtgtgtcggaaggagtgggtgaggggcatgcccaggcggggtgagacgtttgcggtcgcggcggggagtgcgcctacaggcggggtggggacgtgctcacgctccaggcagagggagcgaggcggcttccccagcttaccaaagccctctcacccgacgtggcccgccccttctcggtctggtagtgcccgatgcggtaggcggcctgcagcgcgttgagcagcgtgtcgtggggcagcgcggcgccccagggcgaggccaccagcgcggccagcacctccagaatgcggaagagcacgcactcgtccgaccccggcaccgtggcctcaaacttgcatgaggtgacggcgtccgccagcgccgccacggcctcccccaccccggcggggaatgcggccaggaagccggcctggatcaggcggcgcagggagcccagcgccgcgccggtcacggggccgctggtctcaggcgtgcggatgacctcgaagaaggggtgcagcaggtgcaagggctccacatcgcccaggcctgggggatgttcagggggggtggaaacatggtgcagtcgagacggagacagtgaggtgcgtgtggccatccggaatacgagaaggctgtgtaccagcacccactacagcaggtgcagaggaggagccaggggcgaggcacaacacagagggagtcccccnnnnnnnnnnggacggtgaagtgcgtgtggccatccgcaatacgagaaggctgtgtaccagcacccacnnnnnnnnnnnnnnnnnnnnnnnnnnnnnnnnnnnnnnnnnnnnnntgcgtcgaagctgctgaaagtcctccaccaggctctcgggcatctcgtcgtcctacgggggcagggaggggcgaggttgggcgcccggatcgccccctggcgacgcagaggaacagccagggatgcagagatcagggtgggagtcatgatcgcctggtgcataccgtgtatcgcgtggacgcagcggcccatcctcgcagggcagcgaggactgtggccacctcgttgttcagcaggagggccaggtcgccgacctccatcgtcactgctacagccaccaatgtcaccccatgccaagctgagtcccagccgagtattctgatcgatggtgggtgcgcggtgccctgatcaccccgtccatcgccccgggcccggtgccgagaggcaggcaggggcctgggagtgtggtaccctccctggcagcataccactgctccggaacctgctcagcatccttcactagcgatttacattgatatgtgcgatggcaaacagggtatgcaatgggctttcaaacaaccatcacaggtgtgcctgccaatggttgcacgtcaatgcgccgcaagtctagtgcgagttcttccactccagcagggctgccttctcagcggcagacagcttgccaccaacgatggtctgcaacgggggtgtgggggggatgtggtatcaaccctgcggtctctctctgggcacagcaggtcaaatcttggctggcaaggctgcctaaaccccgccctgaactgagactcacctccagcttggcagacgcctcatcagcggccgccttcgagccctcaacatcatgctgtgtgatatatcaggtgaacaggggagatttggtcgcctggagattgcctcaatgcacatgcacatgcatgcgcgaggatgacggacacaccccaggctcaccttggatgcctgggccgccaccttctgcagcagcgtgcggagcagcttctcctcctcctgcgcagacaaggggaccagggcttgagcaggtcgtacgtgactcctccagaatgacatcaccagctcgtttccagagaggcacccaaagggctgggcgctcggaaatgtgnnnnnnnnnncacgtgattcctccagattgacatcaccagctcgtttttggagagacacccaaagggctgggcgctcggaaatgtggcctggccctgtcaccttccggaagtagacggtctgtggcaaggtccgtgggaggggtggggataagttcggtgataccaaagtatgggtttacacccttgcataaatgtaaacgaaatcgtgcttcacgcacctcctcgcnnnnnnnnnnagcgtggagggggtggggatgagttcggtgacaccaaagcatgggttcacacctttgcatgaatgtcaacgaaatcgtgcttcacgcacctcctcgccgcgctccttctcgccgtagcctgcacagagaaccggtgtcgagcaggtgaggcaaggccaccgacacaacatccttctcacaccctatcatttccgctccgcacccttcattccatcgtgagcatacgcgcgctgtccaatgacagaggtcacgcgaggcgcaaaggtgctcgaatgcttgacgacggtctgcagcatctttctagcttagactcgcgcagtgtgggcgtgcttcgatgatgattgacctcaagatgagcacgttcttgcccgatggattcggcccgctctgtcatgtagggtccaggcccgctcgattactagtcgggcctctgcaccatttcttcccacacgaaccgccctcccatgcatattgcatggtcgacccaccctcaccgccatgtccacatcgccatcccccctcagttctcacacttgagacccatacctggtggcctcccctgctgtcatggagggccgcgaccccaccgtccgcatcgcggtggtaggggaccctggcgtgggcaagacaagcctcattaccgccgctgcgacggagaccttccctgatcacccccctcccgtgctcccccccgccatcctccccgccgaaaccgtgccggagtgcgtgccggtggtcatcaccgacacctcctcccgccccgaggatgcagcagccctggagctggcggtgcaggaggcctccgtggtcgtcctgtgctttgccatggacaggccgaacaccctggccagggtatccaggcactggatcccggagctgcgccggatggcggggggcgcccacgtccctgtgctgctggtcgggtgcaaggccgatgcccggcccgccgaccacaccctgcaagcggccgtcgtgcccatcctgcagaacaaccccgccgtggagacgtgcatggagtgctccgccaagaagctgcagtacgtgggggaggtgttttacctcgcgctccgggcggtggtgcaccccaccgcccccctcttcgacgcccaggcccagaccctgaggcccctctgctctcgcgccctcaagcgcatatttatgctctgcgacaaggacaaggtggggctgcacggggcaggggtgcatgctgaagcaggtgccagcggccagaacgggggcggtgtgggttgctggaatgccaggctgtgttcatcgatgagccctgaagagtgcagggcgccgtctgcaccagcactcgcgcctcaacccttctgccgcccaatcctgcaggatgggattctcaacgaggcggagctgaacgccttccagatccactgcttcaatgcccctctccagaccgaggagttgataggcgtgaagcaagtcgtcgcggagcgagttcccgaggtacttctgggtgcagaagtcatagctctgtgctgtaggaagacgcagtcattttgggggaagattgagggaaaaccggtgtgaacttgtgtaggatacaagtccagcaagcctgggccgtatgttcccctacgggtgagagcaggactgtattttgcgtggagggcgctccttctctgatccctgagannnnnnnnnnacagtcattttgggggaagattgaggggaaaccggtgtgaacttgcgtgggatacaagtccagcaagcctgggccgtatgatcccctacggatgagagcaggactgtactttgcatggagggcgctccttctctgatccctgagagggaagctctatggatgggaaggctgagctgggaccccacgacgctccaaactcccaaccttcagggcgtccagaacggcgggctgaccctgccgggcttcatcttcctgcatgcgctgttcatcgagagggggcgactggagaccacgtgggcggtactgcggcggtacggctacaacaacgacctggtgctgtcccaggagacgctgtctgccgtgaacttctcgcacgccccagaccaggtcagttgaggtgggaaaggggggggggggatgtgagggtgacggttataggagcagactggaaggtgtgggatatcttgtaggactcctgtggggcatgtgctgtgcagccctgctgcctcagaccccgcttctagctgatcaccatctttcctctctttcctcccgctccaggtgttggaactgtcggaggagggccgtgccttcttcaccagcgtatttgagcgatgcgacgtcgacgatgatggcnnnnnnnnnnacaggtgttggaactgtcggaggaggggcgtgccttcttcaccagcgtgtttgagcgatgcgacgtcgacgatgatggcgtcctctcgacgcgggagcaggaggagatgttctccacctcgcccggcaggtgtgtgtatggggagagggaaaagtttcctgtggcctagtgcaaaggggcagctgggttcagggacgtgcccctagacccgcatgccagctgtgatacagctggcgttcccactcctcgtgactctnnnnnnnnnnccagggacgtgcccctggacccgcatgccagctgtgacacagctggcgttcccactcctcgtgactcttatgtagattgatgaggtccccccccccaccccaagtcccaccaatgccttctgcctccgcagcccatggtccacccccgcctacgatggcgtgctggtggagacgagcaagcgcggcctgctgtccctgcgcggcttcctggccaagtgggcgtacaccaccgcgaccgagccggaggtcaccctcgcctacgccctctacttcgggtgaggggctgttgaggctcatgaatgtgtgagagacaaggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaggaataccggcgcggtgctgcaccgtgggcctttgtgagccttctccaaggtggctactgcccttgctcgaacatcaggggacgcaaggaggactggcacctcctcccaagcatcagtcctctctcaccatcccacccaccccgccactgtccccccagtctgcccgacacggaaacggcggcctcgctcttcaccacctcccggccgcggcgtgcggagcggcgctccgacgctggccgccgcagcctgctgcgctgcttcctctttgcgcccaccggcctggacaccggcccgctgctggagggcctgattgcgcaggcccgccccgtgcatgg

SEQ ID NO: 34018 - DNA, 698 bp, Chlorella protothecoides
caaacatgaggaacttgtcggtgagctggaatacacacttgacgtgatcacgggtgtactaggtcatgtcctctcattgctattatccttgtctcaccagccctcgtttctgccctttaggatgaggttgttccaaagaactagtcgctggaagctggacagtatctgctgaagattcccgctttttgcattgtgcgcaaccaggagtctgatcttccccattcagatattacttctgtggacggcgagtgagatattttgatgcgtttgctcatggcattccccgggaggagccacccgggcgcaaggggcacccgggaaagcacggagtacccttacccctccctaccgggcatgcgccggttgctagcaacttattcccgcggacgggatatcgctggcgcaattggttgcctctaatggcgaaccggggggtggggggtggggggaaaggaaggggaagcaggggggccaccagaagctgtgggacgaggtgcattcgcaaaaaaggacttggtcagcatcaggatgttcaccgccccattgacgtcgcggttgataacgttgaccttgcaggccgggttgacgcaccgcttggtgtcccacacgtccaccagcttctcttcgccgttgtaaccccgcacgtactggtgggcatggagggtggcgtgacaggcgcaacacagtttggaagtcct

SEQ ID NO: 34019 - DNA, 62 bp, Chlorella protothecoides
atgcgatgctgcacagtgcgaccccccccctctttcgatcaatacttcgcaccacagagatt

SEQ ID NO: 34020 - DNA, 64 bp, Chlorella protothecoides
tgtggatgcaatgcattgctgtggaacatgcaataccacctggcggcaggcatgggctcaaatt

SEQ ID NO: 34021 - DNA, 74 bp, Chlorella protothecoides
agctgggcctcgacgccagccggcctgccgcggtggtcgaggacgcggggcgtcccggtgccgcgccgctcgat

SEQ ID NO: 34022 - DNA, 160 bp, Chlorella protothecoides
cagagagcagtgtcaggggcaagcgagtgccaggggagtgcacgctgtcaccatggtgaattggcctccgcattgccaaataacgtgtgtgaatttggatcatcaccgcatgaccccctcaagcatcccaattgcagtgcaccgagcgatgcgggacgac

SEQ ID NO: 34023 - DNA, 9984 bp, Chlorella protothecoides
  modified_base (321)..(366): a, c, t, g, unknown or other
gggggggggggaaggcgaactcccgggtcgtatggtgggctgcgcagcccagcacgcagagtcagccgggaaaaggggtgagcgcgagaggcgtgaagtaggcggggcaggacctctgcgcgcacagggtggcgacggggctggacctggcacgcttggcgacaccctcgcccaccaggctctcgcctgagcacctgccctggtgcggcgacagctcctcgccgcccaagtcatcccacaacccgtccaggtctggcagcgggcccagctcgaagggcgaggccagggaggcggcgcggcaccccagcgccagcgcctgcnnnnnnnnnnnnnnnnnnnnnnnnnnnnnnnnnnnnnnnnnnnnnnctccaggtgcggcggcggcgtggcgtccagcaggcgcagcgcgtgccactcccccgcctccaccgccagcggcgggttggcgtgcccggcgggggccaccgccgcgcccagccctggcgtgcccctgccgccgaggagcgcgggcgggggtgacgtcgcgtgcacctctgcgccctcgatgctcatgctcagcgcctccagcgcagactggtacgcgtcggcgcccagcgacgcgttctcctcgggcgaggagccctggaacaggtccaggctggagctggcggaggcggcggcgctgcggtcgggcgcagccgccggcggccaggccgggttcgggctgcagggtggggcgggggccgcgcccagcgagcaggtgccgctgtgcaagctgctgatgggcgagggcaggttctggtaggggtagcactcgggcaccagggcgccgcctgccagcgacacgctggggaaggcgccgggggcgggccacagcgggcgcagcgggccggcgccgcggccgcagccctccgcgccaggcgggcgtgggaggtacgaggccgggcgcgagaggggggagctcgcgtccagtacgcggccccgtgcaaagggcctgcccgcggaacccatgccagggcgggggctggcggggctggatggctgggaggcaccggcgctcgtgtggccgccgagcgactgggaggaacgctcgccccagtactggagcaggcctgcatggtggaggcgggggaatgcaggactcagcctggcgtgcagacttccagaaggggcgcacatccccatcatgcctgagcgcagatccagggccctgcccggacgcgggcctggctcgaggggcaagactgggcgcatcgttgccatcccagaactcccgtcaccacgacccgccagctccagagccccacctctgaaggccgtctgctgcatgggcgtctcaaacacgagccaccaggtcatgtcgcgagcggtgcactgccagctgggcttgcccagccccaggagcaaggggaactccttctgctcggcgccgtgcaggtgcagggtgctcacggcggcacggcccctgcggtcgtacaccgccaggcgcagctgggctgcgccgccgacgcggctctccagcacggcgcgaacccccgccatgcgtcgcgcgccgccggaggcagaccacggcgcgcggaagaccagggtcaggccgtggatggggggaacctctgtcgggcgccaggtgtgctgggggaggggggggctggggcgtggggcccagccggtcatggaggagatctggaggagggcaaggggggtggaggtgggcgtgaatggcgggttgctggtccctcccagccctcatgtgtggggacggagggcaccgggttcgaggcctgcgggcaccgggctcgtggagctcacactcgctgcatgaaaggctggccctgtggcaacttcccgtggcccccacgcggccccgagcaggctacaaatcagccctcgcaaccccatgcgctgtgggaataaactcacacatgcatctgctgacatgcttgaggcgagggggcagcctcgtgatccgcggagcctcccgaaggggcctgcgggcaaggttaggatacgcagagggcactcaatgcggagcgcggacagcgcggggcacagtgctatgggtcccgcgacatgtacatttcgccaccggagtacacacacaccttggctcagggctgggaatgggctggcgagcgagtcccagccgcggggtgcaagcttccgaggaactacggcgaggcagtggtcgcccgtgaaaagctcacaaatattagtatctgaaagtgcctctactcccgtaataattgggctcataaatagtaaacacctcggaagggcggcggggagagaatattcacttcctccctggctcctgcttgtttggaccgaacgctgtacgaccccctgctaggcagccagcagcatccccctcctcccgtttcggacccagggacaggtgtcacccgttcgacagggttactgcgcggctggcgagcacctggcaacgaaggcgaggatactgccgcgatcttgacagactgttgtaaatgcagcaagcttgacagtcattgcgccagaattgtgggcacacctcgcgactacttcttggtgtgcgctgcccgccgacccccagcggtcggtgccggaaggctcgcaggtgaaggtcgaagcctctccagcttccttgatatccttcagccgtgcgtgggcacgacgtagttgtcttctgccataatctgcccggtctgcaccgggacagtgtatgtacccggtgacaagcttcgctgagccaagtgggcctcgaacagctcatacagcgggccatacccaggtccagcgcaccaccagcgttgatgggagatgcgtttgcgcatttttgtttctaattcggtgatactgtcagggtttgccgaccctccagtggcagcctttaacccttcacgagagcttgtgcaggcaggacagctgcaccaagcaaacaattactcaaatgctgggctctgcatctggggtctacaggaatctacgtcaatttgacatgttactttgtacccggcagctcctgcacgtgcctggaagtttatggggaaagtgcaagggccgggaaggtgaatcttgcccatgatatctcaagcgacacaacacctcgcagattcgacaagatcagtatgtcaattcttgtcctcccttgtgttgctggtgcgcgagggaaggctgcagtaaaggctttttgaacgtcccgtacccagccgctgtctgtgcacgtggggtcctcacatggccggatggaccccatcgaacacttgcaaggcatcacaggtttcccgctggagtgcactatacttgagcaactgggcccaaattcggctatcgaagtggcgtgaggagtcccaccttgttcctctggggcgtgaccattcacgtgtggaaaccccgtgacaggccgcatccagtggcctcagtagctagggcttgcatgggatcaaagttatgtatatgatgatcttcgcataagtcgtcacctccacctctggccagcgtcggcctccatggctgttgcccctttgccggttccagagatggaaattcccgaacccgcttcaaccgagccattcaagtggactgccgggaagatagttttgagcatattcctctttctggttgcatcagtggcagaaatcggtggaggctggctctggtggcagactctgcgggaatcaaagccctggtggctcgcagttctaggttcgggcgtgctcatcctgtacggcgtcataccaacctttcagcccacagacaattttggaagggtgagtgggtatgttgggcactcgtacttcccggtttgctgctgagaaggcccgagatccaagcgatgctgtgctagctggggacatgtgaacaataattcttgatgggtccctcaacgaggacctggatctgaacacccgtcaagctgttcctcttcatcaacaaccccccttgcagatctacgccgtgtacggtggattcttcatcatcatgtcatacttgtggggctgggccgtcgacaagcagcgccctgacactggcgattggattgggacggcgattgcgctcgcaggcgtgtgcgttgccttcttctggccacgatgacccttggcgtcctgcgcccccttgacgcgcccattgcctcaccttgaccagactgtgggtattgcctagcaggccctcctcgtatcactcttgcagtccgcacattgttcatgtgtaccctattctgtatgcaagccttcacatcaattactcatacgttttccaccctccgcctgcctttgagttttgattcacatttctgtggtctaaacctgcagatatgcccggcatcttgtcaatggctttgctcgccctccccagtaataatcacctcctcattctgctccgtacatcttcatgccttttcatgttgtagaaagactgacgcgtggtgttaggcttgcaaaccctagagtttgcctgtaacgggggctgaagggagtgtgttatgaagtcaatctccctgctccccccccatctacagacccaagaactaatcttatgcgctggcaatccttccaattgcaccataaaagcctccagttgacggccgtctgagaagcttagtagctccattggccacctgccggctgcacgtgtgccacggtggaaggccggaaaacccttcatcgtgtgcaagggcgaagggtgtcaacacctctgtctacatgcaagatccggttagctggcgaagaacgtgttccatataaaatccttctgcccaataaccatccgagatcatggtgagctcgccccgcctccaagggttgaggggcctgctgccgtgcactgcttcggcacctcacacaaccctgatccccctccctcgcagtcggccgccgcgtacatcgaggagcacaacatccagaaggtcgtcgaggaggtcatcaatgccaccatcaaggccaagccctccaaccccttctccttcatggtgcgctgaacccccggccggtattgacatgactgcggtactgctccccagggcggacaagtccgtgcatgcaatgatcgcgtatgattcattccgagcctcgcacatccgctgggcgcaggctgacgaggtgcgcaagcaggcccctgctgccatcaccgccgtgcacgcccgccagatttacgattcccgcggcaacccgaccgtcgaggcggaggtgaccaccagcctgggagtattccgcgccgcggtgccctccggcgcttccacgggcgtgcacgaggccgtggagatgcgcgatggcgacaagagcaagtacatgggcaagggcgtgctcacggcggtggccaatgtgaatgacaagatcgcccccgccgtcatcgtgagcctagggtttgggggtctgatgatgcacgcgtgggagtggtgacgttttcagtgtcgcaggactgggcacaagggttcgccgtcgtgagttcatgatgggagacggtgactcaggggctatcgggtacacagacctgtcatgcactcggtggaaacaactcctgttgccatgcctctcgttccttccttcccacatgctccccagcactcacgtgtgctctattcagccgcctagcatgtgctccacctccctgccccaccccttctccctctctgaaccccccctcatccgccgccgcagggcctggacccccgcgagcaggagaaggtggaccagaccatgcgtgacctggacggcacccccaacaaggccaacctgggcgccaatgccatcctggcggtctccctggccgtcgcgcgtgccggcgccgccgagaagggtgtccccctctacaagcacatcgccgacctggcgggaaacaccaagctggtccttcccgtgccctccttcaacatcatcaacggcggctgccacgccggcaacgccctggccttccaggagttcatgattatgcccgtcggcgcctccagcttcgccgaggccatgcaggtgggtgctcgtctgcgttggggttcttggggagaagggaggtgccaaaggatgcatgcattcgtgattgctgagccaaggatcacacagatgggcttgggagtgcatggattggcgtttggcagcaggtcaccgcagcagtcagcatcgtgcgcggcgcaatcggcaagcgctgctcgtactggctggccgagccctgagggaggtctcccctgtgcctcattgttctatcccatggaggagccgtgggcatccagtgcacctcccacttccatccccaccctcacccctcaccccctcaaccaacccctccccagtttgggtctgaggtgtaccaccacctgaagtccatcatcaagaaggagtatggcctggacgcaggcaatgtgggcgacgagggtggttttgccccccccatccagtccaccatcgcggggctggagctggtggtgaaggccatcgaggccgcggggcacaccggcaagatcaagatcgccatggacgcggcggccagcgagttctacgacgagaagagccagacctacgacctggccttcaagtcggagcccaacgacggctcccagcgcaagagccaggaggagatccgcgccttctacaaggaactggctacctcctaccccatcatctccatcgaggaccccttcgaccaggacgactgggagacctacgccgcgctgaccgccgacctggacgtccagatcgtgggcgacgacctgctgtgcaccaaccctgtgcgcgtgcagaaggccatcgacaccaaggcctgcaacgccctcctgctcaaggtcaaccagatcgggtcggtgaccgagtccatccaggccgtcaacctgtccaagagcgccgggttcggggtcatgacctcccaccgctcgggcgagaccgaggacaccttcatcgccgacctggccgtcgggctggccaccggccagatcaagacgggcgcgccctgccggtcggagcgcctggccaagtacaaccagctgctgcgcatcgaggaggagctgggcgccgacgcgggtatgtgcggggctttgtttgttggtgttggtgttggtgttgttgccatggtgttttcctttatctcattgtgttgtttggaggggggttgagtcgtgggtgtgtgattcgcaccccgcacaccgtcgactcgccaccccactcaccggcaatcctcacccctgtcgcagtgtacgccggcgagagctggaggttcatcgccaacgcctgattgattggaactcaccaagcggcccacggcttcgaacgtcccgtgtcaattgcgcggggtgtgccagagtttctgcgccaccgatgctcaccctagggggggatgccctttgacattcatgtgtgcctgcatgcacgtttgtatcagtctcaccacaccttgaagatttttgggagggggggggcggtcggaatggaaaccctagggcagcatgacgcgaacaacacgtgacgcgagaggggccgaaaacatcggtcaaatacgcaagtatatcgaacaattgatgtcatgcacatttgttgcctgattgctggatccatcgaggcatttctcccggacccactccgcgccgcagttcaggcccctgcaagaagagatgatggccactccctgcctgccgggcctcgtcattcggcctgcaaccgacaaggacatcgacaccatcgcgcgatatggggctgccatcgcacaggtagattggtgacttcctcggacatgtgagtctgcatggtggttgagcattgtgcacagccactgaaaactcataaatttccaatcaatgcaggagaccgaggacttgacccttgagaccaaggtcatcaccgcaggggtttctgccgcaattgcagaccccagcaaggcacggtatctcatcgctgaggtgggttacagctcgagggtgtggggtcggggcgggcaaggatggcctgggaatgaccggcactgcttctcttcagccgcgtgatacaggggcagccatatctgtgttctccaatcgaatgcaggtggatggagccccagtggggagcctcatgctgcagaaggagtggtctgactggtgagagggcctggcatgtgctcgcatgaatgccaggggtttatggggaggagcacattcccgcagggtcatatttttaaaggctcgctgagaatacgccaatggtaccagatcgcatgccccaccacatcaatccgtgtgctgcctgcaggcggaatgcagagtactggtggattcacagcgtctatgtggttcatgaccaccgcgggaccggcactttcaaagccatgtacgagtatgtggagaaggaggcgcgggaggctggtgcggcagggctgaagctgtacaccgagaccaccaacgagagggcacagaaggcgtacacgaagatggggatggagaaccacgccttggttttcgagaacgtctggctgaagcactgaagtcaggctccatgacctgtgtgcaatgcgtgtcacttctcagaaagcattccagagtgagatcatgtgcacatggtttgcgagcatcgtcaccgtcagcatgcgaagcattgaggaatgaccagggaccgcgcagcatcacgtccaccagacccagacctcttctggcaatcggaaaagagggaaaacttcccgaggtatcgtgcgagtgtggcccttccgattctgtgcgcagggatgcggaggacgtgatcgtcgtccaaacccgggtacacacgtgtacacccgagtgtgtgcgatgcggggttccaaggtgctggctcgttctgccggcaagggcctgcgggccttcgcctcgggccagaggggatcggacaaggtgggtggccggctcagggagtggggccgtcttgattccaggggccatcggatccccgcgctcagccctccccatccccttccctgcctcagtccggggccaagcctggcgaggcggtgtttgtgtccgccaagcaagcccgcaaccaccccgctgccaccgccaaggctggtcctcgtgccagccccccagtgccggcagcaggcaagcctgggcccgtgcctgtcccgcctcccgggccaccaccgagtactgggccgggtgctgggccgggagccggtcccggtgccggaacgggtgctgccccatcgaccaactggctgctgagcaagagcctccctgtggacgtgcgcctgctgggtctggggctggccgggacggctgcggcagcatacgcggtctgggacggcggcgacaaggcccctgggtcgagtgcagggggaaagacagacccgggatcgctagagtcggggcccgttccgctggcaaaggagcctcatgagctgcaggacccttatgcggtcacgcccccacccgaggaggaaagggaggagcatgtgcgtgagccggatgcgacgcccagcggggcccctgagtctgatgtcgaggcggcggcggatccacgccccgtcggccaggatgacggcgagggcgacgccggcaaggcggagactgtgtatgtggacagcaacgaggtgctggccgcgcttcaggacgtgctgggcaaggatgccgatgccatgatgagggagacggaggctgccctgaggcggggcggcggcgggggtgcctcatcccctgacagccccccgtcaccagtggatgcggaggcggcagcgtctcaggctggctctgctggtgcacctggtgcagccgccgctcctcaattccagcagtctggcgcggcccccggcaagcccgacgctgaagcagaggacagggaggggtccaagcgtaccgcccaggccgcgacggcaccgcccgcctcggccccccccgccgcccccgccccggcccgcagcagcgtgaaggcctcggggcgggaccgcacggttgcggagcacatgtcggccctgcatggcgccatctccgactcggtggcggagcaggtggccagcgacgtgtccaaggccggggtcaaaggcccgccccggccgcgcgtgccgctcaagcccgggcaggcgcccggcggcggcgaccgcggcgcg

SEQ ID NO: 34024 - DNA, 61 bp, Chlorella protothecoides
taatatagcagcaactctcgtcgaattggggtacggatgatacacccttggccacatggtg

SEQ ID NO: 34025 - DNA, 119 bp, Chlorella protothecoides
agtcttgatcacccgccaagagccgggctgcccgtcggagcatgtgcaaggcatcttctcttgcgagctcaggctcctggccctactcccaggccacgctcctgacccgcacactcatt

SEQ ID NO: 34026 - DNA, 75 bp, Chlorella protothecoides
gcgtcacagccacgagtcacgctgaacagcttgaggcaccccagaaagcagccaatggagccatgctttgggctg

SEQ ID NO: 34027 - DNA, 115 bp, Chlorella protothecoides
cttgcctgcctccctcgcaccctatttacaaggccaagttgcctgctctgaaccctttacctatgtacacaagctgcacaatccccccccaactcatatccctgccctctccaga

SEQ ID NO: 34028 - DNA, 68 bp, Chlorella protothecoides
gctgacgcctcacaacctggccctccgccgtctgcactcgcatctgcgccccgacgacaggacgatgg

SEQ ID NO: 34029 - DNA, 63 bp, Chlorella protothecoides
gtgccccgcaagcctgttgagctcatccaacaccgtgacacactcacgcaatcactggaatct

SEQ ID NO: 34030 - DNA, 61 bp, Chlorella protothecoides
ctcagcctggcatcgccgtggtaccctcccgggccggctggacgttcggcgtctcccaccg

SEQ ID NO: 34031 - DNA, 63 bp, Chlorella protothecoides
tcgccggcagttccctgggaactgctgtgctggttgggttaaagactccggtggaggaatcat

SEQ ID NO: 34032 - DNA, 149 bp, Chlorella protothecoides
atggggatggccgggtggaacccactgaaactctgctgccggtgggcatgcagaccagcgggcagcgcctccatggcccagcccccaccacaaaataaccggccctcccttttctctccgcagcggatgagtcgctggactatgtgcac

SEQ ID NO: 34033 - DNA, 135 bp, Chlorella protothecoides
tagggccgatgcggatgcccagaagctgtcgggcgtgctgggcgggtggggccgctggtggtgtgaggaatggggggagcggggcagtgtgtatggaggtgttgcacaccagggtccacatcagcgcagccaggg

SEQ ID NO: 34034 - DNA, 71 bp, Chlorella protothecoides
gggggggggttgtgctgggatttgggtggggcagcaacacttgcaaaagggcttgctgggccccggggtgg

SEQ ID NO: 34035 - DNA, 150 bp, Chlorella protothecoides
gctgtcgatggcctggcgcagggcagggtcggagggcggggcgacgcgcgcgaggagggcaggggtcgcctgccggctggggagcggggcgcttgcgcctgtggaggtggtgtgtggcgaggggggattggaaggtgctggggccctcgg

SEQ ID NO: 34036 - DNA, 133 bp, Chlorella protothecoides
gtggaaggccaggacaatgtgatctccctgtctaggtaaaagagcctggaaattggcccgcgcgtctgcaaagccctcctgcatggatgccctcccggccaggctcaccagcagcttgagctcctggggggcg

SEQ ID NO: 34037 - DNA, 61 bp, Chlorella protothecoides
agacaccccgcctcagctcctcccccccccacccgcctccccccccacacctcctgcagat

SEQ ID NO: 34038 - DNA, 70 bp, Chlorella protothecoides
taccccgtccagctggcgcccgtggaccccgccctccaggccctcctgccgcggcccgagagtcacatgg

SEQ ID NO: 34039 - DNA, 156 bp, Chlorella protothecoides
ggtatgtgtgtggtgcacaggagagtggttggcgatttttgcttgctggtaaagggtcatgcataagggtattgagggtctccgtccctcatctccttggtaggaatgcctcacgtcttacccctgtggcctagggttggtgtgccacaccgtgtt

SEQ ID NO: 34040 - DNA, 69 bp, Chlorella protothecoides
caatgcagcataccccaccacactctcatcgccccctctcatgcaggtcttctccgcatgcgtcatgtc

SEQ ID NO: 34041 - DNA, 71 bp, Chlorella protothecoides
cccttcatcaccctccccatccctccatcatccccccccaaacctccaaaggcatcggcgacctgattgcc

SEQ ID NO: 34042 - DNA, 133 bp, Chlorella protothecoides
gtcaaggcgatgccagtcgacccggggtccgctgccgtccccattcccgccgtccacctgctggcaggtggggcccggagggccgtgcagcgagaaggccttctgagcagtatgatcctctgcagccacaagt

SEQ ID NO: 34043 - DNA, 89 bp, Chlorella protothecoides
tgccaacctcttcgaagcagaaacgagaaacgcagggacccgccgctcccaatcacaccgcggccatctgtccaacgcacggagtcgaa

SEQ ID NO: 34044 - DNA, 455 bp, Chlorella protothecoides
  modified_base (152)..(363): a, c, t, g, unknown or other
ccatcgatgcgaagggttcaagtgggcgtctgtttgctggagggtttgcagctggctgcagatgttcattgacaagcgctgcctggctgcaggccggggcgtctttggcgagggcggatgcacgcatcatcattctcctcaatctcaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtctgcgtcgcagatgtgctgtccccaccagctctgagtggtcagtgaatgttccaactccttgtgtgctcctttccattccagggactg

SEQ ID NO: 34045 - DNA, 63 bp, Chlorella protothecoides
caagcatgaaccccatcaaggcagccactgcagcgattgccgaggatgtcgcacccccgctgc

SEQ ID NO: 34046 - DNA, 78 bp, Chlorella protothecoides
gccctcctgcaaggcatcaactccactgtggtcgacaagggctctgtgggcctcgtctactgtgagtgctggggtgaa

SEQ ID NO: 34047 - DNA, 120 bp, Chlorella protothecoides
gcgacggagccggcgcctgccggcggcgtggcctggctctccttcggtgactccacacgttcgccaggcagctcgagcggcacgctggagctcctgcgcgaccccatgagccggcggtgc

SEQ ID NO: 34048 - DNA, 155 bp, Chlorella protothecoides
gctcgccggaggaggggcaggagccacgcatgcatccgggagtccagcattcatccgcgcaccccgcagcctggcacctccccacgcacagactgctgcgactgcatcgactgattcgtgtgcgacactgttcaggccctcgtggaggggcgggg

SEQ ID NO: 34049 - DNA, 87 bp, Chlorella protothecoides
ttcgtctaggtggcgctgatgagagcacccgagggcagcattgcgtgggaatgtgcgacaatcagcccggcgctcctccgtccttcc

SEQ ID NO: 34050 - DNA, 92 bp, Chlorella protothecoides
gcaacatgcagggcagaggaggggcctgaggatgccttgggaggcaggtactgggagagtgtgcacgaggccgatgcacatgccagctctgt

SEQ ID NO: 34051 - DNA, 76 bp, Chlorella protothecoides
gggctttcagacgggctgagcccaatggatacccctcccactccaccaccccagacactgtcacagtgtcatcgac

SEQ ID NO: 34052 - DNA, 61 bp, Chlorella protothecoides
actgagtcagcaaaggaacattacaaagggggttttacccctatttagttactgcgggctg

SEQ ID NO: 34053 - DNA, 61 bp, Chlorella protothecoides
tcgacctggaaggtccaggtatagatggtcactcccagccatgcagctcacgccggcggtt

SEQ ID NO: 34054 - DNA, 113 bp, Chlorella protothecoides
catcccagaagacctgtgctgcccggcccccctcctgcccctgcctctgcatgcccgaggctctcacacggcatggaaactgaggacgtgcacggcatcagcgcgcgcccttg

SEQ ID NO: 34055 - DNA, 67 bp, Chlorella protothecoides
acaagaatggcatcatctgcaagaacatattctactcccgtgtatgcatgtagtatacatatgagtg

SEQ ID NO: 34056 - DNA, 73 bp, Chlorella protothecoides
tctgcggccgacgcgcgtgcccggcgtggcgcgcggcgcggggtctggcggcgcggcggcggcgccctcctcc

SEQ ID NO: 34057 - DNA, 84 bp, Chlorella protothecoides
ggcacaggcccctctgctctatcctacacctggccgctgagcctggtttggcacgcaccccagtctcattcctccccctctctt

SEQ ID NO: 34058 - DNA, 151 bp, Chlorella protothecoides
gaaggcatcacctcttccaccacgaaaggtcccatcccctcgatcaatgatacccccagcatcaccttcgaggaaaacgtgcccccctccctcgaagaaggttccaatcctttcagccaaaaaatccccaccttgtgcacaaaagatgcat

SEQ ID NO: 34059 - DNA, 96 bp, Chlorella protothecoides
cgtgcatcggcattcccaccctcacagtaacccatccccctcacatccgcctccccacccctcctccaaagtccctggcggcggccgtgcgtttcc

SEQ ID NO: 34060 - DNA, 71 bp, Chlorella protothecoides
gccatgctggcactcaggcgaccagcaccccacacccgcggtgcgcgtgagccatcccaaacttccgcacc

SEQ ID NO: 34061 - DNA, 150 bp, Chlorella protothecoides
gacttcatccacactcagactattgtatgttgtatctgcaaggatgtacgcctgcttggagggggcaccgatgtaagatctagcacgtcttcagagttggccttcgatggcagctctgacgctcaattcgtcccgcattgaatgacatcg

SEQ ID NO: 34062 - DNA, 577 bp, Chlorella protothecoides
  modified_base (237)..(246): a, c, t, g, unknown or other
gggggggggaaggggcgaggtttaattgtcgtaggggcagtaactgggaggagggagggcggggggcgggggccgacgggcacgcggcagacttctcgccctcgcacctcctcccatgcttactttgccgcctctccccactcctacaatctcctcgcaatccccagttccccagctcccccttgttgacaatgcaccccccaactcactcccaggcatgtccaaggaggaggtggnnnnnnnnnnttcctcccatactttctttgccgcctctccccactcctccaagcaatccccagttcccccttgttgacaatgcaccccccaacccactcccaggcatgtccaaggaggaggtggagaagtcgccgtttgtggagacgctggtggcgcgcgggtacgaggtggtctacctctccgacccgctggacgagtacatgatggggcacctgaacgagtacgacggccacgactttgtcaacgtggccaaggacgacctgcgcctgccggaggacgccgacgcaaaggaggcggagaagaaggtcaaggtgcggtttttgtgtgtgtgtgggggggg

SEQ ID NO: 34063 - DNA, 65 bp, Chlorella protothecoides
gcttcccttgccgaggagtttgctgtgctgggcgccacgggaaatggtgggtcctcgtcctgcgc

SEQ ID NO: 34064 - DNA, 70 bp, Chlorella protothecoides
aggcaaccaactgcgccagtggtatcccgtcggcgggaagaagctgctagcaaccggcgcatgcccggta

SEQ ID NO: 34065 - DNA, 61 bp, Chlorella protothecoides
gtatggcttgtgagcacccattcctgagcaaggtcggcgccgcttcttggcagggagccgc

SEQ ID NO: 34066 - DNA, 77 bp, Chlorella protothecoides
gccgcatgtaggcgtgctgcagtgtggaggatttattgcagggggtcctctgcactgacgcagctgcgccagaggag

SEQ ID NO: 34067 - DNA, 61 bp, Chlorella protothecoides
tgcctggtcgggagcggcgaccgggtcctcagtcggcgccagagggtttgcgaagctgacg

SEQ ID NO: 34068 - DNA, 70 bp, Chlorella protothecoides
taccggctgggcacacccagggctcgcaggagacctgtacacacacagcgacggcccatcgcgcgccaga

SEQ ID NO: 34069 - DNA, 78 bp, Chlorella protothecoides
acacacagcgacggcccatcgcgcgccagacccgcgacagcacccacccccacccaccggcgagaggatggcgggccg

SEQ ID NO: 34070 - DNA, 61 bp, Chlorella protothecoides
gaggttcaagaggaattcgctttataaagtcggtaagaggaaggtgatggtgggcatgccg

SEQ ID NO: 34071 - DNA, 61 bp, Chlorella protothecoides
accctaaccctaaccctaaccctaaccctatccctaaccctaaccctaaccctaaccctaa

SEQ ID NO: 34072 - DNA, 65 bp, Chlorella protothecoides
gcttgtgggagagttcaaggcagagaccatgcccttcaacagccctcacatgaagcccctctcct

SEQ ID NO: 34073 - DNA, 61 bp, Chlorella protothecoides
ggccaccaccaggcccgcggccttgaacaggagctccacctcgaacacgatggagttgcgc

SEQ ID NO: 34074 - DNA, 79 bp, Chlorella protothecoides
gcagtacagcgtccaagtcagcacagccgcagtggtctcgtggcccgcaatcagcatggtcatcaggtcgtccctcagc

SEQ ID NO: 34075 - DNA, 96 bp, Chlorella protothecoides
cccctgtgatctgcaggggtttggtcactcgcgcatgccctgccccctgttcattcccgctttccacagaacgcggtggatgtctgggcacgcacc

SEQ ID NO: 34076 - DNA, 80 bp, Chlorella protothecoides
caactagaaatgcacggccttatcggcgaatgacagcatcaccaggcacggtgctctgtagcaccgacctgtgctccgcg

SEQ ID NO: 34077 - DNA, 133 bp, Chlorella protothecoides
gtgacgccctcgtgatgcttgccaccctcctagatgtctggaaggtgaatgtacagcggtatgatagtaaaacaagcgtgagactgcatgcactgcgtcgcgtgtctcaccactggccccccgcctcgtcaaa

SEQ ID NO: 34078 - DNA, 70 bp, Chlorella protothecoides
taggcaggcactcggtgccacaaagaccctcgtcattcccgccccttagagagttgcacccttccagaca

SEQ ID NO: 34079 - DNA, 79 bp, Chlorella protothecoides
gctggccaggtggcgggagtgggcggcgcaggcccacttgagggcctcgccccaccaccgctcgcgcaggtcggtgtca

SEQ ID NO: 34080 - DNA, 154 bp, Chlorella protothecoides
gtgagtggaggtgtgggttcgctgtataccgtgccacgctgctgcaggggcctctggggcacgctcgaggtcggcaggcagcgggccctgagacccgccggctgtcgagcgccacctccacctctccaggtctggtgggagggatgaggtccac

SEQ ID NO: 34081 - DNA, 61 bp, Chlorella protothecoides
ggagcggggcagcgagccggtgaaggagggagaccatgttgcctggaagtggggtgcaggt

SEQ ID NO: 34082 - DNA, 160 bp, Chlorella protothecoides
actgcagcttatctgcatcgaggccagggttgccctcgatggtgagctcctggtggcgcagcttcctgaagggctccaggcacggccctggcccgaggccggcgtgatggacctcgctgcaaggtgtggtggaggtgttccgggatggggaatggggcac

SEQ ID NO: 34083 - DNA, 61 bp, Chlorella protothecoides
cagtccagagggctcgatcagcatcggcgggtcccactgtttcaccgatcaccgcacagct

SEQ ID NO: 34084 - DNA, 124 bp, Chlorella protothecoides
catgtgggtttagcccgcggaggtgggtgagcgcgacgtaggcgccgtgctccatctggtccagggcgtgcagcacccccgtgctgccggccgccgtctccccgtgccccacgcgcgacttggc

SEQ ID NO: 34085 - DNA, 61 bp, Chlorella protothecoides
gggccagtcacaagggagcgagggggcccattcggggccccatccacgagagtttggggcg

SEQ ID NO: 34086 - DNA, 79 bp, Chlorella protothecoides
gggcgcagggcgggggcctgcgattccctgcaggggagcaagtggatgaggaggtattgagggagcgcaaatcatggct

SEQ ID NO: 34087 - DNA, 117 bp, Chlorella protothecoides
cgggacgtgctggccagcaggcggacgcggttggaccgcgctttcttcgccgacctgctggggcgcgtgcccaccctggccccgcacctgctcccgggtctgctccggggctgcagc

SEQ ID NO: 34088 - DNA, 115 bp, Chlorella protothecoides
tgtgcttgcagcccgccgcctctgcctcatcggcaccgctctgaaccattgaaacatctttctggcaggagctggatgctctgctgttcctgtctgcatgcctgtgcccgtcccg

SEQ ID NO: 34089 - DNA, 71 bp, Chlorella protothecoides
ccccccccccccccccccccccccctccaacagtcatgcagcacatcatccaggtcctcaccacatcatcc

SEQ ID NO: 34090 - DNA, 66 bp, Chlorella protothecoides
taatgtatccctctgttgcatggcgcccttgcccacactgacgtactcttcgatttccttctgttc

SEQ ID NO: 34091 - DNA, 80 bp, Chlorella protothecoides
cggatgtcgattgttcggggttcaggggggggagaggttgggcagggatggactcaggctcgtggccaggggcaagccga

SEQ ID NO: 34092 - DNA, 141 bp, Chlorella protothecoides
gtgtggcggatcgatcgttgctgaggcctgctcagtacagcacgccttcacctgagggctccgaaaaccctaagggattacaggaccggtggcccacatccgcttggcatagacgttgcaccttggtgtccgatcgctgtc

SEQ ID NO: 34093 - DNA, 61 bp, Chlorella protothecoides
tggccgccgcgccggcggacgcagcgggggtggggggcgggggcgccgcgccgtctggcac

SEQ ID NO: 34094 - DNA, 2898 bp, Chlorella protothecoides
  modified_base (528)..(537): a, c, t, g, unknown or other
  modified_base (1090)..(1099): a, c, t, g, unknown or other
  modified_base (1401)..(1410): a, c, t, g, unknown or other
  modified_base (1718)..(1727): a, c, t, g, unknown or other
  modified_base (1842)..(1851): a, c, t, g, unknown or other
  modified_base (2494)..(2503): a, c, t, g, unknown or other
gcaccgcgtcagcgccgcggcatgcaccgcgccggagtggccgcgcagcgtgcgcagcacgctgccggccgccgagtgcaccaccgccgtgccgtcgcccgaggcggtggcaaccaggcccgctcgtccgccgggcgccacgtcgcccacccaggccgaatgcccgccgtacaccgccaggcgcgcgccggaggctacgtcccacgccgcagcggtgccatcctcggacgcggtgagcacgcggccgccgccctccgccaggcggagcgcgttgatgcgccccgtgtgccccgccagcacgtgtaccgtatccccgctgctcagcctccagatcctggggttgtgaattgtgaatggagagcagagactggggcacccagaaaaagaaaaaggagataccagtagcatcggcccttgcgcgtctcacgctacccactgataggtcatcataagacattacgcactcacctggcagtcgtgtcgttggaggcggagacggccaggtcctggtcagggaggacggccacnnnnnnnnnnaaggagataccaggagcatcggtccttgcgcgtctcacgctgcccactgatatgtcatcataagacatcacgcacacacctggcagtcgtgtcattggaggcggagatggccaggtcctggtcagggaggacggccacggccaccacccagctggtgtgccgagagtgcgccgccagggtctgcccgctgccggcgtcaaaaacgcgcgcgctgttgtcggcggcgcccgtgaccaggcgccctgcgccgctcaaggaggggaccagggccaggcagagcacgccctcgctccgatcctcgcggcaggcgcggtaggtgcgcacgacggcggcggccgacaggtcccaggcgtacacacagccatcgctggcggcggtgaacaccgtcctgccgctcacatccatctccaccgcattgatgtgggcgccagcctctgcgcaaggaaaggggggggagggatgatggtgggggccagggttgggaggttcgaggggccagggattggtgccagggtctgagatgtgaactggcaggctggctgcaggcctcatnnnnnnnnnnggcctctgcgcaaggaaaggggggggaagggatgatggtggggggcgagggttgggaggttcgaggtgccagggattggtgacagggtctgagaggtgaactggcaggctggctgcaggcctcattcagctcgacgacggagtggatccccagcaacatgccgagtgagcgggtctgggtaggcagacgacattcaaacctgagtctccagtcccagatgcacttctcctcccccgcccccaccttcatgcccagtcccccacaggaccctccacaacccaccgattgccaggacgcggagnnnnnnnnnngggcagacgacattcaaacctgagtctcgagccccagatgcacttctcctcccccaccccaaccttcatgcccagtcccccacaggacctcccacaacccaccgattgccaggacgcggaggcactgcccgcgctccatctcgtaggctcgggctgtgccgtcagccgaccctgagaccagcaggctgccgtcggcggagaggcacatggaggtgatgggcccgatgtggccctgcatgctcagcacgcagtccccgatctcctggtcccagacatggaccagcccgtctgccgaacctgtcgatcgnnnnnnnnnnacaccgcttcaacccggattccgagctacggataaacccccacattcaacccccctccctctgtcccgggccccacctgacacgatgtcgtcgcgggtgggggtgagcttgagcnnnnnnnnnnaaatacacaccgcctcaacctggtttccaagaaacggacaaacccccacattcaacccccttccctctgtccgggcccccacctgacacaatgtcgtcgcgggtgggggtgagcttgagctgcgtcacggccttggtgtggccccgcagcgtcagtcgctgcaggccccccgcctggtccagggagggggtcagcgtgcgcaggcagcgcacaccgccgccctccacggaactcgcgggagcctgcgccagcgccgcctcctgcgccgcccgccagtcctccagcacgccccccggccccgccgccaccatcagccgccccgccagctggcagcgcagcaggccggcggcctcggggtgggcctgcaccaggcccagcgacatctgcagcgcctccagcaccagcttgaccccggggtcagcgtgggcctgctggtagcgccggaagtcggccaccagtgcggtgtgccccgccgcctccagcttgccctccagccaggcggggtccagcaggatgccgcgcagctcggcgtcgtacccagcccccatcaggtggtgccccacgttcagccagaggtaggggtcgtggcgagggagggaagccagcgtgacgccctcgcgcgcgtaggaagccagcagggcgnnnnnnnnnnctggcgagggagggaggccagtgtgacaccctcgcgcgcgtaggaagccagcagggcgcggtggaaggcgcgcaccgcagagcccatggcggcctgtggtaggtgggattgtttgtgaggaagagggcacaggatggaaagaggtgcttgaagggcggcttgtggggcgcggcgcaatggtcttgacatcgcactggctgccatgctgtggtgcagcgtccagcaaatcgcgtcagagcgggctggaaaagtattatcgccgcgtggcatgctggcatgcaggtgggccccacacccaggcccgtcgacgccaagacccagggtgctcacccctgcgtcctgctagcctactgcattgggaaacgctcctgcgatacaacagcccgcccccaccc

SEQ ID NO: 34095 - DNA, 63 bp, Chlorella protothecoides
cagtcgacatcacctccccataccttcccacgaaacaggtggcgtggcatcaccttcatcacc

SEQ ID NO: 34096 - DNA, 115 bp, Chlorella protothecoides
tggccgtgcctcaggctcgcgggagggagggctgcccctcggcgcgagggtggtgctcgccggctcagcgctgctcgtctcgtttgtggggtctggaggaggaggggggggtctg

SEQ ID NO: 34097 - DNA, 6423 bp, Chlorella protothecoides
  modified_base (215)..(224): a, c, t, g, unknown or other
  modified_base (1036)..(1045): a, c, t, g, unknown or other
  modified_base (1684)..(1693): a, c, t, g, unknown or other
  modified_base (2670)..(2679): a, c, t, g, unknown or other
  modified_base (3145)..(3154): a, c, t, g, unknown or other
  modified_base (3708)..(3717): a, c, t, g, unknown or other
  modified_base (3796)..(4021): a, c, t, g, unknown or other
  modified_base (4340)..(4512): a, c, t, g, unknown or other
  modified_base (4653)..(4662): a, c, t, g, unknown or other
  modified_base (5231)..(5240): a, c, t, g, unknown or other
  modified_base (5911)..(5955): a, c, t, g, unknown or other
  modified_base (6312)..(6321): a, c, t, g, unknown or other
cccacccccccctcccgtccgctcaccctgggaacgcccaggagcgccgcctccgccaccgcctcttgtgcggtgcggtgcagcaagtccagcaggccgtcgaccgagaggagggcggcgcgcgggtccgggtcctggtcccgcctagccaccccaatcccgctcgccgcctcctctgcctccgcctccgcctccgcctcggcggcggccttggnnnnnnnnnntcgtcgacagagagcagtgcggcgcgcgggtccaggtcctggtcccgcccggcctccccattccccctcgccgcctcctctgccgcctcctccgcctccgcctcggcggcggccttggcggaccagaaggcgtgccggatgccccgcgcctggaagtagtctgcccacgcgctgcgcagcgtgggcggcagcaggtctgccttgttcagcagcagcaggctatgcttggtggcatgcagctcgtgcgcataggcgtccaggtcggggcaggcgtaggtcagcgggtcgcgcgcgtccaccacctggaccaggacgtctgagcgctccagcacgcgccagagctggcgccagacctgcaggttcttctcgaagggtgtgagcaccagcgattcttcaccctccagcagcgccaggtcgcggcgccaggcgaggaaagaggcgcgctcctccgcgtctagcgccgcgggcgtggtcccctcgtcccaggacggccggcgcgggatggtgaggcggtggcggtgccgctcctccgcagcgctgcgctcggcctcggcgcgctcggtgtccctgggtgccaccgagccggtgctgatcaccaccacgttctgcctctctgcggagaagtccttgtccgccagcgtggccttggagaggggaggggggatggggggattgagagaacgtaagggataaaataggagggagccccctccttgcaggggcagcaaaatgggcagcttgggatatgtgcccaggggcgccccccgccttcaaccaccctaacagcgcgtgcatgcagggcatgcatgccnnnnnnnnnncgccaccgagccggtgctgatcaccaccacattctgcctctctgcagagaagtccttgtccgccagcgtggcctagggtaagggggcgggggtttagggaggggggggtgacagaaggaaagggataaaataggagggagccccctccttgccggcgcagcaacatgggcaggttgggatatgtgcccaggggcgccccaccttcaaccaccccaacagcgcgtgcatgcagggcatgcatgccaaggcaatccccacgccatccattagcttcaccatggccatcatctcgtccaggtcgttgcgctcgatcacgctctgcatgttgttgtcggggcccaggtccgtggtgtacatgtgtgccgccgccccggcggtcctgccctcccgcttagcgcgattcaccagggactgacccacggagagtcccgacttgcgggacttaccattgtgcttccccatggccccgagaccccgcacaaggagggagtcgggggtgtggcgggtgcttctcgaccgcctgcaaacactcctactgtgcttcactttggataagtatggaaattcaaaaagtacaacccacacatagtattgtgaagacttgcgtcagcgagaacgtggggcgcttgacacaatcgnnnnnnnnnnaggggtgtggcgggtgcttctcaaccgcctgccaacactgccactgtgcttcactttagataagtatggaaattcaaaaggtacaacccacacataatattgtgaagatttgcgttagcgagaacgtggggcgcttgacacaatcgtcgcgccctgtgacctcgcgcccagacgaagtttggggagaaccggcacagccaggaaaggggtttcctggtacactgccaatatacatgcatttgcaaatgggagagggtgcggttctacttcttaggacgagagagataataattgtggttgaagtgcatgatgctggccgacaagatgatactgctgtcagatgtaggagactgcggtgcatgtggcaggtgtacccaacagaggcagggatcggcttcaagcaagggcatcatcgagctttgaaccaaatggtaccgttcccttggcacgggtatgcgacagaaaaggctaagtgtttgcgctaaaggactcttgaatgctccccttcagggctgttgcaagcaagaattgattagttcagttgatggggaagttcgagttttctgatacttcaaaggagcatgaggtcggaatgtttgaatcattcatttcaccggatgtcgctcctagcggcggcgaggatgatccagacttgcaccgcgcacgcctaacgagacctgtggtcggattgacctcatggctgagaaggatgtcgtaagcgattccaaaaagtttgtggagggtccagcgcgatgaaacacaaatgaacggcggactgcttcggcctagaacacaccctgtggaacgcttgtgaaacaatcaattgtccgatctttatggatatcatttgaccccacaaaatgcttgctgcgttggtgccccaaaggattgaaagaggggagatgacatcagtcagaaggttggggcgaaattcgcgtgtcgagagtggcttcaatactttctaaaaaattctcaannnnnnnnnngtcagtcagaaggttggggcgaaactcgcgtatcgagaatggcttcaatactttctaaaaaattctcaatgttcgaccaccctgtgaggggagtgccagaaccctcgcctgccttcacaacatgacttcctgtcccgcccgcgactctctaagccgagactgaatccatgctgcgccagccgatgtaattcattttcagaaatgccttctacagttaaaactcccagtgagacattacgcacgatacttgtaggtctcgaggtggggagttaacattgtctgaagtacggcttccaacctgtcgagtcgaggaatgattccaagcagttgctgtaacaggaatttcgctgccccgttcctattccatcgccgcctacgctagtgcgtaggggtactcatccaccgaccctacctgcatccgtagtattgcctatccccatccttgtcctcactgtaagcatccagnnnnnnnnnnggtgcgtaggggtactcatccactgaacctacctgcatccgtagtattgcctatacccatccttgtcctcactgtaagcatccagtgacatccagacgagagtttcaactcccgagccgtgcctcgatgattatatatcgctaccccattcacgtgcctattccggccttcccttttcaattgcggtagccctgacgtgctgccgggtgtcatccggaaaccgaacctgatttgcccggtcctgtcgggccgaaccagcaccggcatgtgtgtagtccgatgcagcccttagtaaggtctcgttcacttcagcacgggaacaagattacaataagtctatactttgagctggactacgcttctcgcgaggggagtctgtataagagcttatgagcgcacactttcaacccgccaggggccttgtagtcgttgtcgtgactctctttttcattcaggttcgcacagagcaacactcgagtgcattgacataatttaccatgctatattatcccccagtgtagccaagctctgagttgcccgtccctttctctgcnnnnnnnnnngtacattttcagaaatgccttctacacttaaaactcccagtgaaacagtacgcacgatacttgtaggtctcgaggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatccagacgagagttttaactcccgagccgtgcctcgatagttatatatagctaccccattcacgcgcctcttccggacttcgcgtttcaattgcggtcgcgctgacgtggtgccgggtgtcatccagaaaccaagcctgattgccccggtcctgtggggccggaccagcaccggcacgtgtgtagtccgatacagcccttaataaggtctctttcgcttcaccacggggatacgatgacaattactctagaatttgggctggactacgcttatcgccagggacttctgtataagagcttatgagcgcacactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgccacacccatgtcgttgcacgctactcaagcttatatggtgaagaaggacaaaacgtctcccaaggggggacagtcacttgccgtacggcaagcggttgcggctccacaatcgcactcgcaacctgaagcgaacannnnnnnnnngactcgagtgcattaacataatttaccatgctatattttctcccagtgtagctaagctctgagttgcccgtccctttctctgcgcgtaggttacacatggcgaccactccgaccaagcgtcagggagttcaagagccgattccgctgtccaagcagggaacggttcgctgagtgtaaccttcggccatgccacacccatgtcggtgcaagctactcaagcttatatggtgaagaaggacaaaccgtctcccaaggggggacagtcagttgccgtacggcaagcggatgcggcttcacaatcgcactcgcaacctgaagcgaacaagcgcctgccgatttcagcgaggaagagtccacctcccctggtaaagaagagccctccaattccagtaaggaagattccgtcacccccagcaaagaagaaaccacctccctcaacgaagaagtggcctccacccccagtcaagaagacccctcctccggcacgaaagagccaacctccccctgcacgaaagagcccaaccccaatgaagaagagcccacctccccctgcacgaaagagccctccnnnnnnnnnnagaggaagagtcctcctcccctggtaaagaagagccctccgattccagtaaggaagaattcgtcacccccagcaaagaagaaaccacctccctcaacgaagaagtggcctccacccccagtcaagaagacccctcctcctccggcacgaaagagccaacctccccctgcgcgaaagagtccaactccaatgaagaagaccccacctccccctgcacgaaagagccctcccccagcaaagaaggccccacctcccccaccacgaaagagcctacctcccccaccacgaaagagcccacctcccccaccacgaaagagcccacctccagtgaagaagagccctccaccacccccaatgaagagtccaccaccccccacaaagaagagccctccaatctcaccaaggaagagtccacccccaccagcacgcaggagtcctcccccagtcccaaatccccagcctcgtcctttcccccctatgagtgttcctccatcttccccgccaccatcccaccccccaccaagttcctcaccatcggcaccttctccaagcttaccacctcccccaccatccccgagtcccccaccatcaccccctccgccaagccccccaccatcaccccctccgccaagcccaccgctatcgcctcccccgccaagcccaccgccatcnnnnnnnnnnnnnnnnnnnnnnnnnnnnnnnnnnnnnnnnnnnnntgccaagcccaccaccttcaccccctccgagtcccgcaccgcctagcccaaccccaccgcccctgacattggaagtgagcatggcgctgtgtcaactcctcggcatcgacctgtattgcacggcgacgataggcatgtcccagagcctgagcacggggaccctgcggctgtactgggaggtggatggcaccaccaaacagggcaccaagtttgtgccctccggcactgtcacctcgcacacagacgttccgttctatggcacggtgagcggcgtgctggcgatgtactccgacgcggggggagaaccggtggcgacttccatggatgcaccagtccccttcaatgtcccccccccgnnnnnnnnnncatggcacggtgagcggcgtgctggcaaaatactccgacgccgggggagaaccggtggcgatttcccaggaagcaccagtccccttcaatgtcccccccccg

SEQ ID NO: 34098 - DNA, 106 bp, Chlorella protothecoides
ggggaatccctcaggcccttcgctcatgataaaacccctctttcctggtcctgcatgctccttgcatcaccctctcgttcctccccgagtccaccaggtgctgcgg

SEQ ID NO: 34099 - DNA, 61 bp, Chlorella protothecoides
aaacccggacgaccagaccggttttgcgggccccctgacgagcgagaagattcagacgcag

SEQ ID NO: 34100 - DNA, 63 bp, Chlorella protothecoides
agcaatggaggtgctgactctccggcagacgaagaggagggagttggagcgggcctcggcagc

SEQ ID NO: 34101 - DNA, 72 bp, Chlorella protothecoides
tggatgcatgaggtgggaagtttgaaccccactcgtgactgctttacacacaggtgcccatgctgcaatact

SEQ ID NO: 34102 - DNA, 80 bp, Chlorella protothecoides
tcggctgtcatggtggaaggaggaggaggggtagatattgaggtaggactcccccatcatacattgtgcctggcaaggct

SEQ ID NO: 34103 - DNA, 61 bp, Chlorella protothecoides
tgtggcagggactcagatccccattctccaacgtggccatgggggcactccccaacaagcc

SEQ ID NO: 34104 - DNA, 61 bp, Chlorella protothecoides
ggtgtagtctatgccggtagactctactccagaggagtgcatgtaggcctggacagcaggc

SEQ ID NO: 34105 - DNA, 61 bp, Chlorella protothecoides
cttgatccagaggtcacgcgcccgcttcacatttccctccgtcctttccagctggccccag

SEQ ID NO: 34106 - DNA, 62 bp, Chlorella protothecoides
gtgtgtgtgtgtgtgtgtgagtgtgtgtgttatataggagaggggatgggtggcacgctggt

SEQ ID NO: 34107 - DNA, 97 bp, Chlorella protothecoides
cccctggcgtcaacggagcctgccatcaaggatctgcacatccctctgtctctgtgccaccgtgattaatggagttcaagtccccatccccctcaat

SEQ ID NO: 34108 - DNA, 61 bp, Chlorella protothecoides
ctttgcctttccctggtatgcaaagctgccactcacctttgggctgtccccacgcatctac

SEQ ID NO: 34109 - DNA, 61 bp, Chlorella protothecoides
cttcttctgtggggtccagctggttgatgaaaatatagagagtcaggtcttgctgtctagg

SEQ ID NO: 34110 - DNA, 418 bp, Chlorella protothecoides
  modified_base (152)..(268): a, c, t, g, unknown or other
ggatgccgaggggctggagggccaggatgcggtggaggccctcacctacctcgccgactgctatgaggtgcgcgggtcgatgggggtgtaagtgaggtgtggggccccggcggtgatccccggacaggggtggcgctgccctggggctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaacccgctcactgatacctagagatcctgctgtgtataagagcgttccagatggccatgctcgagcagcagtcatgcagacatgctccccccctcccgctcaggccgagggggacagcacggcggcggaggcctgcctcacgcgcct

SEQ ID NO: 34111 - DNA, 81 bp, Chlorella protothecoides
ctgcattctggatctccctgcaggtgtgacaaggatgcatggggtgtttgacacgctctcccatggctcatcactgcaaac

SEQ ID NO: 34112 - DNA, 77 bp, Chlorella protothecoides
agctcgcgcaggaagcccacgcagcgaaggggcggccgaccctgcaatccaatgcatcctgagccccactcctgaga

SEQ ID NO: 34113 - DNA, 665 bp, Chlorella protothecoides
  modified_base (183)..(192): a, c, t, g, unknown or other
ccgccccaccccctgccgccccggcccccctcgccgccgcccatagtgcaaccagtggggacggtactggtaggggccagcgccttcaccatctccgtggacacgggcagcttcgttttgaggagcgtgctggtggcgtccctggatgccacggggaccatgatagcaagcactcgtcagtannnnnnnnnnccagcttcgttgtgaggagcgtgctggtggcgtacctggatgccgaggggaccatgatagcaagcactcgtcagtacatgttgaagacgaccgtccgcacctgggaggacgacctggggggttacttcacctcgcacttcagcagggctgtcgcctcaagcgagatggacggtcttgacccgggaccactgccatgggacctggtgcagctgttcaaccccccgccgcagccgtcgccacccccgccgccctttgtggacccctccgggacggtgctggtgggggtcaccaccttcaccatctccgtcgacacgggcagctacaaggagctgaacgtggtggtgacatactacgacgccaagggggtgcgcatcgggttgacgcgccaggcgattttggggaccactgtccgcacctggaacgacaacctggggacctacatcacctccgccttcgccaccgccaccgcctac

SEQ ID NO: 34114 - DNA, 100 bp, Chlorella protothecoides
ggtcctgctgggaaggtacaatggccagggcctcgagaacgagccggaggcagacctgatctcctactcgaggactacacccccagacccctcccaggca

SEQ ID NO: 34115 - DNA, 118 bp, Chlorella protothecoides
ttttacctggcggccccacgaccatggtgagccccggttgcacgccagagaggacggcggatgtctgcaccggggtgaaccgcacgccgttttgcggcggctcgtcctcagggtacgg

SEQ ID NO: 34116 - DNA, 88 bp, Chlorella protothecoides
ccctccaacaccctccgaataaccacgggatcggactgcagatgcagcggacaatttacggaagggccacagtagtactccaaggctt

SEQ ID NO: 34117 - DNA, 74 bp, Chlorella protothecoides
ggacccgagtctccagagggcggggatcactgggtctgacaagggtggcgggtgaggagcgcctgacctcaact

SEQ ID NO: 34118 - DNA, 103 bp, Chlorella protothecoides
gtaaagctgtttttctggcgccctgccaagcctatggagcgtcgcaggatctaggctgccgctcacatgccgtacatcaagcatcctcccggacccctccccc

SEQ ID NO: 34119 - DNA, 73 bp, Chlorella protothecoides
catgctcatgctgactaagtgtttttttgagaatgcacctcgccccacagcttttggtggaccccctgcttcc

SEQ ID NO: 34120 - DNA, 220 bp, Chlorella protothecoides
ggggggccagaagagcgggcaggccgcgccagccaccctcgagctcctcactgccgcaggcagctggctcttccacctgcacgtgtgttggacagggtgggattgggaggagaaaagggcatcggaggagcgtcccgggaatttgggtcgaggatgctgatatctcaagcctctccatgcagccagacacgtgcatcagatctctgcctccccggcacca

SEQ ID NO: 34121 - DNA, 125 bp, Chlorella protothecoides
tccgtgtaccaaaattaatgtccttgtgactctgctgctatcccatcggttgaggtcaacctggtgcctcatgtcgggacgcatgtcccgaggctacggccatggtgttgcgctggcgcggctgg

SEQ ID NO: 34122 - DNA, 76 bp, Chlorella protothecoides
ggtgtatgatcaaatctgatcactccaagcggtcctcaggattcgtactcgccgtgggcccggcacattcgggcac

SEQ ID NO: 34123 - DNA, 61 bp, Chlorella protothecoides
cccacacccttcaagcttccagctgccaaggggggcagatgggatttcggtcgcaaggtga

SEQ ID NO: 34124 - DNA, 61 bp, Chlorella protothecoides
attattattcacgtccccatcgatccatcaaacaccttgaaagtcctgtgtcgctctctca

SEQ ID NO: 34125 - DNA, 61 bp, Chlorella protothecoides
cctggcgcgcaagctgatcgacgccacgcgccggcgcaagggcctgccggtggaggagaag

SEQ ID NO: 34126 - DNA, 61 bp, Chlorella protothecoides
tgaactcggcattgagagcggcgcgcgcgcgcaaaatcagtcagatcatgaggacctcttt

SEQ ID NO: 34127 - DNA, 75 bp, Chlorella protothecoides
tgcgacgtgcgcctccacgttcccgtttgtatgatgacagcaatttggttcaactcgaagcagccagctgcgtat

SEQ ID NO: 34128 - DNA, 61 bp, Chlorella protothecoides
agtcctgctcactccggtcaagtgtacattatgttctgcaaagcatgccctccgcgctgcc

SEQ ID NO: 34129 - DNA, 140 bp, Chlorella protothecoides
tcgccgagctggcaaggtgtggcattacatagggcatgaaagggtgtgggcgggcatgtaatgtggacatctatagaggtcggagcgcatggctatgatcgagatcccgtctgcatccctgcacacgccatgcagccagg

SEQ ID NO: 34130 - DNA, 78 bp, Chlorella protothecoides
ggcccaccaggggaaggtaagcactgggcggagagagaggggccctattgggttgagcagtgaggccttgctggaggg

SEQ ID NO: 34131 - DNA, 61 bp, Chlorella protothecoides
cagacctggactcgggaaccttgggtgccttgtgtcttccaatcgcagcccacgcctttgt

SEQ ID NO: 34132 - DNA, 77 bp, Chlorella protothecoides
taccattcaaagcctcggcaccttccttcactgcactcatgcacctccttggtatgctccgctcagttaatggattt

SEQ ID NO: 34133 - DNA, 121 bp, Chlorella protothecoides
cttcaccaggacttataggcctattagtacaccccatcaacatgtctaacccccttcacccctactcagagacacgacgcactgccccacccccccctgcatttcatgtagctgaataact

SEQ ID NO: 34134 - DNA, 61 bp, Chlorella protothecoides
ctcgggccgcaatgcctacatacctatcgtgtcgggcgtgccgcccccgcgtctgccgcct

SEQ ID NO: 34135 - DNA, 1439 bp, Chlorella protothecoides
  modified_base (183)..(267): a, c, t, g, unknown or other
ggcgctggcgcgcgccgagcccgcgctggggccgctggacgtgcgcgctttcctggacggcccgctggcggcggtgcggcgcaagcccgcgcgcctgcgcgtcgcgctctcctccctggacgcggccttcaacctggacgccgccatcgccgccgcgcacgcctacacgcgccgcgcgctggnnnnnnnnnnnnnnnnnnnnnnnnnnnnnnnnnnnnnnnnnnnnnnnnnnnnnnnnnnnnnnnnnnnnnnnnnnnnnnnnnnnnnctcttcgtcaacggcccgctgcccaacgccagcgagggcggcggggacggcgcgaccaaggtgagcgtgccgagagggtgtgtccgggggggagggggggtggggaaggggggagcggtgggttccccacaatgactgctggggatccagggggtcacagcgccaggcacgctccgcacagcagccaggggcacgtgccgagcctctggtgggcgcgggctgctcctcctggagtcccatcccacttgaccacggcgtcccctccagccgccccccacccccctcaacccctcgctgcgccaggaggccatggacgagcagtttgagctgctgcaggcctggcatgcctgggtctcccgcgaggtgggccacttcaagtccaagttcaggggcgcggcggccaccgtgctgggggcggccaactgccgcggcttcacgctgggtgagcgagcggagggggtgggcaggggtgcatcgaggtgggtctgagagcgggggggtgtcctgcatgggcgagggcgggtgacgcctgctcaccccaccgtgcacgatccccctgcaggggtggagaatggggagtacgagggacccctcaagctgcacctgcccgtcaacatggagctggaccccgacggggccttctcctttgacgcgcccctgccttcgcccaccggcaagatcggggaggtgaggcccagagatcctgtggtttacgagtgcttggcgtggatgaggcggggcgtgtggaggtgtgccccaccgggggcgtgcatgcaagcctagccacgtcgccgtgggagggggagggcccgcaggccgcagccccgcgactcccgctgcgactgccagagccccatgcgcgcctgggtgtgacccgccgtccgccgtccatccatgcagcacccacccccctcccgcaccgccgtgcagttcatggacattttcaaggcgctgacggtgccgtcccacctgcgtccgccggccgccgccgtcaactgggtgcccctgagcggggaccccgccctagacatggccatgagggagcaggtggcctgcggcgtcgccctcatcgccaaggtcctggacaggctgggcgaggcggcgcagcgggaagggaggccggggaaggtgaggcgtgtgtgtgtggggggggaagggggaagagggggggg

SEQ ID NO: 34136 - DNA, 61 bp, Chlorella protothecoides
ggcgacggtgtagaagccggagccaatgtagtgtgggcagtaccgcacgaacccctccacc

SEQ ID NO: 34137 - DNA, 116 bp, Chlorella protothecoides
tgctttgcagcatccagttcctacacccacaccatgcagtagtgtgcatctcacccctgtacgtcatctacccacttgcctcaacctcagggagcagatgcagcgggagctgagga

SEQ ID NO: 34138 - DNA, 126 bp, Chlorella protothecoides
agtgctcgtcacatcctcatcagcttccactcagcttgaactttgacctacgaaatacctgcactgcgggctgcagccttccccacacgatgcacgtgcatcccttgcctcacctgtccacctctg

SEQ ID NO: 34139 - DNA, 78 bp, Chlorella protothecoides
atgaaactacaaggttgaggtcggttggacgggggggatggttcgattgggccgagggtgatcatagcattcattctg

SEQ ID NO: 34140 - DNA, 61 bp, Chlorella protothecoides
ggaggagtctcccgggacggcgccggcgggggagggctcctgtgtccccgtctcctgcacg

SEQ ID NO: 34141 - DNA, 4266 bp, Chlorella protothecoides
  modified_base (1437)..(1446): a, c, t, g, unknown or other
  modified_base (1901)..(1910): a, c, t, g, unknown or other
  modified_base (2610)..(2619): a, c, t, g, unknown or other
  modified_base (3482)..(3491): a, c, t, g, unknown or other
cgtcgcgccggggacgaaggaccacactcgctcgtagcgcgcgcaggccagcagcggcgcgcccgggtcgggcgcgcgcagcggctccagcgcgccgccggccaggtgcgccgccagggccagcacgtcgggagccagggtgagcgccaggtcggacaccgccagcgtcacctccgcggcgggcagcggcgtggtggtggtggcagtgccggagctgacgattgaccccgggtctgcacccgggccacgcagctcaaagtccaggctgacgtggcagggctccagcaccggcgcgtccaggctgccgcgccgcttcttgcgtcgccgcttcttgccgtcggggctgccggaccgcgccgccgccgcctggccgccctcggcatcgccatccctcgcgccctccccatccgcgccctccccgtccagggtccggctctccacgtgcagcccgtgcagggccaggcggccagccttggcagcgccctccagccgcaccgacgcgcccaggtccatggtcgccgcgagcacgtgcacggagcgtgccgcgacgtccagctgcgccagctgcagcccgatgcccacggctgacaggctgacctcgaagcacggcggcggggtggtgggggcgtcggacgtgtttccttccccgccgaaccccacccctccttggatcacatcgccttggaactccccaccacccgacgccgcctcctcccccgctgccaggcactcgcccatggcccgcgcagcggcggtggggttgtcctgcagcggcgccggcagcagagcatgcgccagcgctgcgtgcgctgccgcgccctctaccagctcgacgccgtcgcgcggctccgccagcaggcgcgcgcctggggcgagccgcaggcacagcgccagcgagtcggcgtggagcaggcgcaggttgcgcaggcgcagcgtacacccggtgcccaccagcaccagcggcagcggctcgtccagggagctcggcggcggcaggatcagcgcatgcccgccgccgtcgtactcaaactcggtggcgccggggcggtccgccagcaggcgcgcacagggcgagagccagaggtctgcccctgctgggccgggggggtcagggccgcccagcaggaagtcctggcttgcataagggatggggtggttgcccaccactgcaaggcccggcagtacaaaggcgacggtggccagcaggaaagacagctccaccaccaactctggcttctgcagcgtgacacccagcttctgccgcgccatgccggggctggcactccactgtgcgcatggatatcattgaggggggtgatggtgaggattcttggactcaggggcaatgttgactgcaagacctggctggtgcatagattgggcgagccgtccatttcccttgtatttaccccttgtaccatgctcttaacagccccnnnnnnnnnncgcaatacctggctggtgcatagacagggcgagccgtcaattttccttttatctaccccttgtaccatgctcttaacagccccgcggtacctagatatgtactgtgctctccccttccccccccccttttccccccacttcgcctccaccacacccctctccttcacacccacctccatgatcaagaaagaggccttgttggccgaggtgatgacgcggttgtgggaggtggggacctcggggcgcaagtccacgccctccacgcgcggcaggcacaccgacaccgccatgctcccctgtaggattcaattctcattggtgagctatagggacagtgcgcattgagaccggctgaggggtctggactgccccacgcactgcgcgacggagagaggtgaggcgtcaacccctcttcacccccctccttctcccacccctcctcacctcctcggtgnnnnnnnnnngggattcaattctcattggtgagctactgggacagtgctcattgacaccggcagaggggtctggactgccccgcgcactgcgcgacggagagaggtgaggtgtcaacccctcctcaccccccttcttctcccacccctcctcacctcctcggtgttgtggaaggcgaggcccaggtcctcgatggagaagcgggccagtggctgtggttcgcccacgccctccaccagctggtgcagctccagctcggcgcgggccaggctcaccaccacccgcacgttggtgggcgagacatcctccgtgggcgcgatgccggctgacagctcctcggccgcctcggccgccgccgcctcctgcacggcggggagggccggcggcgcgccgccgtgcgccgccagcgccgcagcccgcgccagctgcgccatggcgcgctcgtagtgcagggtcagccactgcacgccctcgggcggctccggggcctcggccacgttggccgcggcgatggaggtgatgcgcgcgtactcgccgttgtccagcacggcacgcaggatggggatgtccagtgccaggtcgaactgagggttgaggaagagttgggggatggctgggggatggagaaatggagggatgccagcacgagtcaagggtctggaaggaaagctgcaaaagccgggccaggccacggcaagtgtgctcatctcnnnnnnnnnngggaagagttgggggatggctgggggatggggaaatggagggatgccagcacgaatcaagagtctggaaggaaagctgcaaagctgggccaggccacggcaagtgtgctcatctcggatccctgataccaaccccagctgcactcccccctcctcaacaagaagtccgaacccaagcttcaccctcgggtcaaacccaccttgggctgtgggccgcgcgcctcgggctgcagcgggcgcttccagcccagctgccacgcctgctcctggttcttgaacacgttgcccccacgcttcccggcttgcaccacgcagcagctcatgcctggtggttggtgagggaagcgggggaaagggaggggggttaaatgctggtgatgggggagaatggcacaccctatgccttaccttccggggctacaatacgcctggaagtccagctagacatctccccatccccaggctcactcacagcacttacatgcccctcctccaccaccagggtcaatcccccttgtcaccagtgcccacctgagaaggccagcgcggcctgctcctggagcacctggacgccccttttcccgcattcctccccgggcacctcgaccaccttgctgctcaggctgaggttccccaggtccacctccaggctatccaaactgtgggaagggaggtattgggattccggggatgaacaatgggggtcgaggagattaattgagcacagtgtccatgaaggggcgcagcaagcacaaactgcccaccaccccctcgtcacacgcaggtccggggacaagccagccagccggacccccccacacagacgcaacatgtgcacacaaacctgttggactggcggggcannnnnnnnnntccctcgtcacgcgcaggtccggggacaagccagccagccgggaccccccacacagacctaacatctgcacacaaacctgttggactggcggggcagcacgatgatgggcgcatccatctccacgtccaagaccagcacaaagggctgctgcgcctcggccaggggcagcggcggcggcgcggcgcccctcgtccgggcgctggcggtgcgcccgggtccgctgctggcgccccgcagcggcgtcgccgggcgcgaggcggaccccgtggagcgcggggttgacgcgcgtggtgtggctccaccgcttcctccggccgggaccgcgcgtccttcctccaggggcacgccccccgcctgatccaggcgcatggccagcatgacgctgacgtaggacaggtgctccgccagcaggcggtagaggaagaccagctgcagctggctcaggcgcgcggtcaggtgcgcccaggccaggccggggggcacgcgcgggtcggcgcgtgcgcccgccgggtacatcttgaactccacgtccaccagcgaggcggtgccgtcgccgcgcaggccgcaggcacggcggtaggggtgcgggtccggcagcgtgccgtcgagcacctccgcattgcccaggcgggaggtcaggctcagcacgccgcgcgcgtcgacgtccaggccgaagcagaagccttccacggcggcagtggacagcatgcgcgcgccggcgccctcgtagttcagcgacaccgccagcgtggagagcgcgacgcgcatgcggaa

SEQ ID NO: 34142 - DNA, 86 bp, Chlorella protothecoides
catggtgacgtgggggttcagcctgtgcttcaccaccagcctgcttgaggggggagggggtgaccaatgagcgccgtcgagtcggg

SEQ ID NO: 34143 - DNA, 71 bp, Chlorella protothecoides
cacacgtaatctgagccgagaccaagtgctgtttaaagacggggggtggcttgacagggaggcatcgagga

SEQ ID NO: 34144 - DNA, 117 bp, Chlorella protothecoides
ggtgccatggaaggggccaccttgcacatgttatcattgcttctcgacccggggccccctccaaccactccctcgcgctccccttcttcccccccggcgtccaaatccagggtgtga

SEQ ID NO: 34145 - DNA, 78 bp, Chlorella protothecoides
ccacgccagcgcccgtcgcagcgacagaggaaccggcgccgcatgacatggcaagcgatcaggatgaggggctggcac

SEQ ID NO: 34146 - DNA, 140 bp, Chlorella protothecoides
ccgcgcacgagatcatgcgagcactgaggaagacaagctgcgacctctccctgcacatctgggatgggaataaagagataatttattatacacttttcacagttggggcatagcgtcagcaggatcatgctcccgacgtc

SEQ ID NO: 34147 - DNA, 107 bp, Chlorella protothecoides
tagcgggtggtggcgctggagccgtaccggctctcggaggtgggggccttggagccctcgccgtagcgggtgccgccctcgtagcgaccgccgtcgttctcgccgtc

SEQ ID NO: 34148 - DNA, 1927 bp, Chlorella protothecoides
  modified_base (100)..(109): a, c, t, g, unknown or other
  modified_base (218)..(227): a, c, t, g, unknown or other
taccaagtcatcaccgcgtgtgcgtgagaatcacctcattcacacgggaacggacgggtaaaaatgccattacattctctcccagccctactcactgctnnnnnnnnnncgtcaggaggagggggtaaccacagagccccagctcaaaacacaggaccagtcgcacacgctaacccgagggcctcgataccaagtcatcaccgcgtgtgcgtgagaannnnnnnnnnggtaatcacagagccccagctcaaaacacaagaccagtcgcacacgctaatccgagggcctcgctaccaagtcatcaccgcgtgtgcgtgagaatcacctcatttacttgggaacggacgggtagaaatgcccttacattctctcccagccctactcactgcttgttggcgaggatacccgcggtgacggtggtgccgttgttgccacccagacccacgagcatgactctgcggcggagaggggtggtaagccattggttcacgccaatgtacaggacaagctgtgcagacaccctcgctcacggggacggcggccactccagacccccgtctcaccccagcttcggcacgcggcggtcggttttgaacttgtaggccacagtcttggggtgcagctcccaagcgccgtccgcggtcatcttcacctcggtggtctggtagtcgtaattggaggtaatggcgtcctcgctgtactccacgttggggctgaccaccttgaagtccttgacgagcaccatcctggcggggtgggggccggcacgagcaaggcggcagggagggcgggtcctggagaagggttaaaactgtgagcgaacagtgacgttttcatggctcagggggcgtgtcaactcaaggctgggggggtcggtgacgtgggtctgcctgccgggttttcggaccttcctgtgagcggcgcggattacgagatcgttctcagctgggctgcggcgccgacaagtccctgagtcaaagggctcggcggtggttacacagcatttcacgtcaaggagtgcaccggtccaaggcacaagctcacaccatggcaggatggtcactgaaaactcctgccaggcgtgcgccggctacatgatagagcatgtgcagcagcccttgggcggcacggcatccaccacacgctccggcttctgcatgttcttggtggggtcgtagtcgtgcatgctgcgccaggtaaggttgttgtcggggcgtgggcctgagggagactccgtttttgcagcctttggatttgggggttggggaggggagggggggttggatcatccttaccaggggaccctgggcatgcatggtggcacggaacagcaaaccccagcgcccaccagctcggcgccgggggctgaggcgacggtcacacccaggtcgtacgagttctccgccgtcggtgcgcacagtcacgcacgcaaaccatgcaggcatcgacccgcaccccgctcacctcctcggccgccttcttctccgctgccagccgatcctcttcggccgcctttgctcgttctgcctcctcggctgctgccctctccgcggcggccttctcctcctcctccgccgctgcccgctcggcgacggccttggcctccgccgccgccgcttcctctgctgccgccgcagcagccgccgcttcctctgctgccgccgcagcagccgccgcttcctctgcagccatggccttggcctcagccgccgcagcgtccgcctcgcgctggcccgcctcctcggcctccagcgcctcccgttcggcggtgctcatctccagctcccgcttcacctcctgcagctcggtcatgaggtcctccagcttccgccgcgtctccggcgcctgctcctccagcgccgctgcagcggccgcggcggccgcgacgcgcgaggggccccgcgcggcggccgttgcgcccgccctc

SEQ ID NO: 34149 - DNA, 80 bp, Chlorella protothecoides
cgacgtcgaagactttggtgacctctgaggaaggggcacatggagggcccaaggggtacactgggtggcataccaccgtt

SEQ ID NO: 34150 - DNA, 61 bp, Chlorella protothecoides
agcagtatctctgaagtctgtcatatgataataagattatcgcattgtcgccagtacgagg

SEQ ID NO: 34151 - DNA, 61 bp, Chlorella protothecoides
ctgttgaaacgttctgctggcagggggctcagttaccgtcatcatggccccacctgtgagt

SEQ ID NO: 34152 - DNA, 105 bp, Chlorella protothecoides
gctgccgggatcgtggccgagacggccctgacgaccgcgtcccagaccctggccagggttgtgccggggcagctgcgcgcaggcttgcaacgagcggcggagcgc

SEQ ID NO: 34153 - DNA, 79 bp, Chlorella protothecoides
ggaagtcgagcgctgggaccacggcatccgttcgtgcccactgctgcgggcacagcgagggaaggcatcgctgggtgca

SEQ ID NO: 34154 - DNA, 74 bp, Chlorella protothecoides
cagcttgccttggatcagctgtgggtgcgcgtgtgagggggagaggtgggggttggacggaggcccaaggcagg

SEQ ID NO: 34155 - DNA, 70 bp, Chlorella protothecoides
tctcgtttcaccggccatggcagggagcggtgtattgtcgtccccacctccacattgcgctggtattgct

SEQ ID NO: 34156 - DNA, 139 bp, Chlorella protothecoides
agaggcggctgccttgcaggcatgcaggtgagcgggggtctggctacatgcagccgccgggtgtgccgccagcaagatatccagatcccgcccccagctccccatcccacccatcgtgccttgctgagcgtccccgccg

SEQ ID NO: 34157 - DNA, 61 bp, Chlorella protothecoides
caagacgctgctctccctggctcgcgagcgtgcctctgagggggccatcgcggggttcgac

SEQ ID NO: 34158 - DNA, 61 bp, Chlorella protothecoides
cgcgcaggccttcatccgcgagcgtgtggcagggcacgccgcggtgcccaccgactttgac

SEQ ID NO: 34159 - DNA, 76 bp, Chlorella protothecoides
cttccagaccgatggcatctcctcccgaaacctgtggccggctcttccacatgtagatcgctcgtgtggcactccc

SEQ ID NO: 34160 - DNA, 252 bp, Chlorella protothecoides
gtaaatgtccatctcacatggacaggtgcctgcccatccgggcccggccagcaataccatgttcatgttcacactggctatgagccactggtgcatgtatgtgggctttgggagggagggctatgagcatgaaaactggttttaaaccaagctgtatgccagcacaggatcaggttacacctccttaccctccatgtgctggcctgcccaggcgccccagcaggacggcaggccttcaagccgcttcggcca

SEQ ID NO: 34161 - DNA, 67 bp, Chlorella protothecoides
gcagcgggtccgtgccgaccacagtcatcctcacacacacacacagactatgccatggcggcagagc

SEQ ID NO: 34162 - DNA, 70 bp, Chlorella protothecoides
cggggttggcacaggggctgctcactgtttcgtggatccagtcccctaccaatctggcaaaacaacattc

SEQ ID NO: 34163 - DNA, 79 bp, Chlorella protothecoides
gtcggtctcgggcggctcttcaaagctgtctttctgcgcgcctccctccggcgtgtccatgtctgggaggtgtggcaag

SEQ ID NO: 34164 - DNA, 103 bp, Chlorella protothecoides
ctatggtcttgtgaatgccagctcccagccggcttgctggcatacatgatcagcgtggtggactgcccggccgctccagcgctcaaggtgccgcccatgcgcc

SEQ ID NO: 34165 - DNA, 73 bp, Chlorella protothecoides
tctgcggagaatcgtcactccagaaggacttattgagtggttcgtgctctatacggatgctgtcccccatttt

SEQ ID NO: 34166 - DNA, 99 bp, Chlorella protothecoides
caggggagcgccaaaggttttgcctccaaatgtaacacatcaacagaggcgcattgagacaactaggcgctggtctccacatcgaccaagcgatgctca

SEQ ID NO: 34167 - DNA, 93 bp, Chlorella protothecoides
atcgctcgttcaggaaacgggagacgctcaagcgccgcaccccacgagactcggaaattccacatcgtagatggcctcagagctatcatgcaa

SEQ ID NO: 34168 - DNA, 61 bp, Chlorella protothecoides
tacgacaaaccttctcatctcacccttcttcctgttgcggacagagctccctcctgctgaa

SEQ ID NO: 34169 - DNA, 82 bp, Chlorella protothecoides
cgacgcagcaaatcatgcccagcacagtgcatggtccgtcaggtcgaggggccacattcaggagagttcacgttacagaggt

SEQ ID NO: 34170 - DNA, 81 bp, Chlorella protothecoides
tctgtatacataggtgtcgaagagaggagggtagggcgatcggctgttaggagccctcctgaagtcctcgtgtcacggcac

SEQ ID NO: 34171 - DNA, 61 bp, Chlorella protothecoides
gaatcgctgggactgcgcggtgcccatgcttgccgccgccgctgcaatgggacatggcgag

SEQ ID NO: 34172 - DNA, 99 bp, Chlorella protothecoides
cggcaaaggtcagcacagcctagttactcgattctctatggcgtgaatttctggatgaagtcctgcctatcgcaggggaagacagggccgtacttggcc

SEQ ID NO: 34173 - DNA, 65 bp, Chlorella protothecoides
gggggcagagaagggatgtgcatgatgtgtttgcacgtgggaaggggaggggactgcagggccag

SEQ ID NO: 34174 - DNA, 80 bp, Chlorella protothecoides
tgatcaaaacttccactgtctgcctgcatcacgtaccacaactctccctcccatcaccccctccttcctctcaaaccccg

SEQ ID NO: 34175 - DNA, 97 bp, Chlorella protothecoides
gtgtgcagctgccatgcggtcccgccaaggaggcaccgcgggcgcgggcggttgcccctggagttgtagacaagaatcgagatccagacccctcgtg

SEQ ID NO: 34176 - DNA, 61 bp, Chlorella protothecoides
gcgtgatgatctgggcgggaaaggggggaattggaaggcagaacttgcgagaggctccaga

SEQ ID NO: 34177 - DNA, 70 bp, Chlorella protothecoides
gaagttgaacaggagggcgaagaaggcccacccgacgtgtacaaaccagtcggtcttcttctcgtccgtc

SEQ ID NO: 34178 - DNA, 71 bp, Chlorella protothecoides
cagagtactatcttgccacgtcatggtgtccgcgcatgccctcctgctgcagattgcgacagacagtcctg

SEQ ID NO: 34179 - DNA, 282 bp, Chlorella protothecoides
ccaatgcgcactagcctccacccagcagagtatttgtggagaagctgtggcccgagttcacggcaggcaacccacaactggacgccacactccatgtgcacccgggtcggcaccccaacctcaccgcccagtatcgtgagcatgagttgagggatgagatcatgttctgatggtggcctgtgtgacctgtgaacatggagagcccccggcaaccactggcaggggtgcagctagcactgctgtgagtacaatgctagaacttgctgcctcaagacccccacc

SEQ ID NO: 34180 - DNA, 75 bp, Chlorella protothecoides
ccatcagcggggcgatatgctgccctccttgcgaacagaattcttcacacctctcaagcttcactctgctcgctt

SEQ ID NO: 34181 - DNA, 61 bp, Chlorella protothecoides
cttttccaggcccagctgttgcagggatcaaccccttctccgaatctcgcaggcgcggccc

SEQ ID NO: 34182 - DNA, 95 bp, Chlorella protothecoides
gggtcaggtgcacgcccagcccgcccccgcaaggcaccgggtagacgaggtggcggaacgggggcctgcacccgctcagcgcaaagtaggagccc

SEQ ID NO: 34183 - DNA, 73 bp, Chlorella protothecoides
gttgcagcatgggcgcaaggatggcgcctcaagcatttcaatgcccttcacgacttctggttccagttgacaa

SEQ ID NO: 34184 - DNA, 61 bp, Chlorella protothecoides
gcgcgcgccgcggtacggtctgcgcagcgcagggcgcgccggcgcgggcgcgatcccctcc

SEQ ID NO: 34185 - DNA, 61 bp, Chlorella protothecoides
cggggtgtcgtggacggaactgtgggacacaaagcggtgcacgaacaagggctgcaaggtc

SEQ ID NO: 34186 - DNA, 61 bp, Chlorella protothecoides
cgggttgacaacctcctggaggcaggaacccgggcgatgctcggctgtatgaaggatgggt

SEQ ID NO: 34187 - DNA, 72 bp, Chlorella protothecoides
tactcgagattctcaacaaacacatgactggcttttgcgtttagcataaagggtgcgcccgtagtccgggca

SEQ ID NO: 34188 - DNA, 401 bp, Chlorella protothecoides
  modified_base (124)..(350): a, c, t, g, unknown or other
cgtgacccctcatggagcgccccagtttgccccgctgattgaatagagaagttcctctgaaattgcctttgcagcatcttactcacaatgggattgcgcgccagagatgcgagactcagaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagggcgactggctgtcagaagccctcctgaagtcctcgtgtcacggcac

SEQ ID NO: 34189 - DNA, 72 bp, Chlorella protothecoides
tggaggccatgtacctgtgcgaggtgggtcggctggtgggggcagggggggctgaagcgtgtgatgggcaag

SEQ ID NO: 34190 - DNA, 64 bp, Chlorella protothecoides
ctcccttcaaggctttcttgagccacccgaagcgaggtgcaagtgcccgcccttaccccagaaa

SEQ ID NO: 34191 - DNA, 124 bp, Chlorella protothecoides
cgaaactgcgcctgcatgctgtcaaacctacaatcagctgatcccaagctgccacaacccaaaccgtgctgctgcaggagacaccgcgtccttcgacgctaccctcgctctgatgcgccggcgg

SEQ ID NO: 34192 - DNA, 61 bp, Chlorella protothecoides
gctatgctcacggtcttctttcccaggggcaccggccgggtcttcacgcgcaggcccaggg

SEQ ID NO: 34193 - DNA, 63 bp, Chlorella protothecoides
agaagaacggtgcctagggtggcccaatcgctccagtgttgcccggcaggcgaaacatcccct

SEQ ID NO: 34194 - DNA, 99 bp, Chlorella protothecoides
cggatgggacagcctgggcggcaggtccagctacagcagcagcaggcccggctgccgcagccgccacctttgccttcttgggggccggcttcctggcgc

SEQ ID NO: 34195 - DNA, 61 bp, Chlorella protothecoides
agagaggtgctgtggagtagcggcttgcttttttcattggcataagacagttgcatatctg

SEQ ID NO: 34196 - DNA, 61 bp, Chlorella protothecoides
caaatgcgctgggccccggcggcgccttctacctgccggtgaggagggagggggtgccgat

SEQ ID NO: 34197 - DNA, 414 bp, Chlorella protothecoides
  modified_base (88)..(297): a, c, t, g, unknown or other
aggaagcaaggtcggggagtgggggaggggttcgtctcaccgttacccctggaaaaaaggcagcaatgagagacacaccagcacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcctggttgaagctttgctagtcattcactcagtggcttcatcgtgtgatggagagcgctgcattgcactgtcgcatgcaaggatcagcacggtgttcgccttccacgggaagg

SEQ ID NO: 34198 - DNA, 167 bp, Chlorella protothecoides
cgccagggacgcgcccaggaccaggacgcgcgtgtactggggcgggcgcagcgccgcctcggcatacatggcggggtgggacacagcatctaagatgctgcacacccccgtggctgccagggtgccggccagcgacacgtcgttgccaggggccagagtgaccagca

SEQ ID NO: 34199 - DNA, 61 bp, Chlorella protothecoides
ggagcaggaagctgtgttgtcgagcactgttatgcatgtggctgtgggaaccccaaaccgc

SEQ ID NO: 34200 - DNA, 61 bp, Chlorella protothecoides
cgacgccactgttgcccccaccgccacgccgctggacctctccaccgcctcttcttcctct

SEQ ID NO: 34201 - DNA, 103 bp, Chlorella protothecoides
ctggagatccacccaggccgccagctggggatccacggagggcagctcggatgcctggtgggtttttgggtgcggggggagcaggtgggtgtgatccttccaa

SEQ ID NO: 34202 - DNA, 61 bp, Chlorella protothecoides
aggcagagcccgtgagacatagtagacctggtgcagatggcaagcagctggacataccggt

SEQ ID NO: 34203 - DNA, 156 bp, Chlorella protothecoides
tgactatcctctccactgccactggctgccgtggttgcataccaacattttgctcgggcttgccgccccccgacaacacagtggcattgtcagatacccttgaagcatgcctttcacagcctccatccccccctctccctcccctcccctcaggtg

SEQ ID NO: 34204 - DNA, 1525 bp, Chlorella protothecoides
  modified_base (100)..(109): a, c, t, g, unknown or other
  modified_base (252)..(261): a, c, t, g, unknown or other
  modified_base (564)..(573): a, c, t, g, unknown or other
  modified_base (811)..(820): a, c, t, g, unknown or other
tggggtcaaggctgtactcctggatgcagcagcctggtagagctgacatcagggcaccccatctgggagtctggggcggtccagcaggttgtcatgtctnnnnnnnnnnggcctggtagagctgacctcggggcaccccatctgggactctggggcggtccagcaggttgtcatgtctcagcactgtcacgctccccctggcgaccgaccctgcatcccatccccttgtctaggtgtgcgagcggctgctgnnnnnnnnnnggcactgtcacgctccacgtggcggctgaccctgcgtcccacccccttgtctaggtgtgcgagcggctgctgccgtacaaggaagaaaccgcggagatgctgctcaagtcgctgacgctcgtggtggggctgcccgcgggggtggcctgggacctggcagaccgcacggccgcagaggtgggtgaatgggttcaggaggggtgggtgggtgtggcagtggtgatggagaagggggcacatgggtgggaaggaaaatgggcgggaagagaaaagggtggtgtagtgcaaggtgtcccgtggagnnnnnnnnnngcaaagagcggaggagggtgtgcagtggacgccatgcaggaggggaacccatgccgtattctgagacgctgacggccgcactgcgcccttgtaccggcgggcggtgctgccgcccaacttccacactcgaggcttgtgaggggcaagagctcgtgatatcctctcgtcttctccccctctccccgccctctccaaacctccaagccactcccctcgcagctggccgcgctgctgcgcnnnnnnnnnngtgggtgggtgtggcagcggtgatggagaggggggcaaatgggtgggaagggaaatgggtggtgtagtgcaaggtgtcccgtggagggaacccccagacaaagagcagaggagggtatgcagtgtacgccatgcgggggggggaacccatgccgtgttctgagacgctgacggccgcactgcgcccttgtaccgacgggctgtgccgccgcccgacttccacgctcgaggcttgtgaggggcgagagctcgtgataccctctcgtcttccccccctctccctgccctctccaaacctccaagccgctcccctcgcagctggccgcgctgctgcgctcctccgcacgctacatccgcagcgaggcggactggaggacggtgtgcgcgctggtgcggctgaccagcctgcgccccgaggcggcgcccgcggccttcgaggcgctgagcgtggccgtgcacgacccacgcgcgctgtccacgcgctccttcccccccctgctggaaacctgtctgcactttgtggaacgctaccgcgcgccctcccccgacctcgccctccgcttcctggagatggtggaggcgctgctggtgtggctggtggggcccgcagggcccgccagggggcatgcagggggcgagggcgcgggcggaggcgccggccccggggccgcgccgggcgacggcctcgccgccaccaccccgggcg

SEQ ID NO: 34205 - DNA, 432 bp, Chlorella protothecoides
  modified_base (146)..(361): a, c, t, g, unknown or other
gctggttggtgatgagcggagtggttttggtcatgctccgtctaggtccagggacccccatccatctggctggggcccctcatccacccatcccgaactcccgccctctgcaccacaggaacattccccaagagtgtgtgcacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgctctcggccgagcatcgcccacagtctcctcctcgtccctttccacatccacgacgctcaacccct

SEQ ID NO: 34206 - DNA, 61 bp, Chlorella protothecoides
ggccattacagtgtcatgtggagggtatctatatcctggcgagtagggcatcgcaatgtcc

SEQ ID NO: 34207 - DNA, 124 bp, Chlorella protothecoides
cccgtgcatggcctgggtggttgattttttggggggggttgaagctgatctggggaaaactgcatgatgtgcaatcgatgctgtcatgtgttgctggcagtccggtgaggtggccgctgcgatg

SEQ ID NO: 34208 - DNA, 65 bp, Chlorella protothecoides
gggcgtgatgggagaatgggcgagggggccagtacgggtgcatgggagggtgtgggaggctaggg

SEQ ID NO: 34209 - DNA, 80 bp, Chlorella protothecoides
attcggctacctgaaaggtgggcctgggtgctctccctaggagcagcagggggtgtgcgccagtgggacgagcatgccct

SEQ ID NO: 34210 - DNA, 62 bp, Chlorella protothecoides
gggcactttcaaaggtgccctgctcatctctttgcggttcctgtgacattgccccctgagat

SEQ ID NO: 34211 - DNA, 74 bp, Chlorella protothecoides
gggtcacctttaaggatggagtttgtatttcgtggagggaatgtcctgcgagaggagatggctgctggaacatg

SEQ ID NO: 34212 - DNA, 77 bp, Chlorella protothecoides
tggcggagccggggcaggtccgacgctcactgacttacccacccgccgcctctcctccaacttcccctcccccctca

SEQ ID NO: 34213 - DNA, 61 bp, Chlorella protothecoides
gcaggcctgacgagatgcagctggcggcggtgacggcctccagcgccgcctccagtgcctt

SEQ ID NO: 34214 - DNA, 61 bp, Chlorella protothecoides
gctatgacttgggacagggtatcgggggggtgacagagcctgcctgtctgcactggcccag

SEQ ID NO: 34215 - DNA, 118 bp, Chlorella protothecoides
gctgtctgcagtcgtggagagcagggagcgagtgcaggccgccggcaagcagtgggccgcgcaggcggcggtgaagctgcacctgactctgcgctcgggggccgagggcgagtccagc

SEQ ID NO: 34216 - DNA, 61 bp, Chlorella protothecoides
gagcaagcggaataaagttggtacgtatgaaagctaaccctgcaatgcttgcatgccatgg

SEQ ID NO: 34217 - DNA, 98 bp, Chlorella protothecoides
gaatcccggtcctgaaggatgggacgcgtgtgtggtgccatgcaaccccggcctctatttttgcgctgcctcgccacaaccaccctcgcacataccct

SEQ ID NO: 34218 - DNA, 71 bp, Chlorella protothecoides
ccaaagtctgcatgcgtccggaaagccacagtgcgaccccatgatggcgattcagcgcacggcacgtggag

SEQ ID NO: 34219 - DNA, 11035 bp, Chlorella protothecoides
  modified_base (2951)..(2960): a, c, t, g, unknown or other
  modified_base (4153)..(4162): a, c, t, g, unknown or other
  modified_base (5730)..(5739): a, c, t, g, unknown or other
  modified_base (5829)..(5838): a, c, t, g, unknown or other
  modified_base (5972)..(5981): a, c, t, g, unknown or other
  modified_base (9998)..(10007): a, c, t, g, unknown or other
gccgcgccgtagccggcggtggcgcgcagcagccaggccacgtagcgccggctggcgaccagagcacgggcgtccaccttggcgccgtgcgcctcggccacgccttccaccagcacgcggaccgcggcctccatgcgcgcgcgcgtggcgggcggcgcgcgcccggccgagtcgtcgagggactcaggctcggggttgagcgccgagggcggccttcgctctctgctcacatccacgtgatcaggccccgacccaatcaggagctctgtgtcgagcccagccgccccctccgctcccaaatccagcgcccccggcgccagatccagcaccgcctccagctctatcaggcggtcggcgcggcgcaatgcacctgcggccaggcaggtcacgcgtggcccgctatccgcctcgatgccgcccagctgccgcgcgacgcagaccacagcggcgccggcgggcgccagctcagcgaccacagccgccagcagggagcgcgtaaagcccgcctggtcctgcaggcgggccgccaggaccttggtcacccgcgccagcttggacaggcccaggatggtgccgtgacggggcaggtatgcgacgtgcaccgcgccgtagaaggggagcagggcggagctggaaagcgcggcgaaggttatgtcgcgcaccaggaccaggccgtcggacgcggcggccaggcagggctcgtggaacagcgcggagccaaaggcactggggtgatgggtggtgaggagtatgggggtcggaacgacaacagatgggtcagcagggagcaacatcaggcaccagctgggacgccctccgacaaagctcaccctgtatgatcctggccgctcccccgcgtcatgtccagccaggccttggccaccctctgcatgaaccattcagtagggagacttctaagtgaggcgtgcgggcgggcgacagtcgtgggccgggcagcgcccccctgcaccacccacctttggcgtgtccacgagaccctcccgcttgggatcctcgccgatgcactccagcagggtggtcactgcgcccttcatgcggtctagaacagctggttccccgctcgccgcggctgggggcggctgggcctgcaccgcgctggacgtggtgaccatggcgcagggcgccgcagcccggcgcgcaccggggtcggggcggggaggctggcagccctggctgtcgatgtttaggagcgacgacggtcctgcatgggtatgggcccgtccagcatggccttggccaaaattcacaaatggattggatgccgcgcgcggtctagaggtccccacggtttcctcacgtgctgaattggaattggatgattccaggcacaaacttcccccgacagatgatcttcggcgccggctgcacagcaatggcatgcttcaatgcaggctgtgggactgccttgcgtgaagctgctcgtcgagggtgtcttgggcgcccagcgctgcccggtagccggtacccgggggacataccgcacggagtggggagccccattcgaacgagtctggatccaggtgcgcagtgcctttggcaatggatgggttggatcgggggtgatgggaatcgcacgcattcccgctcgagatgggagggactgtgacagtgaggctggcgaccactcggtttggtgacacccccagcatgcatcgccttgatggtaccggacgcaaggggagcctccactctcaccaatgccacctcgtgatactgattccaaaagcctctcagaacactgcttcgtaaccagggcacggtctgtgagcgcacagacgcgggcttgaatctgaaggacagcagcggcgccgtgattgcagtggtggtgacctcgcgcttgccgggcttggacctcgcctccatcgtgccaggagactactgcctggtggtgggccccgtcgccgaggaccccactggaccccgctacgtcagagctcacaaggtgactcgcggatgtgtttgaatgagaggggtgtttgatcctcgccttctccgaggacggtgtggggcaacgctgcccgactcaacaacccggagcttgatagggtcctgacttcctgtccggcctacatccgcaggtgatcaatctaacggcggagctggtggacgtggcactgcgagcggagcagtggcaggccgaggtcaaagaggcccgcgccctcccgcttggggcctgacggggcctcccagcatgagggcgctggccctgctgtgcgtcctgctgggcgcgctgggctccccctgcctggccagctcgggagacgaggcccctgagtaccgcggctgcctctaccactgcgtggagggcagcgggggccgcggccaggtccactccgccctgtgcgaccctggtgacggggaccagggcagcgcggcgccgcccatcatcttgcgctggacggcgtggacctgcgagaccgactgcgggtacctgtgcatgtgggcggtggaggggccggaggtaagggccgcgctccagcagcccactcctcggcaccccactccttggcgccccaccccgccgccccacgcacacgcggcgcaaaagtaccacggcaagtggcccttcacgcgctggctgggactccaggagcccctctcctccgtggcctccctgctcaacgccgcggcgcacgcgcgcgcgctgcgtgcgctgtggcgcgcggggcgccgcggcgggccgccctacctggcgcactgcctgctctccctcgccgcctggctggccagcgccgccttccacgcgcgcgacacgcacgccacggagcgcgccgactacttcctggccggcgcggtggtggcgctgggcgtgcacgtaaccgcgctgcgcacgctgcgatgcgtgggcgccgccgccccgcggcgccgcgcggcgctgggcgccgtgctgggcgtggcctacctggcgcgcgtgcacgccatgctcaccnnnnnnnnnngtgcgtgggcgccgccgctccgtggcggcgcgcggcgttgggcgccgtgctgggcgtggcttacctggcgcgcgtgcacgccatgctcacccgccgctttgactacggcggctgggtggtggcctgcctggccctgggcctcctgcagaccctgctctggctgcgctgggcatggtggacgcgggagggcgccacccacccaagccgccggtcgctgctggtcttcattgccagcctgaatgcagccagcctgctggaggtgctggactttcccccactcctctggcacaccctggacgcacacgccgtctggcacctggccaccatcccgctgtgggcgctgtggtaccggtttgtgctgctggatttgcaggctggacaggtgatgtggtcactacccctcgatagtgcaggggaggacaaggaattgtaggagttttggtgatactctggtatggacaggaatgcaagccaatagtccaggtgtcgagtgaagtatggcatgggagatgatatcgaattggtctctagcgtggcactgcacacgttattttccttcaatccctgacacttgagtttaattctcagtgataacgttattaaaattgaagtacaatacacaaaagttctggggaacactttggtgtcaccagccacacagaatcaacagtcggaagggtgggtgctgttcaatgaatacctctcaaccggaagggggggtggctcactgcttcagcttgtcaccaacatccttgatggcatcaccagcacggtcggcgaggttcttaccctcgttcttggcgtcacgagccgcgctcttggcatcggacttcagatcccgaccaccgctcttcacatcgcgggtagcatccttggcatcacccttcacatcggaggcaaagtcctcgaccgcgcccttggccttgttgaactggtccttggcctgctggccaagatccttagcctctcccttggcgtcgttgtacgcgctctgtggaggcagagtgagaagggatattgctggatgaagccaatctgtgcgatggctacttgtcatgcaggcagatggcatgatctgaaacagtatcaaagaagctgagtttccaggtatacatatcacccaaatccaatgtaccttggccgacccggaggtgttgtccaacttgcgctcggcggtgccctgagcggagcgnnnnnnnnnnacatcaaagacgctgagtttccaagtacacatatcacccaaatccaatgtaccttggcagacccggaggtgttgtccagcttgcgctcggcggtgccctgagcggagcgtgcctcccgcttcctgcaatcgtggaggcgcaagccagatgcatgagtctgggattgtacacatgtgtgatccaaatgatgtacgtcaatgccaatcatgtttgcaactgacgcatggcgttcaacactcacgtcttgtcggcgatgtcctcgccggcgccctgcagctcgtcggccgcgccggagatcttctccttggcagtctcagccgcgttgccgacggcgttcttggcgtcctcgtaggcgttgcgcgccttgtcgcccaggctctcctcctgtggaacaggtgggggaaacatgtgaggtcgcccgcatcgcactacccagccgactccgtgagaagcatggccgtccgtcccgtggataagacgcaaccgctcatgggaatgcgatgcacgatcgctaggccatcggtcaaaccatgaaactcacgttgacagccctcagcacgacaggggcagagcggaactggcggtgcgacttcacgaccgggcgggtgaaggcgacagccctcaggggggcggtttgcatgcagatcattctcagggaagccatgtcgatgtcgatggacagatgggagtgggttacgtttgatgtgaatgaagggacaaatgtaggtttggatatgattatacaagctcgtcatgcgtgcctgtatctaaatgaaccaatagcaagtggggggcaggtgctgcgaaggtaccggcaacaggagcaggcgtgcttctaggcagcttcaccaccactgcccgttgccgggcagactgttccgtcactagcaacgatcgccgcttacagcacgttgccccgactacacgcttggacaacttgatcactgtatacatttaaaacccatgcgcgaggtagtctgatcggactactgcctgaatcacgagtagacgccatgaggcgtcctgcgacatcgatgcgcggggtgtcgatcgccctgttcatcttgctcgccgtcggcgctccacaggtgattcttggtcctcagtaattctttggtgatgatccacccttccatccaagtctacttcgatggctggggggtgtgttgtttgctcgtccggaagtgtgagtgccgttccctgacgtggctttgcaccgcccccctacttgcaggcccaggccgagcaggcagctggcctcccctcctacctgaggagcctggtggacaggatcaagggatcctatgtctcaagtgagtcgggtgcctgagatgcagcatcctgctgtaggctgggatatgttgtatttgaaggcagcagtgattgtgtggtctgattacaaggcttcggcgcatttttcgtcttgcaagaaggattggcaccattgatcgagtgactgatccataatcccatctctgttcaacagatgaccgcgtggtcccagtgtccaccaacctccccggccatgtgggagaggtggagtacatccgcgtcacgtgagtttggtnnnnnnnnnntggcgcatcatgcgtcttgcaagaagcattggcaccattgattgagtgactgatccatgatcccatctctgttcaacagatgaccgcgtnnnnnnnnnncatgcacaacgtttgaggctgggtgcgcaccagctttcatcatgctgccatcatcagtatacgagtacaagcccaatgcaccccagttcacccctccgtccccgtgcacctcctccttctcgcagcctgtttgnnnnnnnnnntgtgtccattcgacctgcacctcactgccacttctacatccgtgctcttgcaggacacctgccggaaacggacccagctcctgggaagagcttgcaccacagaggtgagccacaacgctatgcacagcgtttgaggctcggggcacaccagctttcatcatgcttccatcatcagtatgcgagtacaagcccaatgcaccccagttcatcgcccgtccctgtgcacctcctccttctcgcagcctgtttggtcgcgcctggttccatgccaagcgcctggccgggctgggcggctcctaccaggacgccgtgtatgcccaggcccagggcctgaagaacagcgccggggagtcctgggaccaggcgaccgagaccgcccagaaggcctgggagtcgggcaaggagacgagccagcagagctgggacgacgcaaagaaggcagcgtgggacacctggtcctccaccgtcagcttccccgcccgcaaggcagccgaggccaagtctgccgccgccggcgcctacgatcgcgcctctggcaaagccgcgggagccgccgaccacgcgaccggcaaggtcgccggcgcatacgaccaggcgaccggcaaggctgccgccaccgctgaccgcgcctccggcaaagccgcgggcgtggccgaccacgttgtcggcgcggtgaagggcgcctgggagcaggccaagggcgccgccaagggcaccgccgcccaggccgagggtgccaccaagggcgcggtgaaggaggccaagggcgctgcaaaaggcgtggtgaaggaggcgtccgccacggtgaaggatgcgtctgccacggccaagggcgcggccgcctccgccgcgagctcggtgggcagcggcgcgcagcaggcggtcgacacggccgccgactacgccagtgccgggtacgacaaggccgcggcggtggcctccgactgggcgggcgcggggtatgaccaggcctccgactcctggcgcgcggccatgggccaggcgtacagtgcctaccgcaccggcgcgggcaagggcaagggcacctgggaggacgccaaggcaaccgcctacgccgcctggaagaaggcggagggcaaggcgcatgagggctacgatgcggccagcgacgtggccagcggcgcctacgagcgcggcctggacgcggcctacaccaactgggagaagacgcggtcgcccgagacgtgggagggcgcgcgtgacgcgtttgtggacctgtggcgccgcggcaccgaggactgggaggatgtctccgcccgcacctgggagcagtggcagcgcaccaagcacgagacggggcagacctgggacgaggccagccgcgcggcggccgactcctggcgcgacgtgcgctccagcagctggctctccggctacttccccgagcccaagaaggcggccagctcagtgtggctgaagaacgcattccggagctggtggggctccaaggaggccacccagcagccctgggacgaggccaaggccaccgcgcagcgcacctttggcgtgctgcaggacacctcccgctccagctgggaggaggccaaggccaaggcccagagcgcgtgggagaccaccaaggccaagaccggggagagctgggaggatgcgtcggccaagacctggcgcaactggtacaatgccaaggcgtatgccggcggcacctgggccgacgcgcagaaggcggcggacgcctactgggcggagaccaagggcaagagcaaggacgggtaccaggagtttgccgatgcggcctgggagaactggaacgaggccaagaactcggcggggcagagctgggacgaggccgagaaagcggccaagtcctactactccggcggcttctggggccacaagaaaaagtcctgggaggaggcggggaaggaggcctggcaaaactgggtcaccggctccgcacgtcgcgggcacccttgggccgacgtcgagaccgccgccaaacggcgctgggaggagaccaagtccgccagcggcgagacttgggagcaggccaaggctgccgccgagaaggcgtggaatgcgcgcgccccgggccattcctggtgggacaacctgaccgacagcatcgcctgctcctgggacgacaccaagtgccgcgccagcgacggctggacctccctgaagaagtcagtgggccccagcgaggcggaaaaggcgcgtgtccaggcgcaccagaaggtggacgaggtgtttgagaagacgaagcaggagctgtgagggaagttctccttaccttgcattccacccgtgcccatgactgccccattcccaagtgtagcgtcacgagtgtgagaatgtgccgggcgcgagccgtgcccggcgcgaatgattcatgtaaccgcttactcagatgccgaatgtgggggggaatcgctgttcagggatgggacagtgagatgacgagattgactccctacttctcttgatggcaagtgcctcgccaatttgggaggaatgcacaagatccaccttgacatgctccgacgcttggaaacatgcaaggtagactgctgtcctcactaacacccctaagcccctgccaccctcatccacacccaatgggaatctgatagtttgtcaaaagtcatgaggggtagttacatggttgctgcacccgtgcagaggctgcaccgacgcatgcgctcaggcagaggtcttggcggcggccttcttcactcgcagagaccaggccagggcggaggccttggcgcgtgcagcgtcctgtgggtgaacattggggtggattggatggtggtttgtcaggggtgcgaaagctgtgagaacgaggggaggaggcagcgcaatcaaagcccagccaggcgagacccgccattcaccttgaggtcggggcggatggcgccggcagtggcgaccgcagacttggtggccttgcgggcgtgggactttacagcaaaggaccggaggttgccggccctcttcttgctgctggtgctgatcagcagaccagactcgtcggcagacacgtccatggtcttgccaaagttggccaggccagagtacttgtagctgtgcttgttcatcctgcgatgaggaacaacgtgaagacactatgagcatgctctggtgcctgccttaccgctccagatcccacgggagggattgagtcaccccgttccctggggcgcccgacagtgccactcacaggttcccgggttcggtggagaccacaatgccgttgatgttcttcttcagaaaggcattgttcttcttcaccagctcccagaccagagaggacgacatgatgtcgggctcgtcgagtgacctgcgggagggaggtggggcggcgatggcacccttccctggtgtcggggaatccagactcctctcgctggttgtccccgccccacgcacctgtcgatgtgggctgccggcacgggaaagagggctcgctgggggtgcctgcacggggagtacacgggaggaggcgcgcgagggtggtaaggcatgccttgctttccaatcacggctgcgctcacgggcatcggtgtgccatctcccaaggagtctcgggctcttggacatgtgcagcgtgatctacatctgattcccttcccaggcgcttctgcatttccagcacagaaaagagggcacggtacaaacgcatatatcacaggtaaagattgacgcgtgtgccgtgcaccgcgggatcatgcatgttgttgggcatggagctgggtgccctcccgggcgggctgctgcagcgagccatacaggccgtgactgtagatgtgggtcagggcatcgtccggcaccaggtaccgcacgctcctgccttgctccagctccttgcgcacctgggatcgaggaggagggagtgtcgccagtggggcatgctcagctgcatggtatcttggtaggcctgagagtgtgtctgacgatcatggcccttgcaaacgccccaggcacaaagcatgttcccgcccacttcaacctcctgggccccccttcatacgctcnnnnnnnnnncgtctggcgatcatggcccttgcaaatgccccaggcacggagcatgtttcccccctacctcaacctcctgggccccccttcatacgctcccaccaaccaacaacattccaagcccgctgaccagggaggagctgatgtcggtgggcacgggctcctgcacgatggacacgcgccccgcgtgctggtgcaggagcgtgcccggggtctccagcagggagagcgcccgcgcgccgccgcgcgtcacgcagaccacgccgtgctgactcagcagcgcgtccagcaggtcctggcgccagagtgaggggtccgccatggtctccagcacgtccgcgccgcagaccagcaccgcgcgcgggctgggcgcggggccggcggagctggccagcacccccgcgccgccgcgctcctctgtcgagaaagcgcggcccagttccgcctgcacccgctgcagctccaccagggtgcgggtgtagtggggctgcgccgcctcccatgcgtccaccatcacaaagtctagctcacagagacgaggggatggtatgaaatgggtggggagaatgtgggtgctcacggcgagcgagcgatcagggcgagtggcaggtggctcggtgaggctcctcctgcacccaccctagcatccgtctcttggcgccgtctgggcccctttggatcccaacacacccacagtcctgaggcccaagatcaccaaacaagcagatccaaagcccactcatccacccaccggaggaggcggcggcggcctgggccatggcgacgcggtgggcggcgggcgccaggccctccttccagtacgcgtcggagaccggggacaaatagcctcccagcacatcgtacccctgcgcagtcatggcgtcgcgggccagctccatcatgcgcaggtgggcgatggtgggtgggttgaaggagccgcaggccaccaagaccacggggcggtagcccacgggcggcttcccggggccggcggcgcctgcgggattgtgagtgggtgggcggaggagggggtgggt

SEQ ID NO: 34220 - DNA, 74 bp, Chlorella protothecoides
ggttgcccaggaaggagtactcgcggaaggcgaccgggggctcaccgccctccatgcgttgctccaggttcccc

SEQ ID NO: 34221 - DNA, 127 bp, Chlorella protothecoides
acccagtccagaccaaaaagggaggcacccgtgtctactccccgcgtctgccatccagggcaacccactgggcaccgcagcgcagatgtgcgccggtcccttgcctgtcttccccgccttcctcccc

SEQ ID NO: 34222 - DNA, 114 bp, Chlorella protothecoides
cgccacccccaggcccacccgagccgccggttgggcgggggggtgcgcagggggcgcagcgctgtacgacggcttcagcacagaggaggcattgtaggggggcaccttcagcac

SEQ ID NO: 34223 - DNA, 76 bp, Chlorella protothecoides
caccccactgttgcaccctacttggtgtatccaaggcatgaccgactgttcctcccccttcaaccgccccgcaacc

SEQ ID NO: 34224 - DNA, 61 bp, Chlorella protothecoides
accacgcaccccattttccaagcggaattctcaactatgagagtccgcgagtcgctcacct

SEQ ID NO: 34225 - DNA, 95 bp, Chlorella protothecoides
aggaggcgccttcccgaatcccttccccgcggtggacctgctggaaacaggctgactctcgtccacaccgtctgagctcccaagcgcatggcatt

SEQ ID NO: 34226 - DNA, 67 bp, Chlorella protothecoides
attccaaggcatgtgcccaccactttgaccccccctgattcctctgagtagacggcaccccccctgc

SEQ ID NO: 34227 - DNA, 144 bp, Chlorella protothecoides
tgctgggaggggtcctgcaaatggggcatgacggatgtcagaagcgtaggatcagggggggtgcccgaaacgccatgggctcagagccacaagtacaagcagacgacccatcaagaacagccatgtcggcaaggggccagtccg

SEQ ID NO: 34228 - DNA, 94 bp, Chlorella protothecoides
tgctcttccgctcgttggtccagccacgtcacgattgacaagtacgccacctgcgcggataatttgtctcgacttaaaactgcaaaatgggaac

SEQ ID NO: 34229 - DNA, 103 bp, Chlorella protothecoides
gtgctggagcattacacccaggtgagggttgaggaggtttgccaatgaggctgtgtagtcgttgagacgacccgcaaagcagagacagcacacctcgttcttg

SEQ ID NO: 34230 - DNA, 7774 bp, Chlorella protothecoides
  modified_base (1380)..(1389): a, c, t, g, unknown or other
  modified_base (2420)..(2429): a, c, t, g, unknown or other
  modified_base (2625)..(2634): a, c, t, g, unknown or other
  modified_base (3926)..(3964): a, c, t, g, unknown or other
  modified_base (4315)..(4324): a, c, t, g, unknown or other
  modified_base (5876)..(5885): a, c, t, g, unknown or other
  modified_base (6693)..(6702): a, c, t, g, unknown or other
  modified_base (7528)..(7595): a, c, t, g, unknown or other
ctggcggcgtagaccccggggtcggcggggatgttgtaggaaggccagtagccgcgctccagatggggcgtgccgtcccagaccgcgacgcggccggggatctgctccacgatggtgagcaggccgggggtcaggtcggcgccgggggcgaagcggcccaggtccgccaccatccactggttgttgccggtgccggagttgtgcgccgcgacggccgccgcccaggccgggccgtcgcgcgccgtccagcaggccacgcgctcgcgctgccagctgggcaggctgtgggcgtgcacgtcgtggaacagcgactcgttcagcacacggttggtggtctgcagcaccgccaggcctgtgtttgtgaggtagaagtcgtcgtcggaggagagctcgccggggtaggaggagaagctgagggcggtgccgggcaggtccgggtcggagagggcacagcggtagtgcttgtacacccgcaccatgcctccatacgtgaacctgtgagggtggagtgtggggcgggggagggcgggtggtgggcatcgtggcgctcgtcggtatgtgagcggcaggatgtgaggtacacggcatcactcccacccctcccccatgcagtgctgtcccttcaaccccgttcctgccccgcagtcgccctccaccaagtcggacatagaggcatgcaactccccccactcaccaggcggagtggcccaggaggaggtcggagaggtccggggtcacgctcaccagcgcgctgcagcgcccgccctgcgtcagctcgcgcacgacctcctggggtcccatgccggcccagggcgcgagcaggtccccctgagcggtcgctgttttcagactctgtctcacagcgatggcgcgccggatgtcgcccaggtcaccgacggagctggtctccaggaaggcgaccaggcccaggtcgcgcagggcgtcaccctccgtgcgccggcgcgccgcgtagcccagcaccatgccctccagctgcgccagggtcaggcccacggcgcgccaggccggcgaggaggggccccgttctgtcgcttgactccgggaccatgcgtgctgctccagcagccagtcgcgctgggcctggctggtgttgaaagtgctcaccacgttgttgtagtgctgcgatccgggatatgtgttaagggggggggggcgagggaggagtggcatggatagggtgcggcgaggcagcgtgctggggcaggtgggcactgcactggctgcatggattggggccacggccctgatgccaggcaggcacacagccagcagcaccctcgacctgtcaacccttcaggacagccttatcaacgccagcgcctcaccgtctggatctcgcgggcggtgaagtagccctcnnnnnnnnnngttagggccacggtcctgatgccagacaggcacacagccagcagcaccctcaacctgtcaacccttcagaacagccttatcaacgccagcgcctcaccgcctggatctcgcgggcggtgaagtagccctctaggaagccggcggcgcggagctgggtcagatcgtcggtggtgttgaaggtatggacgctaaactgggaccagccgtggcgggtgtgcttgccgcgctggaaggaggcatgcgccacggcccctgctgaggtggagggtgggagtcaaagcagagattccaccgctcgggggatgcttggcgatgcgaaatgtagcaatagcaatccacaatgcaaccatttccctacctttgcattcggtggcgctgaatacgatggcatcagggccattggcaattacggcgcacccctcgtggacgggaacatggcgatgtggagcagatcggcgcgtcgcgtgcaggaacggctggtgtggctgcgcagctccgagagcctgttgccagtaccccgccaccaacaggcacgcaagccaccaggcagcgcgcttcgacatgtcgtgccctttccaagattttctaatattgtatcaccacatgcaatattgctatgtcttctcacgtttcagtctttcgacggatcactgtcggaactctgatgtcggcacgtgacggattgaaagcagccaggagtgcctcccaccgtgggctgtaaggtcagccaaatgtccatcttgaggtcgctcctgttgcatttgcttgtagacatccatgttttatgggctcaagcttggcccttggtgttttgaggtgggttagttttcgaaccctgcccatgtatttggttgccagatggattcataaacactactgaggccgtcctgaaacccagctctatttcagagatcgcaaaagagggattaaagtggctgcagttaattgtcaaatcctcctccatcctctgctccagttggcattgccattctggctgggtaagaatcatcagcttccatctcagcctcgcnnnnnnnnnncatcctcctccatactctgctccagttggcattgccatcctggctggggaagaatcatcagcttccatctcagcctcgcgccaaaaacagcaaactctcgggaattgttcaggtccctttccattcacaccgtgcacgtaatttgtcgagcttgtgattgcttttaataaaccgcttgttgaattctctcacgcannnnnnnnnnagtccctttccattcacaccgtgcacgtctattgtcgagcttgtgatttctttaaataaaccgcttgttgaattctctcacgcactgacgtggtgagtttgtgggcttccttatccttaccgtcaaagcgatctgcggacgggtcagcttcatccctctactccccttgagccattcaaatcttgcttcgcgcagtagagtcgtctcggtattccaccagcgcccggagctgaagatgatggccaagcgcacgctagcgggcttggtcctgcttgtcatcgcgggtacgtcctggtgtcgaacgatacccctgtaccgtgtcggctgtcatcaacgctccgggccgacgtgcttcctccatccatgcactgcaggctccacgatgggcctgccgctggctcagcgccagactgcgcttcgcgggcaggacgctcccgcctgcgagctgtgcgagggtttggtggtcagtctgtccgcctacctgtccgaccccaagactcaggcctatgtccaggagctccttgtgggagccatgtgcgaaggcctccccgacgccttccacgacacctgtgtgcaggtactgatgggggaggtctgcgtgtgtagggattctttaaggtcctgtgctgcaggatggtgtatctgcaggcccccatccagccccctcccggctccccccagtctcaattacaaggcccctccaccccttccccacaggagctggctgctgtgtacaggcaggtagtggccacggtggtggcggccctggacccccacgatgtgtgcacccttgccggggtctgcgtcggcaccgtggccggggtcaactccgccaatggaccctttgactgcccgatgtgccgcatggtggccctcaccctgcttcagcgcttcaaggaccccaaggtccgcagcgagatgcacaccggcttcctgcaggcctgcaacgacctggagccggccaaacgggtgcggcggacctcgggggctctgatgattgcttttggatcattgggggatgatgacgatacatcagaagacccaagagcacgaaaccatggaactggatgttcctttgccgggtgcatcctatcattcgcctgcctggccggcgagaagtccgactccatccatcccgcctccttgaatcgcccttgtgcagcccaagtgcgtcacggacgtcgatgccctgttccaggcggtggaaaacatcatggacgacctggaccccgacatggcctgcgaggtggcccagttctgcccccgccccgcgctcggcgccggcaccgggnnnnnnnnnnnnnnnnnnnnnnnnnnnnnnnnnnnnnnntccccgccatgcgtgcgctcttccacagcctggtggagcagcggccggcgcgcgtgggcgacaaggagtcgtgcgacaactgcaaggtcgtggtcctccaggccgtcgccatcatccaggtcggcgcaggggctgtgaatggggcggtaggaggggtgaagtgtaggggcaacaagatgagaatgtgggggtttggggtggggggagtgggcgggcatgtgtctggtggtgtgattgggttggcatgacaggcgactgcctgtgcatgtgtaccggaggatgggttatagagcttctcgagccactgcctcaagtgcggaccctgtccttccgattgcacaagccagccannnnnnnnnnttcaagatgagaatgtggggggttgagggggggggggagtgggcaggcatgtgtctggtggtgtgatcgggttggcatgacaagcgactgcatgtgcatgtgtaccggagtataggatatagagcctctcgagccactgcctcaagtacgggccctgtccttccgattgcacaagccagccaaagtatgcgcctgctgggtggactcaccccccttgcaaccatcgaaactccaactctccttccgtcacagaaccccaagactcaggcggacatcatcgagtacgccaaggagagctgcagcatgttccccgactggcaggattcctgcgaggcgtacgtcacgctctacggccccatcgccatcaacatgctggtcacctacctccagccccagacggtgtgctcggagctgggctactgccccccactcagcctcgcctgagcgcgggagcggcgtgccatggctgggaggggtcgcaaacccgctgcacccagcatcacaagtgggtgccggcagttgtcccccaggattcacacccctccctcgggctggcaaacagccttccctgctttgtttggcgtctgtattctacaccagccctgtatcctctgccctgtcgatcatggtgtcacgtgtgcatcatctcagtctagggattcgaatgcacatcctttgggtcgtccccggtgcagtcgacgacttgtttgctttcaccgctcccggcaaacgcaacggggcgcgacggaacgcacgttctcagacaaagaacccggcaaatttttagcaacagctatctgaattgccccattcagcacgatcctgaaattgcaagtggtcgtggtgagcactggcgtcccgtcgtcgtgcagcacgtggagcatttgtgcagaccgtgggccgtccgcatgtcgcccatgggatgaatgcaagctacgaattgcatttcccgatgtgacatgggtgggcgcgagccggagcaggttgtccagtcgtcaaggtaagcgtgccatgttggactggggtgtaacaggggagcaccttgtgtcctccaacaccccctcgcaatgccaaccgacctctcacagcgaagaagaggagtacgacagcgaggaggagcggttcagggcgcgacaggcagctgcatcccgcgctactcgcattggtgcaaaagcccagacggagagggagcgcctgggggctttcagggagaggcagcgcctcgagagagaggccggcgtccctggagccacatcgggccgggcctgggctgatgcggcagccagtgggacgctggaggaggacaggcacacagcacctgcgccggccccatctgatgccttgttgacccgcctccgctccgacatagcaaagtaggtgcagggaggttctaggattgcatgctcggggccatgtctggcggtcctgctgcctggtgtagcctttcccttctctccaggggctacgtggcaacagtatgcgtctgatgatcctcccccacacccaccctctcgcccctcgatcgccaggtgggaccggctgtatggcgcgnnnnnnnnnnccccttctctccaggggctgcgtggcaacagcatgcgtctgatgatgctcccccacacccaccctctcgcccctcaatcgccaggtgggaccggctgtatggcgcggaggggtcgccgcctgacgcagcgcggcccgtgcccagctcccacatcccctggctcccctgcgacgcggagcggtacctgcagtaccttgctctggtgctggagcgcagggcacccggtcctccacccgccccaacatgcaagagatccggacacgacagggcgctgcgccgcgcctacgcgcgcgcctgcctgtggtggcaccccgacaagttcgcgcagcgcgtgggctggcggctggcggcggccgagcgcgaggccgtgctggccagggtgcaggacaccttccaggccgtcagcggggcgtgggctggcgcggggctgaggggcctgcggggcgaggaggcgtgacgcctggggtcgctgcaggcttgcgctctgggctcgtgcgtttaaaggtcttggtcagccagcgctggggcaccggcagtctgtcaggcaacacaggtcgagttcttgccttccaacacttgtaaggcaggggcaacgcagggcgagcagtatgtggacagagtgccctggggaaagcaggcgggcagcacatcccaagctggttccctctggtcaggaaccccaagggtgcgctcgtggaatcactccgctcgacacggctgcgcctgtggccccctccctcatctgctgggagctgtggcgcccgctccgtgccccactcaggcgccgcgccgtgcgatgagcgactgnnnnnnnnnngaagcaggctggcagcacatcacaagctggttccctctggtcaggaacccaaagggtgcgctcgtggaatcactccactcgacacggctgcgcctgtggccccctcgctcatctgctgggagccgtggcgcccgctccgtgccccagtcaggcgccgcgccgtgcgatgagcgactggcccctgcccggcaggcagtggttggtctcgtactcagtggagggcgagggctggcccacgtccagctccaggcccagctccgcctcccgggatgcgctggggcgggggcccatggggtccgtccccggcggccccaactcttcccgcagcagcatgcagggcatggacagcgcgcggtgcttcctcatctcccaggcggcggggtctggtgggggcccaccccccgtcgaagcgtggccgcccttgccgtccacgcgaacaacacccttgccgtccacgcgcagcgcggcacgcgcccagagccagcgcccgcgcaggccgtgcctccagcgtggcagcgtggccaggaggagcagcaagaacgccgagatgcctcccagggcccaggcgtgccggggccgcagggcgcgccccccggccgacgcgcccgccaggcgcagcgcggtgggcgcgcggacgagggccacgcccagcggccagcccgcgccatccctgcccacgtgcacggcgcggtcctccaggcccaggccgcggcgcaggagggcgcggacgtagggcgcgcggaagcagtagtgctccaccagcagctcgtcggcgtggcgcgccgcggagtcgcgccacggcgtggcgcagaaggcgcgccctgcnnnnnnnnnnnnnnnnnnnnnnnnnnnnnnnnnnnnnnnnnnnnnnnnnnnnnnnnnnnnnnnnnnnngccctgcgccctccagcgcggctgggccttcctccacgcccagaccgaagaaatggtgaacgacgtagaagccggacagcgcgacaaactcctggccggcgcgcgggcggggctggggcgagcccagcgcgcagggcggcgcggcgcaagaggacgcgttgccgcgcgtcgcgaccccc

SEQ ID NO: 34231 - DNA, 61 bp, Chlorella protothecoides
ggtcaagctgaacccagaaccctgggatgcggttgttctggcggtcaaggtgaaactaggt

SEQ ID NO: 34232 - DNA, 61 bp, Chlorella protothecoides
ggatccttgagatggctgggagagggtgggggggcgcactgcgacggcctccagcggctcg

SEQ ID NO: 34233 - DNA, 62 bp, Chlorella protothecoides
gccgtcgcagcagccgccacagcagccgccgtcgccacagagctcaagcgcctggttgaggg

SEQ ID NO: 34234 - DNA, 112 bp, Chlorella protothecoides
ccgcaggatggccaggacattctgcactgctgccccatcaaaccagctggcattccatggagagggccacgtcccatgacatgcacctggcgctcgctggctgccggcaatg

SEQ ID NO: 34235 - DNA, 79 bp, Chlorella protothecoides
ttcagcaactttctgctcgagcaggtttccatcagcacacatatcccataccccgcattccctgcagcttcacgaccaa

SEQ ID NO: 34236 - DNA, 154 bp, Chlorella protothecoides
gcgcaaggaggctggcgtcgtggggcggggctccgcgcgctggccgcacaccacagggtgacggcgggggcatggatgcttgcatgcgccctgccccaaccccatgctgcgccggccagggttcccatggtcctggcccgaccacccctgcgcc

SEQ ID NO: 34237 - DNA, 62 bp, Chlorella protothecoides
acacccctgcgaatgcaaagctagcccatagtcccccccggggtcagacactttctgccctt

SEQ ID NO: 34238 - DNA, 61 bp, Chlorella protothecoides
ggggctgatcctctggctgggggtggtggcactccgctgcctgtaggcgatgcagggatat

SEQ ID NO: 34239 - DNA, 94 bp, Chlorella protothecoides
ttaaggctcatcgcccgcggcgtccgaatacaatagcctcaagagtccgccctgcggagctgtgtccgggattgtggcaccctccaaggtgatt

SEQ ID NO: 34240 - DNA, 61 bp, Chlorella protothecoides
ttttcgcatcgaccattctctcggcgctcaatttaagatttactcacagtcgaggcgagcg

SEQ ID NO: 34241 - DNA, 78 bp, Chlorella protothecoides
gcagtgcctcaatttctactcctgctggtagaggtgacagatcaaggcccacctcatccctgtgcgcaccggttgcgc

SEQ ID NO: 34242 - DNA, 806 bp, Chlorella protothecoides
  modified_base (147)..(156): a, c, t, g, unknown or other
  modified_base (722)..(731): a, c, t, g, unknown or other
ggcccctcccgacgcatggtattatgttactttcgactgatctctcatgcgcgcgcgctgcacgtacctatcatctattaatacagaaagtaggtgaaatacgttcccgaacgggcggaattcgctatgtccacagacaccgctttnnnnnnnnnngaaagtaggtgacaaacgttcccgaacgggaggaattcgctatgtccacagacaccgctttctaatccgcggaatcgatttaatacagcatttatattatgttcgagcgtcgttgttgcctgggcggcctctctttgcgggagtttcgagggaagtgcgttgtctgccaggaacgttcagtgcacgttctcaaacgttttggatccccctcactggggcggggtgttgtgggggttagaaaagggccttcaggtccagagctgcgcagtttggagctttaaaatatggttataattgtattctgggcttgcaaaggctcctatcgggcactgcactggctctgcattttaggtccatgaacgtttatgaacgttgtgcgtcgttggacggcctctctggacgtctgctgctccgcggctttgggttgctgccttgtcgtgttctcgggagggatgccatcagtccacatgctcacaaaggcacccgttgcaatgttttgtgcagccactggcaccaaagatgacattcacgtgcactgcaaggtcaacgttgtcaaccgcgacgtnnnnnnnnnngcttgtcgtgttctcgggagggatgccatcccccccctgccactaccacaggtgcccgacctacaagacagcgag

SEQ ID NO: 34243 - DNA, 110 bp, Chlorella protothecoides
tggattgttgtgcgaatggaaggaggggttcctgccagcccgggatgggcatggctgcgtgcagatgggtctccctgctggcagaccaccccttggaaccagcccctgct

SEQ ID NO: 34244 - DNA, 122 bp, Chlorella protothecoides
ggaggggcgaggtgcctgggtgacctgagctgcagctgggcaggcacagcgacacacgcagtgtgaagttgggacgcacccccgaacccgcccaccatgccccagcgcgccgttcccctcac

SEQ ID NO: 34245 - DNA, 145 bp, Chlorella protothecoides
agccgcgctggaggcccaggtgtgcacgccctggctctctggtggccgtcggagggggcctgtgctggctggggcccctgcccccctcctctcctcgactcggcatgcagcaccacccacctgcgccctatccacccgcccccca

SEQ ID NO: 34246 - DNA, 61 bp, Chlorella protothecoides
agacccggcctgctgcacgccatcagccagaccagcctgccgacccacctctgccaggatt

SEQ ID NO: 34247 - DNA, 68 bp, Chlorella protothecoides
gcgcatgcgtagaggatcgagggaggccccaagcccgtgcggcagcgcctgcgggcacaccctggtca

SEQ ID NO: 34248 - DNA, 6552 bp, Chlorella protothecoides
  modified_base (2082)..(2175): a, c, t, g, unknown or other
  modified_base (4076)..(4124): a, c, t, g, unknown or other
  modified_base (5323)..(5375): a, c, t, g, unknown or other
  modified_base (5780)..(5968): a, c, t, g, unknown or other
aaaggggatctgcgacggcggggtggcgagggggccggaggggccctgcgcagccctgtttcagagggcgcctggcgcggacgcctggctcgacacgtggcgcgccctcgggcatcgcggcgcgccctcgggcatcgtgacgctcccaccctcgggcacccgagccatccacccagctcggttcgggcccgcccccccccacgagctcgcctggaagcgggtgcgcatgtactgggtgcgcatcgtgggcttcagctgcttggcgtccaccacccgctgcacgtcggtgaagacggcgcggaaggcctccaccgcggcctcgcccggcggcggggcctggcgcgccgcccactccgccgccgcctcctccacggagtactcgccctccaggaagccgaccacgcgttcctccggcagcacgatgctggccgcctcgctctcctccccctgccagctctccttgtgcgtcttgcggtcgacgtgcaccagcgtcggccccgcgccgccctgccagcgcaggcgcagcgccatggcgttgggccgcttgtccaggcggcagtggtacagctcaagcgagctgttgtccaggtacacctggttcaccagctccgcgtcgccggagaagtcggcgggggagacctggtacacaggcaggtgctgcagcaggtggtgcttcaccgtgctcacgtcgctcatccgcacccagaacttggtggtgacgcagcgcacgccctgttcgtttggggggggtgggggacagagatggggagtgattggagcaccagcaggagaactggggggctgacgccgcggcccgggtcgtgagcggccgccctgccctttccagagagcccctctcaccactcccctccacacccaccagccgcccaacaggaagtacctgggtgacaccggggtcggacaccacggtggcgctcttgtcgccccgcagcttggagtagacgttggaaaggacgaacaggaggtccgagtagttgccctgcgcagggggtcagagcacaggagcttgagattttgctgtggcatgctgtgctgaccggcgggtgccaggtggagagacaggggagcatctggatcaggctgggccccaggtgggctgggtgcggagcaacaccaagactctcaggggggggggagggatgggtgcatgcgcacatgcaaacccttcccaagtgttcccccgtcctctagctggtcccgcatcgcacgacgtgcacaggcgtgcaatgcagtcacaaagccaagagaggcacggcatgggacgggctccgtggcagccaggtgcacagtttgtctgagccacacttgcccccatcaccaatggaattactctcgttttagctccaagggccgcccccccccctcccccccccattaaacaaacaaatacaaatacacatacctgaacccagggctggttgtgcaggtgggcgatgtagaactggcggcagggggaggccggcagcatcttgtcgtgcttcttcaggatcttgtggaagcccatgtagttcaggttgacgtacttttcgagctgcaggaactcgtcgccgacattcttggcgtcctgcaggacagagcgggagccgacgggatgggagcagcacagtgctcatgagttgggcttcctggtgtgctctgtcttgagcacctcgtcagagccaaaatcaggaaaccaaggggccagcaccccacataatctgaagtgtttctgccgccccttctcacaacctctcagacccaccaaccccggggctccaaagacaggcctggccccagcccccgccccctaccatgccaggcccctcacctccagcaacgcttcggcgtcctccggcttgacatcggcggccgcgagcctcacatgctccagcctctcccgcagcttggccaccagctgggcggtgaagcggcccaccttctccacctcgctgtccaggcacttgaagaagtcctcctccgcagagtcgcgccggttctggacccgctggacagtgagcgaggtggtgcgaggggagaagctgggcagggtgttctggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaagttcagtcgccaggtgacccgctggtgccagggccaggctccaggtgggccccacgcccgtcacgcgggtaacaatgagagcgcaccgactcatagtccgcggcgctgatcttgatgaggtccttcaaggccttgtagtccacgtactcaccagcccactccgcccgggacttctccagcaggtatttgccgaactgtgggggtggagccgagtgaggtattcagggtggctctcggccatgcacaacacagaggaaaccctgtgcctgaggacacgctcggtgacggcatgccggagaaaatccatataccaaaccttcatgacgctgaatggggttggtggtccaacaatgtcagggtgttcaaggggcgcccgccggccttctgtaaagcagtcgaccaggccagggctcgacaagggtcgcctccagcagctcgcacagcaccgaaggagagcgatctacgcttcctggattcacttgttagtattcacaatcggttcatccaagcccaggcagcacgttgcctgaatgatgccctcgacaccccaagccttcttcttaaaaggcatcttggggggcgcgagatgggaatcttccgcaccccccgctgccgaaagcatgacctgggttgctgtacagccagaacccaggggctaccaggtgcacatgcatgtcatttctatgccaacttgacataggagtgccccagattcatcggagtcaaagtccgtcgcgccaccccaaccctgtcctgccaggggccttggacgcttgctcccccctgacttggtggctgcatccgggaaattccaaaagggcttgagcaaactcggcgccatgtctgcccagccggcactccgtcgcacggaggccaaggccttcttcggtgaggagcctgattggggtttcggtcggtgtgcgagccgggaagtggaggccagcatggccagcgtccctgccgtgtcctgacaggcctcttcacccaacaccctcgcagccaatgagcgtacgtttctgcattggatgaacatggcggtgaccacaggcagcatctccgcagccctcctcggtgcgtttggggttatggtgtgggcgagcggctgtcctcctcctgggagggtttgggtgcatcggaggatgcatgcgcggccttgcgacctgccatgccctgctcggcggtccaacaaaccggaacaaagcaagcatgagcctgcgtgcgctccgcaaacctggacgatgccctcaggacacctggcttacaagaaacccccctccccctccccctcccctccatccacccgcaggcgtggcggggcatgcgcacaagcactggggcacagacctgaccacccgcaccattgccatccgcctgctggccctgctcatgatggcggtgtccatcgccatggccctgtacgccgcctacaacttcaagcgccggggggacatgctgcagcgcaagctcgacgggccctacgacagccgtgtgctgccagtgacgctcaccgtcgtgctcatgaccttcctcaccctggtctggataggcagcgtcgtgtcctacacccacccctgacctggccgtcgctgtgtggggcggggagggggttggactcactccttgaaatccctcggaggaaagggggaggcttagaccatgcatggttctggcgctggtctctggaggcgtgtgtccccacaatcctgcgtgcctgcagccccctcctatcaaccgtcgtcccggtcggccagccggcccccttctttgagaatcaatcggtgcctgtgctcaggagcacccttgcactttgcgctgtaggtcccttgctgtacatcgggtcacgggcgattgcaggatgagaaggggtgcaatggaggggggggggggggggggggannnnnnnnnnnnnnnnnnnnnnnnnnnnnnnnnnnnnnnnnnnnnnnnnaactttgagtatctggctcccgcgctgggccgctcaggccaagcccgggatgcgcaggccgcggctcccgccggaccggccagagtcgcgggggctgggcgacggcgcggcggccggctccggggtcgcgcccccggactcccccacctcgctggcctggggccggggcggtgagccggcgaccgccgcgctgagtggtccggcgctggtggtgctccgcgcgggggggagcagcgcgggggccgccgcctgcaccgccgtcagcttcttggtcaactgcagtgttggggaagtggaggggggttgatatgcgagggtaggcgacgggctaaggggaggttggtagggagcgccgggaggcagccacccgcgcctgggtcccatcgcaaacaaaaagcgtctccgcaaatgcaggccccgggcgccgcaccctgcgacatcccccccacacatgactgtcctcgccgccgcccggcctcgccgccccttctcaacccccgtcgccaaaggaactcacctccaactgcttctcgcgggcgcggagcagcgcgcgcttgctctccaggtagtccccctccatctccgccatgcggatcttggtcatcaccaggtgctccatgatcatctggttctcggcccgcaccgcgcgcagctgcgagggccaggtgggagggtgggtgggagcgacggggcgtgagggtgcggtcgatgaggcgtgggtgccaggcgcgaggcagggctgcagtcgctcgcaaagcacggcggtgctcgagtcgtgtccagcgcctgcagcgcacgatgccggcactcccctgccctttccctgccctcctttgctaggctgcccccccgcaaaccccccgttggccacccaccgttccacaactcacctcctcctctgcctcgccgggggcaaggggaacgaccggcgccgcggctttcgcgggcacgccggctgcgtcgccgccgcccgcacgccccgcctcggcgtcggcgctggcctcccgcgacttggaggagccgccgcccaagccccggaacatgcggccaagggtcgcacgcgcgcgccccccctgcgacttgccgcccccggtcttggcgccgggcgcgcgcttgggcgtgggctccttcagcggcgtgacgtcgcctgcgtggagggggtcggtggccaggcatgtcgggggggggggggagggcannnnnnnnnnnnnnnnnnnnnnnnnnnnnnnnnnnnnnnnnnnnnnnnnnnnngggctcagcgtgtcgtgatgttgagcaggcacggccgcaccacgtccatgcccaccgtccccccccacccccaacccacggattcagcctcacccgtgcgcacggcggcgtccacccgtgcctccatctccgccttgtcctggtccgcctcctccagctcccccgccatcttcccgatctgggactccagcagcgcgcaccgcgcctccagctccgcgcgcgcgcgcttgagagcgggcaggtcgctggaggccgcgtagtcctcccaggccgcgtccgcggcggcgcggtcggccgccagcgcgcgcgcggcctcagaggctgccgagcccgtcggcgacgcggggcctgcgggcaagggggcggcggcaccgcccctgtctgctgcggctagtgcaggggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgccccggcctgatgcgccgccccgggctgggcagggtgcgcctggctgccctggctcgccgccccgccctcgccctgggccgtcgccgcgtgagggctgctgcgcggcgtcccccgcccgccggaccccggccgcacgcccgttttcagctgcgccgcctccgcctccgcgaccgccagggccgcctgcaggccggcccgtgccaccaacgcgctcagcaggcgctgggtggccacgtccccatcttcagtcgccccgcctggctccacctcactttcgcgcgaggacgcaggagccccacccgccggcgctccaactagcctcgccaccagctcctcccgcctcgaggccagctcctccgcgcggggtccgtccacacccccgcctgccagctcctcctgcgcccgcaccagctccgcctccagctcgggcgcggactccgctgccggatccgccgcgggctcacgctcaccggcctcctcattggcggcaagctcgccccccgccaccgcgcctccttgtgccacgccctcgcctgcggcccctttccccccgccgccgcgggcggcgcgcagcgcgg

SEQ ID NO: 34249 - DNA, 61 bp, Chlorella protothecoides
tccaagctcaggaggagtgatgctagcctcaccgccgaggactttgagcctctgcacaacg

SEQ ID NO: 34250 - DNA, 61 bp, Chlorella protothecoides
agtagatcactctaaaattgccagcaacccaccccagccagctcactcaggccgggttcgt

SEQ ID NO: 34251 - DNA, 480 bp, Chlorella protothecoides
  modified_base (144)..(153): a, c, t, g, unknown or other
gtgcatgggggagggtgggtgggcgaggtgagcgcgcctgccggctggcaggaaggtgtggacgtggagtgatggactgggtccggagccagcacacgaccctggccaagcgggaatgccatgctgcccagacgtcaccccccnnnnnnnnnntgtgcgtgtgcatgggggatgggggggtggtagaggtgtgcgcgcctgccggctggtaggaaggggttgacgtggagtgacagactgtgtccggagccggcacatgaccctggccaagcgggattgccatggtgcccacacgtcaccctcccccgaccaacattcgcccgtaggacaccatcacgcgctccggcaagttcttcttcctttacaagcgcgtgggccaccgcgtgctcatcaacggcagcggggacctcatcgtgcgccctgactacatcgagaagtatgtgcaccgcatgccgggaggtgagcatgtgtgtgtgtggg

SEQ ID NO: 34252 - DNA, 75 bp, Chlorella protothecoides
agagggatccagcgccacagcccccgttcgagggcgagggtcactcgctccgcggcacgcgcgcggcccccggtg

SEQ ID NO: 34253 - DNA, 80 bp, Chlorella protothecoides
ttgcagggaaagccagagagacaggtttcaacccccttcttaaccccaaccccacagatccctcacctcgggcgcgtgcg

SEQ ID NO: 34254 - DNA, 61 bp, Chlorella protothecoides
agcatcgactatgcagactgcgtcaccaagacccctgccactgtctcctgcaccgtcagcg

SEQ ID NO: 34255 - DNA, 77 bp, Chlorella protothecoides
catgcatgcaggcacgcgcatcgtcaattgcctacggatttggacagggtgtgagatgcgtgattcgggagctggcg

SEQ ID NO: 34256 - DNA, 61 bp, Chlorella protothecoides
attaaatacatcgatccctcggtttcacgtttcgtgcgggtgtctgccgcgagggatcact

SEQ ID NO: 34257 - DNA, 61 bp, Chlorella protothecoides
ccctcaacctttgcaaacagtgtccatccctcaattcccacatcacctttcctacggcagg

SEQ ID NO: 34258 - DNA, 63 bp, Chlorella protothecoides
acgagtcggaccagcacagggagtagctggaaaagtcaggcacatcctaccacggagtggcag

SEQ ID NO: 34259 - DNA, 75 bp, Chlorella protothecoides
gaagggtccaaggtatgctgcgtgtgtcattgccgaggctgaagagtggaacgatctgccgcggtgcccatgggc

SEQ ID NO: 34260 - DNA, 138 bp, Chlorella protothecoides
gaccgccgccttgtcctcctcggagatggcagagggggcggggcccgcaccaccggcccctcccgagccctctgacgcggccggcgacgcagagtcgcccttctcgggggcgatcacgcctgtgaacgagtgataaga

SEQ ID NO: 34261 - DNA, 80 bp, Chlorella protothecoides
gccgcctgctgctggatgtctgagatcgggtgccactggccccgacacttatgcagcccttcagcaccactggctgaact

SEQ ID NO: 34262 - DNA, 3014 bp, Chlorella protothecoides
  modified_base (694)..(703): a, c, t, g, unknown or other
  modified_base (1353)..(1362): a, c, t, g, unknown or other
  modified_base (1423)..(1432): a, c, t, g, unknown or other
  modified_base (1519)..(1528): a, c, t, g, unknown or other
cgcgggcatgccccgccccgccgcgcggcccaggcccgggccgccggggccgccgggggccgccttggccacgcgtgactcgtcggccgggggcggcccctcgatcgtcaggtccatgacctcgtcgccgcgcaggatgaccaagcccagcacccgccgctgctcccgctgcaccgttgggaaggtggagggggaggggtaagatgagcggcaacaacatgtacacagccgcagtgagagaggacctgcaaagcatgcagtcgccctcttggaacaccacccagcacctcaactcccacgcgcgacgcgctgcacagctcgtcctaaaacacaactccctgcgcttgcgcataccatccctcacacacacctcctcctctgggatacccttcttgggtggcagcttgcggtactcctccgcatctcccaggaccaggttcatgtgacggtcgaaagccataaacctgcacgttgatgtagcaggcgtggtgtgagaagagtggagcactttcagtcagagactgggtaatcaggatgaagcagcaaagcacactggagcgacaggccaccccctcccccactcaccgtcccacaacttggcgcttgtcactgagagtgacccgcatgcctgcgattttgattgtgggatgaaaagttagtggatatcgcgaaccagcaagcagattcgactgtnnnnnnnnnngcaggatgaagcagcaaagtatgctggagagacaggccaccccttcccccactcaccgtcccacaacttggcgcttgtcactgagagtgacccgcatgcctgcgattttggttgtgggatgaaaacttagtgggtatcgcgaaccagcaagcagattcgactgtagacatccacctcccaccaccaccggggctggtgatgagccgagggactcacggaagtttatgtactgcagcagcttgctcgttttagagagagacatggcgtctcctttccctcgtcagctgcaagtggcacgtagggccctccgtctctccgctcgccactagactggccaggggtgagccggtgccccggtgaacagggatgcaggcaccttacactctcaagacttcgcacgaaggtatagatcggagtggtatgtgcagtgtgacaacgaggctggccctttcccggcccgctctggcctccagttccgcgctccctcctggcagtgcaccaatcggaaaacgccgtgctttccagttagaaagcctcttttcgagaggggtttcatttgggtggtgttttctcacaatatactccacaatgactgctctacccgcagcagaacagcatccgcgggcacgaagtaagcacaggcagagggnnnnnnnnnnagactactctacccgcagcagaagagcatacgcgggcacgaagtaagcacaggcagagggnnnnnnnnnngcgctctttgtactctcaagacttcgcacgaaggtatctatcggagtggtgtgtgaagtgtgacaacgaggctggccctttcccggnnnnnnnnnngtcagaaccagatcgcttgccgccccgccgccccgccgcctcagagcttggactgggtggccatcagctcgtcgcgcagcacgcggcgcatgaccttgttggccgcgttgcggggcagcgcctggcgcaccagcaccctgtgcacccggaacagcgggttcagccgctgcgagatggcacgctgcgcggcggccgccaggtgtttcgagctcgccgggtcgttgtcggtggcccccattgcgccgctcccaacgctcgcaccgctcgtcacacccctcgcatccccccccagcaccaggaagaggtacaagaggtcaggcccgccccccggcgcggggcaggccacggccgcggcctccatcacaccctccacgcccgccgtcacggcgcgctccagctccgcagagctggtcttgatgccgcccaggttcatggtgtcgtcggcgcggcccagcgcgcggtacaaccccccccccagccgctcgacctcgtcgccgtggcggcgcaggccgtacctcccccccggcccgggcggcatgcccgcgtggtaggcggcggcgtggtcgcggttcagcagcgtctgagactggcccagggacggcgtgcccagcgcggcctcgcccgccaggcgcgtggggtcgccgtggggcgacagcccgccgccgcgcgccagcagcaccagctgggaccccagcacggggccggagaaggtggagggcgcctggggctggaccagggtgcaggacatgaaggcgccgcccagctcggtgccgccgcagtactccaccacgggcttgtagccgccacgggccgacagccacaggctgtcctccggcgcggaggcctcgcccgtggagctgaagcatcgcagcgctgaccagtccaggccctgcatgcagccgctggcgcgccaggcctgtatgatgttgtggggggaacacttgcaggagttgaggactcgtcggaggtgggtgggtggtggagggtgtccccataccagccaggcgcatgtgtgcatggggctggacttgtggcctcgccctcccttcccgcacatgcacacgcacagagcacggccaccttgacgatgctggggaccacgcccaggacgttgacgcgcgcggcggcgacgaactggccaaagggcctgcccgtgggcgcgccgtggaagagcgcgatggccgcgccgttgagcagcgcggcgtaggccagccagggccccatcatccagcccaggctggtgggccaggccaccacgtcccccggcctcacgtcctgatggaagtgggcgtccgcgcccgcgcgcagcggcgtgatctgggtgaaggggatggccttggggtcgcccgtcgtgccggaggagaacaggatgttggtgggcgcgtccgggggggagggcaccccgcgcagcggcgccgcagcgcccggcgcgggcgcgcgcgccaggaaggcggcccacgtctcgtcgccggggcgcaggcgcccg

SEQ ID NO: 34263 - DNA, 61 bp, Chlorella protothecoides
ccttgcattgccagacctctccaccggccgatccctcgagtgacaactgcatttctcaaag

SEQ ID NO: 34264 - DNA, 62 bp, Chlorella protothecoides
gccaactttggggcactgctgctacaggcgtgggaacccatgcccatgcgacctggcatcga

SEQ ID NO: 34265 - DNA, 61 bp, Chlorella protothecoides
aggattatatgcaacccttaatagtttatcacccgcctgttacgtcccccgtcaggtggcc

SEQ ID NO: 34266 - DNA, 136 bp, Chlorella protothecoides
gaggcactgtctgaggctgtttctgagcaaagcgagtatgcaagacatgccccaattagttcaccctccccacctacaaaacgtgcgacagatgctggatttggtcccgcacgcagactccgtgaccaagctgact

SEQ ID NO: 34267 - DNA, 194 bp, Chlorella protothecoides
acaggtcttcattccaggggttccggggagcgtgggggatgcattcaagcgggtggggtggaatgaagcagagggccccttggcaatgctctcatctttccatttctcatcgctgtttccaatcacaacgaggccctattcccactcgttttttttctccccgcgccccaaacggacccccccccccctccaat

SEQ ID NO: 34268 - DNA, 61 bp, Chlorella protothecoides
tgcagtgtgcctttttgatgtgggtgcgcccgctgcgctgagctgcagcagtgcatgtcaa

SEQ ID NO: 34269 - DNA, 7177 bp, Chlorella protothecoides
  modified_base (1251)..(1260): a, c, t, g, unknown or other
  modified_base (1338)..(1394): a, c, t, g, unknown or other
  modified_base (1650)..(1659): a, c, t, g, unknown or other
  modified_base (1915)..(1925): a, c, t, g, unknown or other
  modified_base (2837)..(2846): a, c, t, g, unknown or other
  modified_base (2945)..(3054): a, c, t, g, unknown or other
  modified_base (3213)..(3222): a, c, t, g, unknown or other
  modified_base (3281)..(3290): a, c, t, g, unknown or other
  modified_base (3424)..(3433): a, c, t, g, unknown or other
  modified_base (4511)..(4520): a, c, t, g, unknown or other
  modified_base (4662)..(4671): a, c, t, g, unknown or other
  modified_base (5491)..(5500): a, c, t, g, unknown or other
  modified_base (5926)..(5935): a, c, t, g, unknown or other
  modified_base (7024)..(7033): a, c, t, g, unknown or other
ccatcctcccaccccccccctcctcccaaacaccccctcctccccttgcaggcgagtggttttgcagcggggagtgcagcgccatccatgcccgcctgcgcgcccgggtggaggagggcgtggtggacatcccggggcacccgcagcacagctggcaggtgctgcgagggaaggacggccgcgtagccagcgcttgggccctgcgcgccgcgcaggaggtgctgcaggagtcctttgaccccatcgtggacatggtcacgggggcggacctgctgccgctcatgctgcatgcacgcagccaccgtgagtgggactataaaggcatgcacacactgctcctccggcacaaggtgatcaagagcgtatgtgtgtgaaggggaggggggggggattgtggaatgcaggtcgagaggtcgatgtggctgggtaggggagtgggagggagctgagaagtggggcctgctgggcggcataggccagacttcatcctctgggttgccgtcggcatcgactccagtcaatcaggtgggtgagccacgactcccgcctcaccgcagccacccaccgctcacctcgcccccccacccccaccaaaaaagggcaagcctgtggtgtcggccatcgtgcgcgtgcttggccccggcgcggcggagctgccgctgatcgccacacgcttcgcggcgcggcgccagggccacgcccgtgtgctggtggacgccttctgcgctttcctggcggatgcgggggtgcaccgcctggtgctgcccgccgcgcatgagacggtgctaacatggcagcacggctttggcatggcacacatgccggaggaggcgctgcgcctgtaccgccaccagctgcacatcctggtgttccccgggacggaggtgctgtggaagacgctgccgggcaccgccgcccccgccgcccaccacacgttgcacgctcgccccgatccggccgtgcacacggtggcggcggtgctggccggcatcgtggctgcggtggagggtgagcacgtcgcgcgagaggtggccgccgtcgtggctgagctggtgcaggccgcggtggagggggccgggggagaggatcagccgggtcctagggaggcggtgcggggggttgtcggcggcgcagaggaccccccgcgtgccctgctgggcctggaggacgagggccgggtgccgctgacggtggcaacggggacgccgctggcacctgcggcgggcccgcggccggcctgcgagacggtgnnnnnnnnnnagggggtgtcggcagcgccgaggaccccacgcgtgccctactgggcttggaggacgagggccgggtgccgctgacggnnnnnnnnnnnnnnnnnnnnnnnnnnnnnnnnnnnnnnnnnnnnnnnnnnnnnnnnntcggccccggctgccccggtgccggcgttgccggccgaactcgcagaggagagggagcggcagcgggtgcactccgccacgcccctcacgggggcgactgcccccgctgcggggggtggcgccatgctgcccctcggcgacgtcctgcccgggtttgcggcatgcagcacgcccatcaatgtcgcctgatgcgcatggtggcgcagaagtgtacggtaccctctcatcgctcttgtccattgagactgaggacttnnnnnnnnnnccagccccgactgccccggtgccggcgtcgccggccgaacttgcagaggagagggagcggcagcgggtgcattccgccacgcccctcacgggggcgactacccccgctgcggggggtggcgccatgctgcccctcggtgacgtcctgcccgggtttgcggcgtgcagcacgcccatcaatgtcgcctgatacacatggtggcgcagaagtatacggtaccctctgatcgctcttgtccattgagactgaggacttnnnnnnnnnnntctcgtgtggcgcggtgcctcagaatccaggctgcgaagtggctcctcgaactctcccgccctcgtggatttcttgctgacacacgagccgtgagtcatccccagatgcaaccccacacctttctagatgtaccgaggcacccaggacctttgagacccgcggaatacagcctcaggacaagggggccgattcacgccgaatccgtgacactatcggaagccctgctgtcgagccctgggacatggaggagtccagctcccgcacatggacgccctggtgggatagacccacggcgcagctgtgccggaatgcctcacccggcgcggggtgctcctggaccttcctcacccagctcgagtgccacaccgagccccaccccgagtccggccaacccgtgaagcgctgcgtgaaactccataaacggctcatgaactgtcctggaaggtgagggagaggtacaggggtgctgggacggggcctcgatggcaaacctgaggctggctgacgcatcaacataacctctcgcgacccccccgggcaggccaccggtaaccgatgagcagcagcaggaggtcaccgcctacggcgatgccgccccgacacttgacctcggactacggtgggatgcagagtctagccctctgtgtgcgaccatgtttgtgctgggtcaccccacactctgcgtccctaacccagtggtccacccccggtggcgaagtggacaacatcgctgacgggattcgctttcgacccatgcaggctctccgacacgcccgtcttcccctcgttacctgcacgggacaaggtccagacacaggacgtgggccaggcatttgccgacttcctcagattcgccgaggagctgcagcagaggatggcaccaggtgggtggcttactgctggactgggannnnnnnnnntgaccatgtttgtgctgggtcaccccaccctctgcgtccataacccagtggtccaccccccctgggcaaagtggacaacatcgctgacgggattcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcgcgggcccgtgggcggtactcgctcgcagtgcacgatagttcacttttccaagatccatgcggggtcatcgcgcatcagccgagcatggaccaaagcccccagcttccgccgcctgtgcgccataggtgtgctggagttggatgagcggccggnnnnnnnnnntgcggaggagctgcagcagacgatggcgccaggtgggtggcttactgctggactgggannnnnnnnnncaggttccgaagaccaggtgaggggcaaggggcggtcgtggtggagcggggggcgaggggagggaaaagcctcgtccaatcaaggggtcagccgatcacgtcccccctcgtgccatgccctcacgctcgcggcnnnnnnnnnnctcccacaccccaggtggcggtggaggagaaggaggagtcgctcctgtccaaggtctttaggttccgaagaccaggtgagggtcgaggggcggtggtggtggaggcgggtggcgaggggagggaaaagcctcatccaatccagggtcagccgatcacgtaacccctcgtgccatgccctcacgctcgcggctgcccccaaccccagcaggcgcggcgcaccggccagacagccagacgtggcaggagtatgccaaggacttcaccgaggtgtagggcccgcctctgcgctgcactttcctcttgatgcattttggttttgcgaagaaagaaagaatgagtcatcacattgttttggccgagtcgtgcccagcccccatgcgccctcctgctacccccgctgcgagctgtatcctgcccccctccccccctcgtggctcgtcagcactctctgctgcccctggtgcactccttctcacctgcctttccactgagggctgcccaattccggccttgtcaacaccccgattcgtccaagttgagcactagcccccgggtacaaaaacagttgatgcaggggtaggttgggccctaacatcatctcagtgatggaccacaaaatgcatcctggacgccggcccttcagtccttgtgccaccaacaggggtcaagttcaggggatgcccaggatgccactgggcaccgaggccttgtactcctggaactgctgcccgaagaaggacagcaggagcgcgtcttcgtattcgactcgggatctgaagaatcgccacacctgggccgaggtggggagaggccggcagggcttgggtttaggatgagggaagcatcgttgaggcgtgagcgacggccccctcctgatgccctccccccttcagtcacccaccacgaccaggaatgctggagtgcatacggggtttgccagcaggacctgggtgccgatggcccacagggcccaccccgcatagccagggtgcctcatgaatccatacacgccgtgggtgacgagacggtgcctctcagtcctctgactggcaatggcgtgcgtgaagttgtgcgttnnnnnnnnnnatggaactgctgcccgaagaaggacagcagaagcgcgtcttcgtactcgactcgggacctgaagaatcgccacacctgggccgggatggggagaggccggcagggcttggatttaggatgagggaagcatcgttgaggcgtnnnnnnnnnntatccgtacacgccgtgggtgacgaggcggtgcctctcagtcctctggctggcaatggcgtgcgtgaagttgtgcgtcgccgtaacctgccgcatactccaagagggtgaaagggctggtcggtcagggtgcgcaggcatgcaacccgccctttcagatcatctctcctgtgcaggagcagcagctaggaccctcaccatgccagtcttgcggagggcctcccccgccacgatcatgaggaggcctagccgggtggtcagcgtgcctgtcttcagcgatggcatgagggtcctctccaggccatactcgaccagggatgcgcccatggcaatgcagtagggccagctcaagagccatgctgaaccggggaggggggggtatctgatgtagggaccctacgtgcaactctatcactttccagcactgatggcatgagcagagctgcaggcgttcatgcacaccgaacgctccaatgcgggatgctcgacccacatcgtcgtgagatgtgctcacggttgtaatagaatgtcagagcgaactccgatccgtggaaaatacagagggcgagcgcaaacaggacgagtggggtcatcggcccccgagcgagagcacatcggttgggtggcacctatttatccatcctctcagctacgagtgcatcgctgacatttttcccggggtatgtttcaaatgtcaggcaggcgcagacataaaatctcagggagcgacaaatctcaggattgaagggtctcgaccgtgtgtgtcgacgatcagcactcagctcggcacgcgacgtcacaacgtcgctcacgaaacatcnnnnnnnnnncgtgtgtcgacgatcagcactcagctcggcatgcgacgtcacaacgtcgctcacgaaacatcgtcacggcagggtcacttgtccagtcccggcagctgcttcgtgattttcttgacgacttcttcagcatcactgatgtagtcctgtccctcctgaacatacttgatgtacaggtaaggaagagaagcctgcatggagcatggggtgggcgcatcagccatgcctgtgtaaatttacctgattcatctctcggcatcccaaacacctcctcccagacgtaaatgggagtgttcttaccagccccaggaattgaatcgggaagccaagcagctgcaagagggggggggatttttgggatcactggtaagcccttgatgcatccacgcatacatgcgtagaaaacatgtaggcaacatgcaccgtgannnnnnnnnnttggatcactggtaagccattgatgcatcaacacatacatgcatagaaaacatgtaggcaacatgcaccgtgaacccaccactcctgtgcataccacgttgaacagtggaaggtggatcagccactccgcaaaccagaccgcgacgaacgctgtgatcggtttgaggggtatgaggaaattcccgctggaggggctggtcgaaattgatgatagtgggaagaggagccacatttcaatcaagtcatagaatgaagctctactttggacatctacttacctcccacaccatatccaatgacggctggcttgttctgtgcctgcatgggatgcatgcccgagcgacagctgagacctcatctgccctgccatgtgctgtaccatccaaccctagctcagacacatggcaccccaccttctcgaatttgtcggctgtgtccgccaggaatgtgtcaaagtccacctgtttgcgcgcgggacggccagcgtgtgtcctgacatcggcacgtcggaaggttttggggcctgcaggcagtgtttggcgggaaaggtttcacttgaacgtcaaacaggcaccggcaggctgcacgcgcatcctgatatcccgtgccaaggagccaggattgtctggacggtgggcaggccccagatccactcactgtggggcgctgcacgcacaaggacgttggtccgcagggcggggaggccacgggctgccaattgtgcgatctgcatggctatgtgagcttttttggtaagagggagagatttctaatgctgtgaccacggtgtcgaatagggtacaagcctacgcgtaaaggggtccggtagggggtggtctgctgcccggaagacgcctacggtgaaaagatctgatgggtttgggttcagattctctcgtctccgcaggcgcagcacggttgtgaaaacgagtcggatgtgcgaacctcgaccccctactttccactatggattcacctggaataaaggcgagattctggccgactttgcaccgatttataatcggtaccccccgagtgccatctcataataaaaagaccccacttttggcaacagtgtcgacccagcgnnnnnnnnnntgtcggtaccccccgagtgccatttcatattaaaaagacccaatcttggcaacagtgtcgacccagcgctgtcccagtgcgcctcctcctgtcgcactcgtgcccgaagcctacacctcacagtgtcccgcgaacactctttgc

SEQ ID NO: 34270 - DNA, 79 bp, Chlorella protothecoides
tcaaagggatcgctgcaccgccccgacatcaaagccaggcacagctgagggcacccagatcaccttttttctctctgca

SEQ ID NO: 34271 - DNA, 61 bp, Chlorella protothecoides
ggaagtgagaggcatgggaaactatggagcaggagagacagttctacattctcccgcaccc

SEQ ID NO: 34272 - DNA, 147 bp, Chlorella protothecoides
gcaggagggctgcccttgcaagccctcgccgtgcgcgcctgccctgctcatggtttcccaccaggtttcttgatggaggaccttccatattccagccaagttctgtgtacatcaatcaacaatcatagggggcacagcacagtcagt

SEQ ID NO: 34273 - DNA, 61 bp, Chlorella protothecoides
gctggcctgcttctccagagctacggcccggtggcggctctggtagttcagggccagggat

SEQ ID NO: 34274 - DNA, 86 bp, Chlorella protothecoides
gacccgggaaggcgtgcctggttttcagtgtgctgacgctgctcttatgctgcgcttggcttgttttcatgctggcgcgcagtgta

SEQ ID NO: 34275 - DNA, 63 bp, Chlorella protothecoides
ataagggtgcactgccctgatcagaacaaaggtatgaagacaccccacaacggcccttgtccc

SEQ ID NO: 34276 - DNA, 344 bp, Chlorella protothecoides
  modified_base (84)..(263): a, c, t, g, unknown or other
actccccccaaccctgaacacaccatccccggccgggcgcacctgtgacgacatcgtacttgttcagcggggtggaaaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagggtctctgacacagagccagatccaatccccccactcccccacctgcgcacaagcgaccctccggctgccaccccgc

SEQ ID NO: 34277 - DNA, 61 bp, Chlorella protothecoides
catcagaagtgttgtgccagagtggcagccatctggcccctgcaggcagcgtagccctggg

SEQ ID NO: 34278 - DNA, 111 bp, Chlorella protothecoides
ggcgcgggcgtggacatggggttgaatgtataatgtattgtgcagggctacccgggcatggtcttcacatcgaacagtgaccatgtatggcacgccagcaaccctctttcc

SEQ ID NO: 34279 - DNA, 101 bp, Chlorella protothecoides
ccctttgtactttgcggcaccatacccagggcatccccacccacctggggccttcccgcatgcccgtcttcccccctcctgcctgccccgaggtcgtctct

SEQ ID NO: 34280 - DNA, 1847 bp, Chlorella protothecoides
  modified_base (207)..(216): a, c, t, g, unknown or other
  modified_base (421)..(430): a, c, t, g, unknown or other
  modified_base (1427)..(1436): a, c, t, g, unknown or other
tggtgggaggggtggagtgtcgggcaggggtgtggggtcgtccttggcacggagttgccagtcagttcatggctggtcaccagaggcacccgaggcgacgcttgcaccgttcaggagtgcaaactccctgcctggcgctctctccaaggccgcaggccgtcacagcggccgtacatagcctgccaacatcagttccaaatgtcgcannnnnnnnnnaggctctctccaaggccgcaagcccgtcatggcggccgtacacagcctgccaacatcagttccaaatgtcgcagcacatacctcgatacaaagctgcagcggcaggcaattttgcgcatccgcaacacccataaacccccgtcttccccgccccaggagcttcatccccatcacaagcccccacgcacctctgccgccagcgaannnnnnnnnnctgcgcatccgcaacagccataacccccccgtcgtccccgccccaggagctccatccccatccaaagcccccacgcacctctgccgccagcgaagcggccgccgccacgtccggcctggccgccaggacctccgcgccggccctcaccgcgtcgctcgtcccggaaccgctcgtcccggaagtcatcccgcctctcgccccgcctctcggccaccggcggcctctgcattgttggcaggggcatggggccaggggcggctcggcagtgcagtgaggctcgccatgcaatgctccaaccgcaccatcccggctcctcagacaatcgcgcattgccgcgggattgagtgccgctgcttgcatcactcccggggtaacacggcgcaacctgaagcccaccctcacctctttccgccgctccttcttgtgtaccacctggcagaaggggtctgcaccggatgcacggaaatgtcatgagcacatgccacacgtcgccacgcctcgcgctccgttgccacccgcccactcactctcgatcagtcgcgacgtggcttcgttcgcgtcccccccgcattccgccagtactgccaccacatcctcctcggatgcccccgtcgcctctttgatggtgtctatcaccttccgggaggggccggggttccccttccgtgtgctcccggcgtcgccggcggggccttgtgcatgcgctgcatggggggccatggcgtaccagctggctagatcgtgggtgctggggtcgggatctggactgggtggggcctggcgagggatgcgaggtgctatgggcatctgcgcgcacatgacgcccggaacggcattatatattgggacgtcggaggcagtcgggagggtactgccgcacgccacacggtacggccattgggagggggccaggcctcgtcgagctgaccctgctgccgtgcacaccttgaacataacgatagtttcgctctttgccattgtcaccaaccattgtcannnnnnnnnntggtacggcaattgggagggggccaggcctcgttgagctgaccctgctgccgtgcacaccctgaacataacgacaattttgctctttgccattgtcaccaaccattgtcatggttacatgggcattgctgacaagcatgcttgccgcatgggggccaggtcagggtaggagctgggggcacatgcaggtctgtgggcggcaggcgtgcgatcaagaccaccactttccttccctccaacgcatacacacacacgccccaccacacgcgccgcgctcacgccgccgcttggggcaggggccgcagggcgtccagcaccgcgtcgcgcgccgcgcggtacctgtcctgcagcgcggcctcgcgcgcgcgctgcgcggccaccagcgccgccagctcagcgacgcgcgcaggcc

SEQ ID NO: 34281 - DNA, 246 bp, Chlorella protothecoides
actcaccatctctgccgtgaagatgaagtgcgtatcaagccacctgattgcattcttgagatcaatgatgagctgcaggattggggatcgagaatgggatcagaagtgttggagattaatctaccaaacagtcaggaaggtacctcaagttggccggtcagatttgagcattccgactcgcagacacatcccccacatctacaggcaacaattgggcaactcctttactgcttgcatagggagggc

SEQ ID NO: 34282 - DNA, 62 bp, Chlorella protothecoides
tcctcctgatccccgctctcgctgtcctccgcgtcgtccccctcgccgtcgctgccgctgtg

SEQ ID NO: 34283 - DNA, 69 bp, Chlorella protothecoides
ggaggggggttggtggctaggcaggggctgggagcgtcacaaggcaacttgggaatgttgctcttggga

SEQ ID NO: 34284 - DNA, 80 bp, Chlorella protothecoides
catgtccagcacccggcactacagccgaggtagggcacgcgccgcctccttctcctcgacctcgatggggatgccatcca

SEQ ID NO: 34285 - DNA, 149 bp, Chlorella protothecoides
gcagagaatgcgaggggcaactaccagggaacacctgctgcgacaacaaaacttcccggccaccagggtgctcgcccccagccagccccgcctggacaccgcaggtctgcatgcccggcaccacgccgccagctcagtactgcacaccg

SEQ ID NO: 34286 - DNA, 107 bp, Chlorella protothecoides
atgcaaacgggtatcgcgtttggcggcgcatgcgactgccggtacctaatctcggcatcattcccggtcaccatggctcgttcataccatccagaacacatccgatc

SEQ ID NO: 34287 - DNA, 75 bp, Chlorella protothecoides
gttgtagggtctaacccgcccccacaacagctgcccaccacaatcgtgctctgatcagtcctttcttccatccca

SEQ ID NO: 34288 - DNA, 73 bp, Chlorella protothecoides
gagcacataccttctcttggtcctgcttctaacatttccgaaggctgtccaggtctttgacatctccacgacc

SEQ ID NO: 34289 - DNA, 70 bp, Chlorella protothecoides
ggtccacgagatcggcgtgtgagcggggatccctgttgcggacaggcgcccgccggattcccaggatctc

SEQ ID NO: 34290 - DNA, 68 bp, Chlorella protothecoides
acccaggcaagggactgacggtgccctggggtgcactgtgacggggtgatggtatgtgacgctgggtg

SEQ ID NO: 34291 - DNA, 83 bp, Chlorella protothecoides
ggggggggggggggggggggggggggggataatgtgcacagccctcgagaagaattgcacaaggaagatgagctgggccgaag

SEQ ID NO: 34292 - DNA, 72 bp, Chlorella protothecoides
tcgcacgggactttctcgtgcccttgaggctcttgagacgagaatggattagatcgatcacgctgcaagcgc

SEQ ID NO: 34293 - DNA, 1205 bp, Chlorella protothecoides
  modified_base (95)..(104): a, c, t, g, unknown or other
  modified_base (792)..(801): a, c, t, g, unknown or other
aaagacgtcggcctgcgcggcgtcggcctcaaactgcacgggccccgctgcggcgtcacgcgctgcgccatagtccacgccgctgaagcccttgnnnnnnnnnncccgctgcggccatggacccgccgcgcggcgcgtcgcccagcggcccctcccgccgcttgccgccgcgcacgtcagtgaggaaggcgtccaggccaaagacgtcggcctgcgcggcgtcggcctcgaactgtacgggccccgccgcggcgtcgcgcgccgcgccatagtccacgccgctgaagcccttgtctggcttgaaccggcgctcgccggccgcatcgtcgccaccggcccccgcgccgtgcacctcctcgtcctgccgcccgcggctgcggaacacttcgctcctgtccgcgaacaggggcttgtcgtacaggttgtacgcgtcctccgaggccaggccggaaccgacgcccgtgtcctggttgaacaggcgctggtcgtacatggcctccccgccagacacctgcaaaggggaggggtggagagtggggggggttgcctgagtgattgggtcgggtgggggggaggcaggcaggtaagtgggttcggcaagagtgaagatggccatggcgaggtgaggattgagtgcgagggggagaagggacctctccaggcaacacagcggcagtgcgcatgacacccgctcccgggcgccggggctccggatacggcacagccaggttcccaccctgaacggaccccgccctggcatccccctggcaaggcccccctccacacacgatnnnnnnnnnngctggttacgccacagccagggtcccaccctgaacggcccccgccctggcatcccctggcaaggcccccctccacacacgatgaaacccaccttggcctgtcccagcgcgatcttctcggagatgtcgcggtcgcggtcgcgcgtgagcttgctgcgcttgtgcccatgcgcgtcgcgcgcttccagccggcgctcgcgctcgcgctcgcggcgcctctcctcgcggatctcgtctcgctgccggcgctcctcccgctccgcccgcgtctcgccctcggcggcagggccgtcccgcacgcgatgcgcggctgggagctcccgctccgcctccgactcgggtgaggagggggccgccgccgcgctgcgcccagggccccgctccgccagcggcacggtgttgctg

SEQ ID NO: 34294 - DNA, 1531 bp, Chlorella protothecoides
  modified_base (291)..(300): a, c, t, g, unknown or other
  modified_base (721)..(730): a, c, t, g, unknown or other
ggcggtggccgccgccgccgccgccgcgccctcgtccccggcctccagcggggcgcggcacagcgcgcgcagcagcgcccgggccggcgtggcgccctccagccggaggagcgagcgccctggccgcctcggtgtgctgggcgcctggtcgtgcgtcgtctccttgtcctcagccagccccaggatcagcagcgccgccgcctccaggcacctgtgtagcggagtgagggggggggaggggactgaagcacagccccttgcgctgcaccacgacaccaaacatggccccannnnnnnnnnggcagagtggggggggggaagggactgaagcacagccccttccgctgcaccacgacaccaaacatggccccagcacgcggaaacaccatcccagctcgcctgtttgccaggggctggtcctcatcgcccgcaccctgcaggccatgcatcgcggccgccaggagggcgtcgtgcgcagccgcgccctcgaggccgcgcagctgggtctgcgcggccccgagtgccctgaccttggcggtccacatcaggaagcctgggtgcagggctcggtgcggggaagggtcgggcgagtgggcgggggacctcgtgtgaccttacagtacaggtggacatgcacatcgtgtccacacccagccgggtagacatgcttgatgccctcacgtccactaccccatcgcacatcgcaaccccacccgcggannnnnnnnnncgggctcggtgcggggaagggtggggcgagtggggggtgacctcatgtgccctcacagcacaggtggacatgcacatcatgcccacacccagccgggtaggcatgcttgatgccctcacgtccactatcccatcgcacatcgcaaccccacccgcggagcctcctgaaacccccctcccagcgccagagcctcgcggaacaaaaccctgccccacgtttccccccctcgctccccgtcgccgccacacctcgatgcccagcgccgccctcctcccccggctccagggccagcatcgcgggcagcacggcggggctggccagcgtcggcgccgactccccacttcctggccccagcaggccctccatgagcacggtctcgaaggcggcggaggccgcacccggcgcccgcgcggccgccaggcgtggcatccgctgcagccactcctgcgccgcgggcggcgcgtcaggcccaccgccgcccagccccagcgtggcgcgcacgacgggtcggctgtacagcaggcagggcatccactccgtcagctcccgcagcaggcgcagagcgcacgcgccgtgcccggtggtccaggggcggttcttgggcacggcgccgaccacagcctcccgctcgctcagggactcgaccaggtttgcggccgcgcgctccagcgcctcggccgccgcgtcggcctcctcgccgcagcccagcgcggtctcgcgccgcgcgcgcaggcacatcgtgcgcagcgcctggtccagcccccgctccagccagggcgcggcggggtcgccggggtcgag

SEQ ID NO: 34295 - DNA, 72 bp, Chlorella protothecoides
tttccacgaattctttatcaatggttttggctcaccattccattttttgaatcacgatctcttcttgtgttg

SEQ ID NO: 34296 - DNA, 81 bp, Chlorella protothecoides
gtggcattttcatctgatgagagtacttgccatgctgcgccacgatgctttctcgcccgcaggtgtgctttgactgcccgg

SEQ ID NO: 34297 - DNA, 61 bp, Chlorella protothecoides
ccaggggcatgccaacagggcatgcccatgcactagctgcaaccaggcttgcaagtggtgc

SEQ ID NO: 34298 - DNA, 109 bp, Chlorella protothecoides
ggtgtcggtacatactcaattgcattgccagtacactcctgaaaacaatggctttgttggtctggtggaagggacgcccgaccacacaaggacgcagtttcaatcggcg

SEQ ID NO: 34299 - DNA, 74 bp, Chlorella protothecoides
tgtgaacggggcggccaacatgctgatgctggtcaagtgctttcttgcgaatgcacttcgtcccacagcttttg

SEQ ID NO: 34300 - DNA, 61 bp, Chlorella protothecoides
ccgcaaccattgggaaggagaggcggggagggccccatcaatacattgggacaggggacgg

SEQ ID NO: 34301 - DNA, 61 bp, Chlorella protothecoides
tttgtttgggtcagcagagtcggttgaattccctgaagaataccgttgaagtctgcctgtg

SEQ ID NO: 34302 - DNA, 97 bp, Chlorella protothecoides
gcagctgtcgtgcaccttggaagaggtgggtacaatgaaggctgtggtgtttggtctgggtctgggttggttgacagtcaggtcgagcaacatcctt

SEQ ID NO: 34303 - DNA, 6490 bp, Chlorella protothecoides
  modified_base (115)..(124): a, c, t, g, unknown or other
  modified_base (3296)..(3305): a, c, t, g, unknown or other
  modified_base (3599)..(3608): a, c, t, g, unknown or other
  modified_base (4530)..(4539): a, c, t, g, unknown or other
  modified_base (5187)..(5196): a, c, t, g, unknown or other
  modified_base (6231)..(6248): a, c, t, g, unknown or other
gggggggcgggggcgcattgatgggagatgtggagaggtaaggaatgtttcatgacgcgactgaggcagagggtgtgactgagtagggggccacacgaccctctcacctggttgnnnnnnnnnngtggaggggttagagaatatttcattacgcgactgaggcagagggtgtgactgagcagggggccacacgaccctctcacctggttgaaggagcagttctgccgtgtgaagaccttccgtgccatcagagtgagcaggtcctcgggaggcgctgcagaaggttttttgggggggggagtgtgaggtatgcgcggcagcttgaatcgctactcctctggtgcaaagtagccagggtggcagctcaggaagggaggagggcggtgcccatgcgtggtgtcccccacaggagcaaagcagggcgcaaagatgcacacacccttccccacgtccgtgcaaagacagttgagacggggccaaagcattgccacccctctcctccgcaccatgcacgttgcccatctgccgcttgatcttggtgaagtggacgtggtggccagccaccacctgggacagccgccgctgcacgatgccgccgccctcgccgtcggccgactggggggagtcggggtcgtccgccaagaccaccaccgccgggtggctgcgcaggacggtgagcttgcggcccaggctgaactcgcgctgctcgccccaggccggggagtccgggggcgtggggatggagaggctgcgcgcatgggccgaggcccccggcgcgccctcatccacagagctggagctggcggtgaactcggggctggaggcgatggagggcttggcctgggccgggcggccgtccggggtgtaggggccggagagggaggcggtgtcggaggaggtccaggcccctgccgcggggcccatgtcgcactcctccccgaagttggcccccgacggggccggggggccgcagcagctggaggattcgtgcagggactcggcgtccttggagggacggcagatggtggcatcggccagcaccgcatcgcgagcgagcttctcccggcccaagtaagattccaaggccaccgacggggggggaggcaggggccgagccgccgtagccgcggccctcattactccgggcttggacacgggcacagcctcgggtgcctggatttccgcatgatggatgccactgtccacggtgcgggggggtgccaggcagaacaggctggacaagctcaaggtgcgacgggcctgacgagggggctgacgccgtttgctacctgccatgattccagactgagtggcgcccaagcaggtgccgaaagccctcaaaaggtgtaatgaagctgggttattgttgggaaccaccacatctgccgggccagtaaaggctcggggggccccaagcgtatactgggattcgccgaccccttcccatgccacgcgtgtcaaatccgggtccgaccaaaagagcgaatctgtgcctgaacagggctcaggcgctgagataggcatgctttgggcccaaagcttgtacgatgggcttctttattaacacctgggcgtatgactctactttcgggggcctcgaaggcgtttggacggcatttcataatggggacggacccagtgaccttgggtccacgtgaccaggtttgcccatctattaggaaggctgacgcacgtgagcttagaccacgcgaccgtattcccgtaccctccccaggcctaagcccgccagactaataattgagtggcaagaaggctctcaatggaagcgctgggctctcgaatgtgacttccaacccccgccccagactcagccacacatggtcgaaagcgacgtttgagcagaagccagctaccgtagggtggcgatgcgaagctgctcggcaatcatccttgctgcatgaagtaattcactggctgcgaggacatcatgtcactctcctcaagcggaactctcatgccggaggatggtgtcctggcttcggccatgctttgcgattcgaggcactccggaccccggcacccgagtgcggcacccaccgatatgactatgggcacggcatccccgcatggcatgcagggatttcttacccttcaaggatgccactgcatttcattggtgaagaccgatgtcgtctgacgctaaggatgcgtccatcgcctgaccagcccttgaatcttggcatgcagggtaccaggttacatagcatcctgcacgccttgccatctagcaaaaactcaacgtcggcagcgtccttcctgcattcagactggccagcttggggctgaaggtgctctggactcgcacctgcgggcacctcgctcccctgcgtcctgcagaatccaccaggctcccggtgtgatcctcttagatttggggggctccatctacgcccggcccctctccagcttctcctccagtttctgcgcaggcgaaatccaacattgttgacctgattcgactcgatggagaggatgtaccaaaagggtggggttcgtggcagcccagggttgacacctggtcacggcgcgcgacggcgcgcggacatcgcacatcgcaccgaatcctcaccttgcgcagctgacgacccagcgccgctgccagtggcggtggcaccgcgtttccgacctgacgatgcttgttatgcacgttgccgtagaagcgatgcttgtccggaaagcctgcgatcgggagtcacggactccaaggtgaagtctcggtgcgtgccgaggtacagtacgaatccggtctggtagcgccgatggtgctgagcctttggcgcatgcgagcacaatgcaaggaatgctggtgtagggctcaggcagtgcgatgcgccgacgccagcgacagggtacgttcccgtggcttcatgcacccgaaatccccagtcagacacggatgtgccttccggatccgcccgccccaggtgcaaacggtccaccccccaatacccccacctcctcggcctcaccctgggcgcgcgcgcactccctcacgctgacgatgcgatcctgggtggggtggaacacctggcccaccttgcccatgggctgggggtcagtggtggaggtggggaagtggccgcgtgggtccaggcgcccaaacagcccacgccagccgttgtggcggtcggcggtgttgggcaggcaccagggcaccaggggttggccctgatgattggggaaaggggcttggaggggtgaggtgtttgccaggaacaacgctggagtggatggctgacctgataggcggcaggcaatggcagcaggcaatcgcnnnnnnnnnnggaggggtttggaggggtgaggtgcttgccaggaacaacgcaggagtggatggctgacctgaaaggcggcaggcaatggcagcaggcaatcgcaagctcacattgaacttctcgcgcgaggggtcgctcttcacgatctcctccaagacacgccagtcagcacccgggacgcccttggggatgcagctgcggcgagtgaggagaaggaggccacgtgatcttagatttttataaagttttccctgctgtagcagtcaggactacgactctctgcctgagcgctgaggcatcatnnnnnnnnnnatcatcttagattcttatgaagttttccctgctgtagcagtcagggcttcgactctctgcctgagcgctgaggcatcatgcagatgccgctttgccagccaaagtcggaccagaggcatccacccagcaaagcatccaccttcccagactcaagtccttcttgcgcaccggcagcgctctagattgagctcgttcatgttcttggagatgtggtcgtaaagcgccgggcagccgccacgaacagcccgctggaaggccgaaacctggcagaaaagggatgcacgcctgctgagctggtagccgcgatcacacccggctggcatgagaggcagcaaggcttgaacgaagcaagcagaggtgcccccatctctccggaccagatcgaccgagtcgatatctaccactgaactctctcacaactcgcccgcccctccccacgagcccctgctcctcaccggctccccctggtactccatctcctccacgtcgtgcccgttggcaatgacaggaaggtcgctgatggcatcgcgcaccgtgacagggcgcaggggggcgcccacctggcgaggcgggatgagtgtgtgagcgttagagagtgaagcccttgggggtgcgggaggagcatgctgaggtgtgggcgtgcaatgtgcatgatggagaggacacaggtcaaccgggttttgggctgcacatgcgcgagtgcagtggtatgcccttgtgtgagaaatagattgaacttcaaggagcaggcgtgctaccaacagttgagatggagcacatccagttcccaacaagtacttcaatcactttcccaacaaccaggaggcacaggcatgcctccctttcatcccacatgcgctaccgcccgccgccggccaaccccccgcctttacgccgttccctctcaccgtctgtggtacgnnnnnnnnnntcaggcgtgctgccaacagttgagacggagcacatccattttccaacaagtgttccaatcactttcccaacaaccagaaggcacaggcatgcctccgtttcatcccacatgcgcgaccgcccgccgccggccaaccccccgccttcacgccgttccctctcaccgtctgtggtacggcggtatactgcacgccattgggcaggttgatggtgagctggggggtgcggaatgcgtgcatcaggcggggccagtcgggcaggccctctccgggcgccgcagcccagatgaaagtcctcttgcgggactgggccacgccaaagttgccggcgttgagcacgccaaagcgaacctgtggtggtggagaggggtgggtatgagcggctcgagggtgggggacccgacggattgggcaccagctccggcgtgtggagcttggcgtgtgaatgacgatgggcacggccgccgtccaggaggcgcgcagtccaacctgtccagcactcagcatgctctggattgcaatccaagctggcgcccttggaccccctctcccctgccacgggacttgggcccatcatcactcacctgccatggtccgccaccctccccattgcatccaaaccaccacccaccctgcccccatcacgcacnnnnnnnnnncctggattgcaatccagactggcgcccttgacccccctctcccctgccatgggacttgggcccctcatcactcagctgccatggtccgccacccccccccttgcatccagaccaccacccaccctgcccccatcacgcacctggtaccccatgtccagcaggcagcgcagggtgaggcggaaggtgaaggacttgttgtggctgacaaagttcctcacgttctccagcaggaagtagcgggggcggtagtagtcggcgtaggacaggaagctcatgaccatggagttctggaccatggaccagttgcccttgttgaagcgattcatgccggagtagccctggcagggcgggccgccgcagatgaagtccacctcgcccggcaacggcagcgccgccacctggtcggcgggcagggcttcgctctcggccaccgcctcggggctggcctggcagtcgtcggcgccgccgcccttgaccatggcggcgtgcaggagcacattgcagttggcgcagaaggtcgcggcgcgcgggttgttcaggcggaaggcctccgccgccgggcgctcgtactcgatggcccagcgcgcgtgggcggccccagcctggtgcatgccctccgacagcccgccgcagccggcgaagatgtccatgctggccagcgacacgccgtcgtcaccggggaaggcgtccaccgccgccttgcccttgtccgcggccttggcggaggcgggggccgcgttggaggcatcggaagcagagcctgggtgagaggggttgtttttgggacagggaggttcagaggaagggtcgggagttgtgggccagagctttcggcatgccctgcttggcaaacggcgccttggcctgggcaggaggggtttgggccacatggtgccctcaaaacaccaagagcttccgctcgacgggcacacacttgattcccgttggaagaggacaggaccagtacccgagttcgccccccccaaaatgacaaagtccctcgcacattccttggcatgtcgagtctgctcccannnnnnnnnnnnnnnnnnccgaggccgtttccacccacgagcccctgccaacgcgccatgcagggcccccatcccagctcaccgcgtggaaggagggtgcctcgtaagccttgtcctcatggatgtcctcggggcggtagaagcggcggacggtgagggtgcaggcggcgcccttgcccttgccgctgctctccacgccgatcagctgggcgatgccccaggcacgcaggcccacgtgggaaccctgcatcggtggaaag

SEQ ID NO: 34304 - DNA, 61 bp, Chlorella protothecoides
tgcttctctgggggacaccatgcatgggcaacgccctcctcccttcctgagctgccaccct

SEQ ID NO: 34305 - DNA, 66 bp, Chlorella protothecoides
acaatggccagcacacttcaggctggccacacaaggaccctgcctcgctggatcccagcacacctc

SEQ ID NO: 34306 - DNA, 72 bp, Chlorella protothecoides
tgctacttgacaatctctggattctgctcacggtgcaccggactgtggcccaccagcaattactccggcgcc

SEQ ID NO: 34307 - DNA, 61 bp, Chlorella protothecoides
ctggctcagttccaagtccgatcattctacacctcccgtgtcaatctgccggccgctcttg

SEQ ID NO: 34308 - DNA, 123 bp, Chlorella protothecoides
tggaggggcacggaactgtcgagaatgggaacgggtggcgatggcaaggagggggcaccaggcagatcttccatgcagtcccattctgcggttccccagacgccgagcgcaaacttccacaca

SEQ ID NO: 34309 - DNA, 77 bp, Chlorella protothecoides
cctgccacagcaggacgcgcatctcgtagggcagcgcgttgcgcagcaggagcggcggcttgacgcacagcgtgatc

SEQ ID NO: 34310 - DNA, 116 bp, Chlorella protothecoides
gccgccagcgcctgccaggctgaggctctgtcgctgatgcggcggcccaaacctgccaaagacagtcacggcagctccctcagaccgccccggcagctcccccagaccgccccggc

SEQ ID NO: 34311 - DNA, 76 bp, Chlorella protothecoides
cgatccgggccatgccaaggaggtgggcaggatgggtgggggcctaggatcaccttttcttgtcaaaaatggggtc

SEQ ID NO: 34312 - DNA, 185 bp, Chlorella protothecoides
cttggggttttgctgcggaacaggcgccccgcctgcaccggcggggaaggtggggatccgacggcgtgtgggacgggtgatgcctcatcctgtcagtgagcatgggagcctggagtgcccagttcgagacatcgcagccccacgaacaccaccaccccagcgccctgtgcacactccccagccac

SEQ ID NO: 34313 - DNA, 114 bp, Chlorella protothecoides
gggagcatgtggagaggtcaagagaatgctgaacttcggcacgagacaccccttcagcgcgctctcgcgaatctgatctttggccaggcgagcaggcgccaagcctcgggctga

SEQ ID NO: 34314 - DNA, 69 bp, Chlorella protothecoides
gccacttgcctgcggcacagggtctctgcgggtggagctgcctccgcagaccctctgcagcgcacagct

SEQ ID NO: 34315 - DNA, 76 bp, Chlorella protothecoides
ggcgacggcggtgaggagggattggaggagtgggcaggtggtgctgggcgacggcggtgaggagggattggaggag

SEQ ID NO: 34316 - DNA, 61 bp, Chlorella protothecoides
cctgctcaatactaggaggatagttttaccactacacacagcaggccgtaggtgtgctcaa

SEQ ID NO: 34317 - DNA, 73 bp, Chlorella protothecoides
ttggcctgaaggaggtgagcatctggggccagagtatttgaacggcagagaagctcggcagtggcatgtcact

SEQ ID NO: 34318 - DNA, 61 bp, Chlorella protothecoides
agtgtcgggctgaatgactacaaggtcgacccaacatttcccacaggcccctacctcactc

SEQ ID NO: 34319 - DNA, 63 bp, Chlorella protothecoides
tccgggtggtccccaggaggaagcgggggtgcggcgggcgggaggtcacctggtggacccccc

SEQ ID NO: 34320 - DNA, 61 bp, Chlorella protothecoides
gcaccctgcttcggccatccacagaggcagggctgttttgtgggttctgctggccgcccgg

SEQ ID NO: 34321 - DNA, 64 bp, Chlorella protothecoides
tcccatacccaggtctagccagtgcaggggtgcagcaggcaaccatggattccagtgtccagcc

SEQ ID NO: 34322 - DNA, 580 bp, Chlorella protothecoides
gcgcctcgcgcgcggcggccagccgccgctgctggcgctgggcctcgcgcgcgctgcgggcagggccgcgcacctcgaaggccaggtcggcgtccagcgtggccagcgctgggcccacgcagtccacgccggcggtgagtgccacgcccgtcccggcgcgcagcaggtagctgcccagctcgcggggcaggaccagctgcaggcggcgctggatgaggcccgggatggcggtcttcaggatggcccggatcaggctggcaggcatgggcacgctgttccccaccagccggtgctccaggtgctggacgtcgaagagggggcgctcgtccccgggctgccacccctccgccctgcagaaggatgatgtccaccagggagggtgggggggtggggagcacggcgcctggctgcgacgcgccgtggtgggaatgaagtgcaaagggccgcggcagggtgcctgccgccctgggcatcgacgggcccacctccctccctcccaccggcaagcctcccaatccctgggccactgcctccacgttcccatccacgacctgctgcccgcaggcccccactccctccc

SEQ ID NO: 34323 - DNA, 61 bp, Chlorella protothecoides
cgtcatttaagggctctgcggcttgctaggttgaccactggtctgctgctggccttgtcct

SEQ ID NO: 34324 - DNA, 68 bp, Chlorella protothecoides
cacgttgttgtgtgtgctgttacacgaggcctgcgtgctgccggtgccagggccactgcacgtgaata

SEQ ID NO: 34325 - DNA, 61 bp, Chlorella protothecoides
actatgcgcgggtattgccgtaacaaacatcaaaacgcgcgcgccctgtcactccgaaatg

SEQ ID NO: 34326 - DNA, 61 bp, Chlorella protothecoides
cagcatgcccagcagcaggaccaggttgccactttgggatgtgcacgctgcggtcccgggg

SEQ ID NO: 34327 - DNA, 67 bp, Chlorella protothecoides
tagtatggcatggcatgtttgagagggtgtgtctgtgtgttgcgtcgtgtgagatggagggtgtggg

SEQ ID NO: 34328 - DNA, 61 bp, Chlorella protothecoides
caacgccccttagtatgaggaacgagtctctacggctgtcaggccgctgcgctgatattgg

SEQ ID NO: 34329 - DNA, 151 bp, Chlorella protothecoides
cgccgcgacggtcagcgcccaggactgcaccgcggctgccacggggaagctgccgccgatgagcgtcttctcaaagccggcaaccacgacggggtacttcagctggatccagcggaactggatggagatccagaggcctgtcaggggatca

SEQ ID NO: 34330 - DNA, 133 bp, Chlorella protothecoides
gactcctgggggattgaaagggcagttggacccggggaaccctcgagggcatggcccacgcctcgggctggcacatacatccccgatagtattgccaagctgtctcccacatccgcccatgaccccctcccat

SEQ ID NO: 34331 - DNA, 65 bp, Chlorella protothecoides
ggctctgcctccaggacccggtgggtgggcggctgggaatgggagtctctggtgtcccctgcgac

SEQ ID NO: 34332 - DNA, 61 bp, Chlorella protothecoides
ggcgggttagaccctacaacgtggaccgctatatatgacctaagataggaatgttacagac

SEQ ID NO: 34333 - DNA, 114 bp, Chlorella protothecoides
gatccggaccggctgcgaggctcgcctgcaccatgcggggagcaagagagggcgtgaggggtcagataagcactttccgggtagtcatacaaatgtgcagcttgtgtcgcacct

SEQ ID NO: 34334 - DNA, 164 bp, Chlorella protothecoides
cttcgctgcgcgccggtgtcgctgcagctgtcgctgctgccaccattcctgcgccctcggtgggcccggctctggcgcagcctcctggagcgtacactgcgccgaggtcgggccctgcacccgccgcgtcgcgaccgggcgtgcagccccctagggtcgaggct

SEQ ID NO: 34335 - DNA, 62 bp, Chlorella protothecoides
ccagctggtggacgagtacgccgacctcttcctagcagagctcccgacggagctgccgcccc

SEQ ID NO: 34336 - DNA, 61 bp, Chlorella protothecoides
tatgtcgcagcaagtctttcctggggtaaattagcagtcaaaggaccctcccacaacccct

SEQ ID NO: 34337 - DNA, 61 bp, Chlorella protothecoides
caggtcaaagtggcgggaggggaagacgtgttggcggcggtacacgtcccactccagcttc

SEQ ID NO: 34338 - DNA, 80 bp, Chlorella protothecoides
cgatgcatgcttccaacacaaggtgtataacaattgctggagaactggcagagccaggcaacctggcccaagcttggaac

SEQ ID NO: 34339 - DNA, 66 bp, Chlorella protothecoides
tctgggctgcaacaacttcaaggttggagggttgttacccctttctttttttttgggggggggggg

SEQ ID NO: 34340 - DNA, 74 bp, Chlorella protothecoides
gaactggtgagcaacttggtgtctcaaacagtgtgtgagaagtataaaactcgtggaatattatcgagccaaaa

SEQ ID NO: 34341 - DNA, 61 bp, Chlorella protothecoides
cagcgtgtctgggcgctgaggcatcacctgaccatccacagccacaccgctctgcaggtgc

SEQ ID NO: 34342 - DNA, 64 bp, Chlorella protothecoides
ccacaccacaccagaacagcacacaaccaacccccccccacccaacagccacctcacccgcgga

SEQ ID NO: 34343 - DNA, 100 bp, Chlorella protothecoides
gaccctggataccaagtgtttcaatcaatctcatgcctttgtggcgccaccatttttctagctctataccccagcccgtctgcttgagctccaacggctt

SEQ ID NO: 34344 - DNA, 97 bp, Chlorella protothecoides
gctgtccgagggcggttgagtgaccatcatgtctgcgtggtggggaattgtgaagcgatcgcagtaaatgcctgcctctctcaatgctggccggggg

SEQ ID NO: 34345 - DNA, 73 bp, Chlorella protothecoides
cacacacacacacacacgcacacacaaacccacctgctgctgaagctctgcgccgagctcgcccccgctggcc

SEQ ID NO: 34346 - DNA, 61 bp, Chlorella protothecoides
gaggtgcaggatgcctgctgccccaatgccaatgccgaagaggatcagcaccaggccgcca

SEQ ID NO: 34347 - DNA, 81 bp, Chlorella protothecoides
caatggtaccctgacgcccctgcagccagaggtgcgggagcgcccccatactctccccacgcacatacacaccatcacaac

SEQ ID NO: 34348 - DNA, 70 bp, Chlorella protothecoides
tctcataacaaggacaaaaagccatgtgccatcccttcagcccacctcctcggaacccgttcccactcac

SEQ ID NO: 34349 - DNA, 89 bp, Chlorella protothecoides
ccggccaggccgggtatgcggccgcaaatgggactctagatgccctcgcgcagcgcgcacagcgtgagggcctgcgctggcacagcacg

SEQ ID NO: 34350 - DNA, 70 bp, Chlorella protothecoides
ggatcgtggtggcaaggacctcaaccccgtaaaccaggcgactctcaaagcgcgggagtcagaagacacc

SEQ ID NO: 34351 - DNA, 68 bp, Chlorella protothecoides
atcttcgcaatcggatacccatgccccccccgcccccacccccccccatcgccgacagatcatggcca

SEQ ID NO: 34352 - DNA, 80 bp, Chlorella protothecoides
cattcgggggtgaaggtacccgtgcctgatccccgagactcatcgtactcgatgcagtggccttgcactttgagccgccg

SEQ ID NO: 34353 - DNA, 118 bp, Chlorella protothecoides
ttatgacagtgttctggctgcattcagtattaatctctcctctagcatgcactctttcataagaccctgccccccttgcatcccctctcaggcgtgtgtatgctcaggcgatcacctt

SEQ ID NO: 34354 - DNA, 61 bp, Chlorella protothecoides
ggggacagaggagaggcagagctggctgagagggctgtaacactcccagctgtcggccagt

SEQ ID NO: 34355 - DNA, 100 bp, Chlorella protothecoides
gccttggactccgatcgacgatgtgcacctactgatcagttgctatatgctcctactgcccacccaagtgacagcaggaaccacatgggcgcaagaggat

SEQ ID NO: 34356 - DNA, 61 bp, Chlorella protothecoides
gtaactccatggcatgccaacacctgaccaatgtacgtctcaaggcacagagtccaacctc

SEQ ID NO: 34357 - DNA, 164 bp, Chlorella protothecoides
ggccctgaacctggtgcccaactacctcctcctccaggtgtgtgatgggctcggtgggcggggctcgatgtgaagatcagggcttgtgcattcaggacagggtgttgcccctggagatgctcggggctcggtcatcggtgcccaatgcctcgtcgcacatgccc

SEQ ID NO: 34358 - DNA, 61 bp, Chlorella protothecoides
ttcattccctccagcacatccactggctgggagatgacgatctcaggaccttgaacttcct

SEQ ID NO: 34359 - DNA, 61 bp, Chlorella protothecoides
cagagtctgtcaggctgtttgctggacatgatggtgtggcagctcgtttgatgcaaggcac

SEQ ID NO: 34360 - DNA, 143 bp, Chlorella protothecoides
tctgcctgggtgagggcaggtgttgacccccccctccgagcgcagaggcccttcaaactttgtaccctcacaacctgaatcttgtgcggccctcacagacctgcacccctgacctgactcccctttgaacctgttcagctgta

SEQ ID NO: 34361 - DNA, 77 bp, Chlorella protothecoides
agagagcctgccttcttcatccagcaccccctgtttgctggaaacctgtcacccccgcacatccacagcatcggtcc

SEQ ID NO: 34362 - DNA, 61 bp, Chlorella protothecoides
caaggtcaggaatgacctccagcgtcccgcgcccaccgccgcctcttcctgatgaggcgct

SEQ ID NO: 34363 - DNA, 77 bp, Chlorella protothecoides
caagtcggtcagcatgacgaatctcgtgacctcctccctgtacagcgttgctgcgaagatcctgtgcctacctcgac

SEQ ID NO: 34364 - DNA, 4970 bp, Chlorella protothecoides
  modified_base (2502)..(2511): a, c, t, g, unknown or other
  modified_base (3442)..(3451): a, c, t, g, unknown or other
  modified_base (3983)..(3992): a, c, t, g, unknown or other
  modified_base (4336)..(4345): a, c, t, g, unknown or other
ggcccccgccgccccctccgccccgccgcccgcgccgccggcgatggccagcagggcctggacgtgcagcacgtcgcccgtgccggcataggcgcaggcgcgcagcgtggccagcgtgggctcggccagcgcggggggcagcgtgcgcaccacctccagcgtggcctccaccgcctcgcccgtgcgcaggaagagcaggcccagggccaaggccagcatggtgccgaaggggtgcgccagctctgcctcgccgcgcagcatcagcgcctgcagcgcggcctccaccgcgccgccgtgcgcgcggccggcaaaggccaggccgagacccagggccgcggccaccgtggcctccatgggcgtgtcggggtcggccaccatgggggccagcaggtcggcgacgtcggcgcggccgcgtcccgcgtaggcgacgccaaggcccagcgcggcgccgatgcgtggccaggcctcggcgccgccgacgtactccgacaggattgccagggccgggtcaacctcgtcggccacgccgcaggagagcacgccgatgcccagcagcgcgcccgccacgacgtgcgggtcgttggaatacaggaagcggtcaatggcggggaggccgccctccaggtcccacagcatgaccaggcccagcgaggccgccgcgctcagcttgccatggtccttgttcttgaatacccagtggaccgcgtcgtcctccaccccgggcgtgaccagcttgtctttgccaaagccggcgttcaccagcccgttcacaaaggtggccgacaggttggcacgtgccgagtccaccgcagggccttggggatggagttgtgggggtggaatggcggtcaggaggggcatcttgccttgtagtggggaggactggcaaggatagagcagccggcgaggaccaggacggaaactgactggcacaggctccaccacgatttcccaccaggtagaaaaatgggcagtgacctctctcccgcccgcgttgtcgcccacacagccccaggaacaaccagcccccccctctttcccctgcccacctgtgggcacgcgcccctccaccaggtgcatcttgtacacgtcctcgggcagcttgggctccatgacatccaggtcccgccccaacgcggcatacagctcgggcagcctcgagttgctgggggtggtgaggttgagattaggatttgtcagggcaaactggatgagagttgaagtgtgccgcacagacggccattggtcgtgctcagcgcggcagcggcctgggcacagcgctcccatgccccccccgcgccgcaccccgctcccctcccaccgctgtgcccaaacatgctcagggcatgcttcccgcctcgtaaaaccgctccatcatgttggggttgctccgctccgtcccttttcccccacacgacacacaacacagcacccccctgcaatcacctgtagcaggagaagtagcgctcgcgcagggcctcgtccgccaccgccagcgacccctcctccaggtccgggacgaacccggcgcgccccatgatgtaggccagctggcagcgctcgccgccgtcggcggcggcgcgccaggcggcgcccaccagctccgcgtcgcccagggccaggcccacgcgcagcgcgcccgcgtgccgccccacgcgcatgtgcacggcgtgcacagcgcgcagcgccgcctcgtcctccggctcgggcaggtaggctgcgcaggcctggaggtagcgcgccgcgcgctccgcgttgcccgcgtccacgtggcgcggcaggtccgccacgcggtccacctccagcagcaggtcaatggcgtccggctctgtgtgaaagggggggttgcggggacaggttgacgactgcgcggtaggaaggggcctggaaagggcgcatgggcagggagggggagcggagggcggctgtggccatctgcgcgctgcagggcagcgacggttgtggcatctggctgcagagcaccaggcggggggccgtggcagccaacacacccctccataagaaagcagccacacccacgcaggccccctccccctgcgcaccggcgttgtgggacatgtcgtagggcacgatgaggtccaccagggccagcaggtcgtccacggcctcgcccgccgcgcggcgcgcgcccacctcctccccaatctcccccgacaggtgacgaacgtattcgtgcccccacaccgccacgtcggcccccgccgcgcccgtcagcttgtagcgcaggcaggcgcgggagcccccgggcgcggaggtcatcgccagcgcggacagcacgtccgacagcggcgcggcggcggggtggccggcggggagcgcggcgtgcatggcctccaggggggtgtagtgcggggccaggaacttgagtggcgccggtacagaggtcatcgtgctggtagcagacctgcggtgggggtgggggtgggggcagggtccagtgagatcaacgattggcagaccgctgacgcacggcagtggggnnnnnnnnnngtggcctccaggggggcgtagtgcggggccagaaacttgagtggcgccggcacagaggtcatcgtgctggtggcagacctgcggtggggtggggggggatggggcagggtcctgtgagctcgacgtttggcagaccgctgacgcacggcagtggggccggacccgcctaggtacctgcatgcagcatgcatttgtgtgactggattgatgtaatggcctcaggccacgggcagtgtggcacctctcaccattgatcaccgagcccctccctggcccctagcctccacccccctgcacctgatttccacactcatgccctccaccgcagagcattgtgcgtccgagtctccggtcttaatctgctccacccactgctctagcttctccttcagcgccaagtcctcctcggacagctcctcctcctgcgggcgagtgatcgagggctcgatcagttcatcgaggggtcgaaggacaatgccttgcgccggcctccaaggtggaagatttcgtatgcacgcgcatacaaataataagcgcccccgtctcgcctctggtgcattcttgtccttcttgtttcctgtcttccctttgtccgcctcagccgctaccatggcaccctcggtcccggtgatcacgaacgatcacttttcgaggtccgaacgtatgctcagatgtcggactcaagtttcaggattggagcttacgtgccctggttataatcatgccaggctgcgagaggggtggctcactgatggtaccgcccagtctcccgcatcaccaacaaacacaatctgaccgagaacgcgctgattgcaacatcctgtcgcctagacccaccccaaacttgctctgtgctgctccctgatttggatctgaactgaaagagtatttgctctcctcgctttcggatcaccgaccaggagtgccgggnnnnnnnnnngactgaaagagtatttgctctcattgctttcggatcaccgaccaggagtgccggggagtgatctgccaccatggcggagaaccgtggggagctcgagtgagtcggacggcttttgactcccgaatcctccgatgacgtgttatcattgcgtatcagggtgtacaaatgctgcttcctcacagtcctttgggccccacctctccccgtggccaggctctacaaccagtggtttgtgctggcggacaccgacaaggacggtgtcgtttcagggggtgaggccgtcaagttcttctccaagtcgggcctccccaccaacccgaccctcttcaaggtctggcagtacgtcgcgggggaccgaccctcactgaaccgcagggagttttacaccgccatgaaactcgtctccctggcccaggtacccgaggttttctgtttgtgaagcattggcggtatgacgggggaatagagtcaatctagcacagtcttgagatggcctgactgggcgggtcatctgctagcagacctgctgcgnnnnnnnnnntggtatgacgggggaatagagtcaatctcgcgcagtcttgagatggcctgacttggcgggtcatctgctagcagacctgctgcggttgcacgacgcggtggccttcatgcgggtcggccatcgtgtgtccctgactccattccgtcccatggctcccaagccattctccatcacctgccctcccatcttaactctccctcaaacctccacctccccccctccaccctccctccaattcataaagctgaacggcggcgtgctggacgaccaggccgccctgcgccttgtcaatggcctggccggccctgtcccccccccaaagctgcagggcctggccgtgcccnnnnnnnnnnggtcaatggcttggccggccctgttcctcccccaaagctgcagggcctggccgtgcccaccggcatctcggtcccagcggcgacgggcgccggggtgggctcccccgcccgcgccccgccccccgcgcgcgcgcagtcgcccggggcggccgccggcgccggcttcgtgccattagctccggagcaggtggccgctttctccaccgcctttgcgcagctggacgccgaccgcgacggcgtggtgcagggcgtggactgcttcggcgtcttcatgcgcagcgggctgcccaaggacgcgctgaagcgcatctgggacctggtggcgggggcggcaggacacctctcctcccaccagttcgtgcaggccctgtacctgatcgagcacgtgaaggcggggcgggcgctgcccgaggccctgccctccggccagttcccgcctgtggccgggacgctgaacctgggggcgatgggcggcgagtcccgcggcagcgacatcttccgcgcgggggcgctgggcgagctgccaccccgtgcgacctatgttgcgggtgcggggggcgcggcggcggcggggcccggcgtcgcgatgcccgccggcccggcgcccttcccaccggagcgcctg

SEQ ID NO: 34365 - DNA, 391 bp, Chlorella protothecoides
  modified_base (97)..(292): a, c, t, g, unknown or other
accgggcgatgactgtggcaagtgggtaccccctgccacgcattcgcattctgcctggtcatgctccacaccagggcagtggacggatgtatctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacgggttcaaatagaaggccattattacttggcaaatcaccgcatggctcttggggacacacgcaacggcaggccctcagtgccagaggggggcggc

SEQ ID NO: 34366 - DNA, 188 bp, Chlorella protothecoides
ccagggccatgcctgcgatgggatgaggaaaggacgacgggggtgctggcggctgtggtgcattcggagaccacacgcgaagagtgattggcgccgcaaaaattgtgaaaccagcccaggacatacaggggcaccctctcccaggctggagaataaaatgccatgtgtcatgcagcccacctccatgg

SEQ ID NO: 34367 - DNA, 61 bp, Chlorella protothecoides
caacgatgcctcaccctccttcctcgactcatctccggacacccaggccgccatggaggcg

SEQ ID NO: 34368 - DNA, 61 bp, Chlorella protothecoides
gctgtagtgcgagccctcttttcccggggaccgggcgaggaggtaaaaggggtacgccagc

SEQ ID NO: 34369 - DNA, 61 bp, Chlorella protothecoides
gggcccctggccacagcgggcccggcggagagcttgggccccagcagggctcgggcgcgct

SEQ ID NO: 34370 - DNA, 97 bp, Chlorella protothecoides
ggggtgcggcatcggcgccgccctgctggcacgcagccgtggttaccgaaggagtccctcgcaccgtgacttccccccccacacactgccgtcagtt

SEQ ID NO: 34371 - DNA, 76 bp, Chlorella protothecoides
gccccccaccccaccccactctcccaccccacacccattcgcgtacagtgctatactttgccatcggcagcgtgtt

SEQ ID NO: 34372 - DNA, 1325 bp, Chlorella protothecoides
  modified_base (622)..(631): a, c, t, g, unknown or other
  modified_base (1048)..(1057): a, c, t, g, unknown or other
ggcgggcgggctcggcgacggccgggacggcaggggcgacggtgacaaggagcgggacggcgacgaggacggagtgggagcgccggacgaccacgcgcggcgagaggccgggcgcggcgatggccacgcccctggtcccgacgcgggggtgcaggcagggccgcggccgcggctgggcacgcgcctgtttctggccgattgcctggcggggctgccgctgctggccgcatccgcagatgcccggcatgtcgacccggtcgccgcagccggggcggcgggcagggactggctggtgcagcggctggagcagctggtccacgtcggcttcgtggaagccaccgggcagctggaggtgtgtagggtctggaggggcagggatgtggggtgaaagcggcgcgcaccatgccgtgggttggcatgttcctgccgtcacgccgacgagtgcgcagctttgatggtgatggagctcccccgggcctgctttgcgcgaagagtgctctgattcccgacctcgtcgagatggccagctgggtcccactccctccctcgcaggccctgcggccgccgggcgtggccctgctggtggtggtcgtgcgggtgtttgctggcgtgcgggacccgnnnnnnnnnngggaggggcagggatgtggggtgaaagccgcgcgcacggtgccgtgggttggcacgttcctgccgccacgccgacgagtgcgctgctttgacggtgatgcagctcccctgggcctgctgtgcgcgaagagcgctctgattcccgacctcgtcgagatggccagctgggccccactcccaccctcgcaggccctgcgcccgccgggcgtggccctgctggaggtggtggtgcgggtgtttgctggcgtgcgggacccgctggccgaggggggcgagcccctgcttgggcagtacgaggcccagctcgtgtcggccatcaggtgaccgctcctggctgaaccggtggtttgagttccacgtggagccgccgcggctggtcatgtcatcacgcccggtgatcctcgtgggcagcgcctcnnnnnnnnnncgaaccggtggttgggggttccacgtggagccgtcgcggctggtcatttcatgacgcccggtgatcctcgtgggcagcgcctcctcgagaagaaccccctcccaccaaaggtaccctgagcctccatattcctcgcaggaccagcctggcgccggaggcgggcgccgacctgcgggcggcgggcgcggcgctgggcgccgccttcgtctgtgcgggcctgggcgaccgcgaccccgtggtcctgcgtcgcgtgctgggcatgctgtgc

SEQ ID NO: 34373 - DNA, 61 bp, Chlorella protothecoides
acaggtggaggatgatcgcagtggcagggggctccatgaaacttcacaatcctcgtattgt

SEQ ID NO: 34374 - DNA, 141 bp, Chlorella protothecoides
ttgggcttgaaggggcccgacgggcgacagcggtcatggccaaggtgtgccaactttattctataactcctgcattcgatgcaatattacttcttatattaacggattaccgctattcgcccggtgttgggcatatgcatc

SEQ ID NO: 34375 - DNA, 79 bp, Chlorella protothecoides
ggcagagatgtccgagatgccccgaaccgggctaactatccaaaactacccccctcgtgcagctcaacattgcgtaccc

SEQ ID NO: 34376 - DNA, 96 bp, Chlorella protothecoides
acccgtttgccgatgggcacgtagatggcgtgcctgaaacacctgatgcaccagtacttttagttattcgatgcttagaaagctgtagcgacgctt

SEQ ID NO: 34377 - DNA, 192 bp, Chlorella protothecoides
caaacgtgaagttgttcatgcatccctggcaatagggagccgggagtacagttattgttcaaggggaggggggatcatgagggagccaggttgcaaagcatcagcaatgaagtactaccgggcaaaaaggccaggcgatgccaggcgactcttctcaagctccgccctctccctgtgctctcctgtgcgctc

SEQ ID NO: 34378 - DNA, 111 bp, Chlorella protothecoides
gcttcatgcattctttcacgcagaatggccagcaaagcatcgccaggagcgtcaagcccttcccatccctttgtaggggctgcgtccccaatcatctggtgcagcaccctc

SEQ ID NO: 34379 - DNA, 124 bp, Chlorella protothecoides
cagagggcaatggagtgcatcaggtggcctggagggtgccccggcatgccgtgaggccacctgcacccttgttccattgtccctctcatttttcgtaccccctttcttcccaaggtcatcctgg

SEQ ID NO: 34380 - DNA, 76 bp, Chlorella protothecoides
gccatacttctgagatgatctctcggacaaccttggtatccagaagtccctccactccctccccaccttgctctct

SEQ ID NO: 34381 - DNA, 73 bp, Chlorella protothecoides
tgcaggggcagtgcaggtggtggcttgcctagcagtccgtctacccattcccaccccagacgcatgcgctgcg

SEQ ID NO: 34382 - DNA, 61 bp, Chlorella protothecoides
actgttttgggggcagggttcaagcataaaagcccccagccgcgacacggaaacacaaaat

SEQ ID NO: 34383 - DNA, 233 bp, Chlorella protothecoides
gagagcactgcggcagcagccacatcctgaggtgggaagggggggcgggaggtcagcatgtgttcagcgtcagacccctgtggtgagcggccatgcagagtcatgcagcaggcttaggtatgaggaccttacgatcacctaattcatgtgtcatttttcacctggaaagatatgggcgaggaggggcagttcaagtgcgagagcggagtggggatgtggacctgcctccctgt

SEQ ID NO: 34384 - DNA, 61 bp, Chlorella protothecoides
tcatggtcttcagatcaaccttcgaagctacatgcataccaaccaaccactccggaagcca

SEQ ID NO: 34385 - DNA, 141 bp, Chlorella protothecoides
accctgaggcacctgagctgggaggggagagcagctgcgcggctgccctgaccagcattgcttctggggacgcgaccgagccggcagccatccatggcccagggcaagacgccaggggagccagggcccccagatggcttg

SEQ ID NO: 34386 - DNA, 61 bp, Chlorella protothecoides
gtaagccgggcatcgtgctcctccaggattgtttgatgtgtcggtaagccagtgccaggga

SEQ ID NO: 34387 - DNA, 117 bp, Chlorella protothecoides
agcgcgcccgcgacccagtcggcggcgccggggccggccagcgcggcgtcggccgccgcgtccaggcgcgccgacagcacgaggtgggtgcagccggggcggatggcgccctcgagg

SEQ ID NO: 34388 - DNA, 70 bp, Chlorella protothecoides
agcagatgccgtccgcgacacctgtggggagcaattctggaaacatggtgccatttcagtgacgattgcc

SEQ ID NO: 34389 - DNA, 414 bp, Chlorella protothecoides
  modified_base (143)..(328): a, c, t, g, unknown or other
ccccctccggccccggcctgaccatcaaggtgtctgcccaggactgaggcctgaccctgctccacacccacttcccatacgtgacgctcaaaaccatttcaatctgtaatactacatcgatgacggcacagggtcaggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaggcggcccccttcatccccggcagcccgcccgccgccgcgcccggcagcggtgcgccgcgcgccaggtgctccagcgcgccg

SEQ ID NO: 34390 - DNA, 111 bp, Chlorella protothecoides
ggaggggtggtgggttgggatcatgaatgccagacgaaattgcatgatgcctgggcacccagctgctgccttgactcaccagcctcgcctcatcactccacagcctgggca

SEQ ID NO: 34391 - DNA, 164 bp, Chlorella protothecoides
gggaggtgatttcagtgtgcctggcggtcatcaggaagggagaaggaggcctgcgtcatcccagagcgccctgcaaggcagctgcggggggctttcctggggatgtcctcggaccgccactgcctgggcacaggttcaccaagtccatcacaaggtctgccttc

SEQ ID NO: 34392 - DNA, 61 bp, Chlorella protothecoides
gttcactcatggcaacacgagggtcgctgtggactggtgacctaggaatcaaatgggccgg

SEQ ID NO: 34393 - DNA, 61 bp, Chlorella protothecoides
tgcaccttggtgtggtctgacgattacaagaacaagtctgtcgtctgcaccaccccctcag

SEQ ID NO: 34394 - DNA, 2716 bp, Chlorella protothecoides
  modified_base (279)..(288): a, c, t, g, unknown or other
  modified_base (634)..(643): a, c, t, g, unknown or other
  modified_base (755)..(764): a, c, t, g, unknown or other
  modified_base (1242)..(1251): a, c, t, g, unknown or other
cggggggggccggggtcgcgccgggggaggccggggccacgccgggggcgggggcggccgcgaccccgggcatccaggtcgtcgtgctcgggtctggagaggtgaggcggctggcggcaacgggctctgcgggggcggttgcccgcccagctgcaggagcagcgcgccctctggccatggtcagcgctgcatcctggagacaacatcccttggccacctcttgaaccccccaccccctccaccacaccacatcctgcaggcctggatggaggccgcacnnnnnnnnnnctcagcgctgcaacctggagacaacagcccttggccacctcttaaaacccccacccccttcaccacacaacatcctgcaggcctggatggaggccgcactggagggcctggaactgtccttcccgggtcaggccgccgggctgccgctcttctcagaggagctggcgcactggctgatggccggctccgacttcgtgctcatcccctcccgcttcgagccctgcggcctggtggcgccctgcgccatgcggtacggcaccgtcccgctggtggcagccacgggggggctgcaggacatggtggacgccaaggtgcgcggggggggggggggggcgggggggggggnnnnnnnnnncctgcaggacatggtggacgccaaggtgcgcagggggaggcgtgcagagtggtgagagtagagtgtagctgctgctttgcctgggccttgcatcgcttgcatggaccccagnnnnnnnnnngtggtgagagtagggtgtagctgctgctttgcatgggccttgcatcgcttgcatggaccccagaggaatggggagatgatgccgacgatgaacggccaacactgtacgagacatgctgatccatgcttgcacgcggaactccttcgcaggtcgggtacacggtgccgaggctgggcagcgagacgtcggccgtggatgtccggcaggacgtcctgcacctcatccaggccatgcgccgggccgctgcgacatgcggcacgccggcgcacgaggccttgcaggccgagggcatggcccgggacgtgtcgtgggcggtgcctgccgcggagtgggaggcctggttggcgagcctgtgacgccgagcgtgttgtgccggcgacagtgcgcgcccgccgaggaggtgcggaagccccgaccctactgtccccccccggctcccaaccggcctgtccggtgcgcgatctgagagctgcggggnnnnnnnnnnccgcccgccgaggaggtgcggaagcccagaccctactgtccccctctcgcgcccaaccggcgtgtccggtgcgcgatctgagagctgcggggcccttcatgtttcacataaattgtcctcctgctccacattgaaatttcgacacggtctgcgcaaggcattgggtggagatcttcgcagtctgcgcacaggggccgtgtccggtcgactccgtaccggttgggacaggtttcggtgtgggggcagcttcttgttaaaccctgatgcggatagcccgctgtcacatctcggtaaaccctgaccagctgctgggtcaacttctggccatcttggagctcagctcatcccagcgaccgccggacagtgcgccatcttccctcgcgcatctccgcaaacccggcgcgtggcccaccacagccaggccacctccctccgcctgcgcctgaccagctcgcaggctgacgcgcggttgcgtcgtgccgcacaaccccctgcgcagctgccgagccctccccagaagcatccctcgcgcacccagaaggacccccccatccctcaaataaattccgaggtgtgtagtcttaccccgggctggacttgtcccgcccaattcaccctcatgacgcgctgaccttgtacggggatactaacgcggttaggtgtgcgtgggtggtcgctcagggccctgagccccctgtcccccaacccacaggattccctccgatggcgtccagcgtctttctgccccagggctccctgctgggcccccccccctgcttacagagctcccacagctccgccttccgcgcctacggcggcgcgcgggaggtggcggacctgcgggacagccccctgttcctggccgccaagcaggccctggccgccacgcaggcggaggccgccgcggcggccctgccctacgccgccccggccctggcccccgacaccaccgccgtcgcggctaccggccccgactccggcgccagctcgggcctgaccgaggcactggccgcggggttgcaggaggtggcgcaggccggcgcgccgcgcgtggcgggcgtgaagctgcccgtcacctgcaacgacgtgcgcggcctggtgttcctggaccagcaggtggtctcctgcttctgccccgcctgcgacgcgcgcgtggcgggcgggcacgaccgcccgctcttctccttcacccgctttgagcgccactctgggtccaaggccaagaagtggcggctgtccctgcgcatcgacccgggggcggtgccggagtgccccccaggcgacgcgcccatgcccatcggccagtggctggacgcgcggggggtgatggcctggagcgcgcgtgcccccacccgcgtcggccccggcgactccgagtccgactcgggcacgcacggcggcggcggcgcgccggcgcgctacctccgccacgccgcggtcacgcccctgggcgaggccggctggg

SEQ ID NO: 34395 - DNA, 114 bp, Chlorella protothecoides
agcatggcctgagattgggctacctggaaatgggggaatgtggggaagtggcacgagggtgggaggggggtggggctgtggaattaggcaggcccctccaaacccttcacaagg

SEQ ID NO: 34396 - DNA, 61 bp, Chlorella protothecoides
attcaggaccatggtgaactatagcatctggctggcgtggatgagctgggtaagggtctgc

SEQ ID NO: 34397 - DNA, 61 bp, Chlorella protothecoides
caccggatgtcgctcctagcggcggcgaggatgatccagacttgcaccgcgcacgcctacc

SEQ ID NO: 34398 - DNA, 93 bp, Chlorella protothecoides
agccgatgttcgtatggagctctcatcgtgattgaatatgttgtacatcatcgtacctgacgaacggccgctctattgaggctgcgatgctgg

SEQ ID NO: 34399 - DNA, 78 bp, Chlorella protothecoides
catgcacggatccctcttcctggacgatcggttgcagtgttgctcagccctctccaccatgtccctggcgtagcattt

SEQ ID NO: 34400 - DNA, 65 bp, Chlorella protothecoides
agagccatgggtgtacgaattcaccgccgcccatagcggctccatcagcgccgagcacgggctgg

SEQ ID NO: 34401 - DNA, 75 bp, Chlorella protothecoides
tgctgcgccttcttcttcatctccttcttcatcgtctccttctttgtcttcttcttcggaagatcccggaagccg

SEQ ID NO: 34402 - DNA, 2711 bp, Chlorella protothecoides
  modified_base (1031)..(1040): a, c, t, g, unknown or other
  modified_base (1526)..(1535): a, c, t, g, unknown or other
  modified_base (2010)..(2019): a, c, t, g, unknown or other
  modified_base (2410)..(2419): a, c, t, g, unknown or other
ctgacgccggcgcgggcgcaggcgcggacgccggcgcaggcgcggacgccggcgcggccgcggggccagactgggccgtcgactggccccagggcgaggaaccaaaggccgacgcggaggcgggggcctccggcacggagtagctggaggcggtcgacgtgccccaggcgctgggcacgctgggcgcgggcgggcccggagccacgctgctggaggtgaggatggcgcggtccatcggcggcgtgggcgcgggctcggggggcggcggctggaccaccgtcagctccttgatctccgatcctgtgggggttgcgcgatatggttggccggtcagacaccctgcgcatgcaagcagatcgaccacgagggtgtgaatgagggaactggggcctgcgatgcagagatcgcagggacaacggtgcctgcgagaagcaagccgccagctgtgtacagaacagacccgtggctgccttggtttcacccccaccttaggtccctaaatgcacccgccgtaccgttgaacactacatacgcatacacttcgtcggtgccctccacctgaggtcccgggtctcggcggccttccgagccataacagcggactgcaagccgggtagggggggtgcgcaaccatgctgagggccgtgcaccaggtacgcacccccaccaggcacacaccatgcggaaacaagtcctccgagaagcggagccatgccaacacgcagcctggctgcccgtcctcaccgttcacgagtgtgatgcgggagttggccatgtccacatggttcaggactccctgataccggacatcgcccgagctcacgaggctcatgacgcttcccacctgggaggggcatggtgtgaatgcaatccctaggagcacggtcgtgtgggtgcgccagcatggccacttccggtcggcccagcacgcagagagcacgcccaggcccgatgctgggtgcacagcacaccgccgtccatccaatgagagtgttggaatgggaatgcccttccacggcatgcgatccttnnnnnnnnnnacgtccatccaatgagagtgtcggaacgggaatgcccttccacggcatgcgatccttgcactcggccactccatcactgctccgcttgggccactcacatagggaagtccatccgcctccgacatctcaagctcctctgtacctcctgttgcgtctcctcgtttgggtggtgcaaggagggaggctctaacctccaggcatgacatgtacaggtctagggaagaccggatcggtagttccgtacatttgaacggtaccggccagaggaaggagcctgcctgagccaagcttcacatgcccatgtacgcgccagggtggtaagaacctcacatttcgcatttcacaagcggtgcatgtgcactcccagctgccgcgtgattgccttcatgatccattgagtctcctcagcccgggtggctcagcacgcccacaggctggcgtttattgcaagccgacttccctcggcagcaggctgccagccacacnnnnnnnnnngaccacgccctcaggctggcgtttattgcaagccgtcttccctcggcagcaggctgccagccacactacgccacgtctgcaccaggcacagtgtcccactgctgcatgctgtgagtcacatagccgccgtggcatgcaggcaccgctcctccagctcctgcatgcttccgacggccatggcctcaaagcggtgctggaagcgctgcggcatgcccgcatgcggcaggccctgccccttgaactcccgccagttgaagggtgggaggtcgtggccctctgtggggccgttgacagcaaaagcctccatctgcgggacggaggcaaggggtggatggtgactctggcggggtgtggggtgaggcagcgcccaccaccctgaacacccacactttgaggcgatggccagtctcccaggcaagacgtcatcacggttcatatccataggaagtccggttgaaggggcgtcgccgtctcnnnnnnnnnnatctcccaggcaagacgtcatgacgattcatatccataagaagtccggttgaaggggcgtcgccgtctctcagaggccccgccacccccccctgggcatgaccctgcagggccaatcacccgcgtcacccgccaacccaccctgcgcgcatgcgatgcagaggtgaccttggtgtcatagcagccgcgcgacaggggaccgtccgggatcaagtcgccccgcccgcacaccgcgcacagcgggtggccctccgacagctgcgtcggggggggcgacacgtaaggcggatgatccaggcaggcggcgctggctggtgcggcctctcggatcagatgccgcccatggacctgcaggcccccaagcaggcaggcgcgccgcatggatccccacnnnnnnnnnnacgcggacccgcaggcccccgagcaggcaggcgcgccgcatggatccccactcgccaccgtacaaacgccatgccccggcccccgccaccacctcctgctgctgcacagaccaagcaccagccgccatcacagccgaccccagctcaccgggtcgtgctgccagttgttggagcgcatcagcccggccatgctgcgcacgctgtgcacgttggcctggtcgcgcctgaagatcttggcccgtggactggtctcgtaggacagccagtgcgtgacctgttgggagtcgggggg

SEQ ID NO: 34403 - DNA, 82 bp, Chlorella protothecoides
ctcatacacctccgagccaggccggcaaaactcaatcacgtcctgcgtgcctgcgggcgggggggggggggggggggggggg

SEQ ID NO: 34404 - DNA, 116 bp, Chlorella protothecoides
gcccccccccccccccccccccacaataaaaaaacccaccatcactcccctgcagaatctcccactcctcatggcgaggcagctgggcgccagctcggatggcttcgtgcggctgg

SEQ ID NO: 34405 - DNA, 145 bp, Chlorella protothecoides
gggaggggagggaaggggttggcatcgaggcgacctcaccaggtgaccccaggatgcgggattgtgtcgcgggccacacagtgccctgtgctcccggcttaccaatgatgcacagggtgatgattaccagatagaagagccacag

SEQ ID NO: 34406 - DNA, 61 bp, Chlorella protothecoides
cgcctccctactgctgcaggcatggcagggcgtgaatatgctcggggttgataggggaatt

SEQ ID NO: 34407 - DNA, 95 bp, Chlorella protothecoides
tcacaacccccttatcttccctttccatccccgccccccaaacccttcccagcactattgtcccccctcgccacaggcatgtggagcgcgctgtc

SEQ ID NO: 34408 - DNA, 61 bp, Chlorella protothecoides
ggtggtggtggacgctgaggcaggggagggtgaggtggagggggacagcggcgcgcaggtg

SEQ ID NO: 34409 - DNA, 131 bp, Chlorella protothecoides
ttgggagggacatggcggtggggggtgagaggggcctggagggaaaggcgtggacagcggggcgaaagcagggcatgggggaaaacatttctcaagatgaagagatgaaagcctcagacccacgctgaccc

SEQ ID NO: 34410 - DNA, 79 bp, Chlorella protothecoides
cgaggaccaggaggaggacagggggacacgaatggggcaactcgaggcagcgctgggccaggccggcgcacgactccgg

SEQ ID NO: 34411 - DNA, 69 bp, Chlorella protothecoides
ccctcgccgaccctctcccatcattctgtgattggcagggctccagccctgtggccgcccaacacaggg

SEQ ID NO: 34412 - DNA, 61 bp, Chlorella protothecoides
tgccaggggtcacacccttcatcagatgcttccccagccgctaggatgcaacactccccac

SEQ ID NO: 34413 - DNA, 124 bp, Chlorella protothecoides
ggtgtgtcggaggagggtgcgggtggtggaggtggccacatgaggccttgtgtggggggggtcggtgtgtgatgcagtggcacacagagtgtggggctaggggcaggggatcaggcaccagcgc

SEQ ID NO: 34414 - DNA, 107 bp, Chlorella protothecoides
gctctgcaatcctgagcaggccctgcctcctggaggtcgtgaccctgaacccagccgctctccccacgcatcacactttcactcacacaggaggactggaggaaggc

SEQ ID NO: 34415 - DNA, 76 bp, Chlorella protothecoides
ccgggagcatgaagtgggttcttgggcgaacagggccttgggactcgtccatttgctcatttctcaaaccaggaag

SEQ ID NO: 34416 - DNA, 440 bp, Chlorella protothecoides
  modified_base (156)..(323): a, c, t, g, unknown or other
gcccccgccacagcgggcggcgtcaacccggcggctccagcgctggcgccgggcgcgggcgacgcgccgcctgacgtggtggacggcgtgggcgcgctgcagggcgcggagctgttggtggagtcgctgggcgacgtggagcgccgcatccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcgcgcctgggacgacacgcgcgcggcgcgcaacagcgtggccagcacctgcggccacgaccccgccttcgtgcgcgtggggcccggccgcttcgccctgcgcgccctggtccc

SEQ ID NO: 34417 - DNA, 442 bp, Chlorella protothecoides
  modified_base (174)..(343): a, c, t, g, unknown or other
tacgatgaggaagggcatgcgctctctgcatcacgcacgccaacaggcgctgtgcagcttgaaacacctctgccagccagtctccatcactgccatctgttgaaccacccacactcaccgagcaggcaggtctgcagcgcagggtacgccctgcggtttgccttccaggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcatgaaatatgaatggtatcgtctctgccagccatcgctcaaccccccaaaacacctccgacaacccccagcccgccacccacctgggtggaata

SEQ ID NO: 34418 - DNA, 112 bp, Chlorella protothecoides
gtggcatgaatgacacatgaggaatgatccatgacttgccggcctgcacaacccgagaaccaaaccagcccctcccggcacataccttatcatagtagcccacatcccagcc

SEQ ID NO: 34419 - DNA, 76 bp, Chlorella protothecoides
ctcctggaaggagcccttgcccacctcgcccgtctcgcaggacccggacagcagcacaaggggccaggtgttgacc

SEQ ID NO: 34420 - DNA, 85 bp, Chlorella protothecoides
tgcatccctgcagcacacacgattgagaagcagcccgcacgctgaacggactccatccccttgccctatcccagcgcaccttgtt

SEQ ID NO: 34421 - DNA, 61 bp, Chlorella protothecoides
tcctatcttggggcatcgcagtggctgccctgggcactttcaaaggtgccctgctcatctc

SEQ ID NO: 34422 - DNA, 131 bp, Chlorella protothecoides
cagcctggcaggacggtgggtaggtgttggctaatttggtattgtgatggttttgggttggggggggggtgctcaggggatggggcgtgctcaggggatgagggcgagctccagggactctgcctgcacag

SEQ ID NO: 34423 - DNA, 76 bp, Chlorella protothecoides
cgagagcttggcgccccgcgacccgccgcccagcccgaaccacccgccgccgccgccgccggccagctgcgagacc

SEQ ID NO: 34424 - DNA, 64 bp, Chlorella protothecoides
tggcggtggcgacttcttggcgggtggcggcggcgacttcttgacgggtggcggcgggaagcta

SEQ ID NO: 34425 - DNA, 61 bp, Chlorella protothecoides
gccagatacctcctctgggccagacatgccatcgctgctggtgtcgctggcgttctccggg

SEQ ID NO: 34426 - DNA, 11422 bp, Chlorella protothecoides
  modified_base (708)..(717): a, c, t, g, unknown or other
  modified_base (4883)..(4892): a, c, t, g, unknown or other
  modified_base (5600)..(5609): a, c, t, g, unknown or other
  modified_base (6069)..(6078): a, c, t, g, unknown or other
  modified_base (6270)..(6279): a, c, t, g, unknown or other
  modified_base (6492)..(6501): a, c, t, g, unknown or other
  modified_base (7191)..(7287): a, c, t, g, unknown or other
  modified_base (7558)..(7567): a, c, t, g, unknown or other
  modified_base (7681)..(7690): a, c, t, g, unknown or other
  modified_base (7876)..(7885): a, c, t, g, unknown or other
  modified_base (8036)..(8045): a, c, t, g, unknown or other
  modified_base (9674)..(9683): a, c, t, g, unknown or other
  modified_base (10272)..(10281): a, c, t, g, unknown or other
  modified_base (11015)..(11024): a, c, t, g, unknown or other
gcgccgtggcgtcgacgcgccgagcgctgccgggtcatgaccgcgggccgccggcggcgagcccgcgtgggctgctggccccgcccccgcctgctcggcgcccaggagggcgtccagcgcggcgcggtagcgctgcatgtggcgctgcacacattccagctccaggacctgggcgacggacgggcgcgcggtgggtgagcgacgcagcaacgctgccgtcagggccaccaggtcgggggagtaccggctcggcaggggcgcgggctgggcgcgcaggatcttgacggcaatggccgacaccgactgaccctggaagggccgggccagggtggccagctcgtacaggacgcagcccgcagcccagacgtcgctcttggcgccgtaggccgagtcctgaacggcctcgggggagaggtagtacggcgtgcccaccatggtccgcgccagaccgccgccgcccgccacctcgcggctcagcccaaagtcgcccagcttcactatgccgccgcgggagaggaagatgttgttgggcttgatgtcacggtgcaggatgtcctggaggagaggggggggaggagggggggacgagggaatggtgctcacatcttttggggggacttctggggttgggtattatgggactgatggtctgggaggtaaataccgcagactcgtgacgcaaatgagagcattccagctggtatttgnnnnnnnnnngctgatggtctgggaggtaaatattgcagactcgcggcgcaaatgagagcattccagctggtatttgcatggcataacgatcagatcgcctcgcccatcgccccccacctgggcatgcacgtgctgcagggccaggcacagctgcacgaagatgagcatgatgtcatcctcgtccagcagctccccctgtcgcgccctgatgaaggcctccaggtctccaccctggatggagtgggtgcgggaaggggactcggggtcgtccgacctcatgctcgcgctgcattacaaaaccatgcggcaaacaatacagcaggcctgagcctggggtccacttccccctacctacctcgcagtattccatgacgatgtgctgggtgggcccggtccagaagcactcgtgatatgccacgatgttaggatggtctagcctgcgcagcacccgcacctcatcccgagtctgggggcgggcagggggcatggatgcggaagcaggaggcaaggagttgcaggatgctctgacccagagcaggtattgccaacctagcgtcgcatctgcactgtcgtggctctgcctgattgccgggccgaaccgcctcagcgatggctcgggtcactccatcgccatcatgcccacaaggcaatcctccaacccgttgctgccatctaccatcaagcttttcaacacacacacacgcacaccactcaccgcctgttgctggcgccagcccatgctgccggtgtggagctgcttgatgcagaccgccgcgccatcgccgcggcgcagtgcccgccaggcggtgccaaatgcgccggaccccacctcctccaggagctcgtaggccgccaagcggtgggaggtgcttccccgcccgctctccgggctgcccaagatcagctcggcggctgtgtgtgcgctggaggggctggggagcaggctgcggtccgggccgccgctctcacccctgcttggcgggtgggcggccacgtcctccgccagcagctgccaggcagtcaggctgcccagggagcgctcgttcccaattacctcctcgtgagccgacgcgaggggggcggtcttggggtgggacaccccccgcactggcaggcccgctttctgatgggcgggggcctccgtgagcggggcaaccgcggcagcctcgctggtggtccgcgatgctctgctgccgcagcaggccggtacccacatttagtgagagtgttatggtatgtttgagcggccgaggagcctcccaacgccaggcatctggcatcaagcagtcccggccaccgggaaggtcaaccccgagcccaggtttcgggccatgcgacaagacgcttgcatgtcagggtgtttcaagagagctttgtagtgggtttcaggtgtcgatgtgtcgcaagaagtctcgacctcccgatcatggccagctttcgctctgaattcgaaccgccagacacgcgagttctcgcgccctcgaccgggcacactcgcgcacacactccctcccatgcatggatgcgatatatatcaagccatggtgcgaaagaagcgtaaagtaatcgtacaatcactgaaattcactgaagcatctggctgaaaattctcaaatcggcgagctgcagaagacaaagtggtggccaccctgccggccctgctcgcgaattgtgacatgcggctgacatccttatagccgtgctcctgcagacagaagcgatatgctggggggcaggggacgagggggtgggcgtggatggcgcagtggaccccctcaagccccgggcatggtcgacgacagtggccagcccatagttctgggacctccacccatgttcccggtgagtttctttgtgtcggtaggaacacttgaccagcccccttacactgtgaagatggctgggtctctcatccccctgcgagtccacaggagatggacttgcccgaggtgccagaaggtgtctccaccgtcaccgagcggtgcctggtgaggcggcacagctcatgcgggccagtactgggtgtgccagggctatgcccattatttttaagatgtttgcaggagtgcagagtggctggcgccctcatgcctgcctttgatcaggagcactcccgcattcggcccgacacaccaccctgcacatgccccccctgcagctgcggcggcatgagctgcagcacgcctggcgcaactcctgcttccacctgacccccgcggcgtttgaggcggcaggaaagaaaggcactggccccacgcccatgcaggagctgacccagatcctcaccttggatccccgctacttcccccaggagctctttggagccaaagatacaaagtaggtaacacctgcaactgtgggtcgctccaatccaaggccttgccatggagggcacggccactgggcttcagacatgcagcaggcctgctgcccagcattggtgttgcctccctctttgagggtccctcctcgtctccgccatacacagggccagccggggcaaccaagccggcatgtgggctgccgccgccgcccggagacagagaggggaggtggatgagctgggggccctggaggccctggcggccgctgagtcacgatccagagtggccggcggggacgtcgccaatggggtccgaccgtgagtggggtggctgcatgccgagggaggatggagggtttgcttgcaccctgcacccctgacctccaggatcctgactcgcagttccctgccctcctgcccaaaccaactgatggcacccctcgttcaccacctgccctcgcgatgctttccagggccgaggacggcgaggacgaggcggaggcagccatcgacgaggaagacgaggatgtcggcgaggaggaggacgattactatgtggtgagagggggtgcggttccatgctttcctgcggggctgccctgcgacgcagagtgcctgaactcatcccaccctctgcctccttccctcagaacgagcgttttgacgatgacgatggctacgatgacgactttgatgacggcggcggggacgacgccatctactgatggcctggcatgtacggcatggcattcctgctcatctttcgtgatgagcagcgtgatcacatgcggtgcgctgcaccttgcatgacgctctgctcaaggatccagccaagacctcagaagatcctgcagcttgcactgatgttctccacacccccttgctgccaatgccatcacctcatcctcccagggaggtattgctggacagtacgctcaaacaaggaagacaaagcatgccccagtcccatcagctaactcctgcggcagcgccggccgtgcgaccctcatgccaggcccagcgcccgcatggcaaaggcctgcagcagggccgccagctccagccgctgcgactcgtgcgcagcgtgcccagcgtgcaggtcgggcgcgacaaggatgggcgcaggcccctggttcatggcccgggccctggcagcccatttcagggggccccacaccggcacccgggtgtcggtgctcgaggcggtgatgagggtgggagggaaggcgccccccctcaggccctggtacgggcaggccgtctgcacctgcttgacgaatggggagggtggtggcggggaggatggtttggggaggggtggaggaaaatggggttggtgggttggggcgagccgccaccaggcacgtcccactgagactgcgtctggctgaggacccctcatcgaagcaggctcagcgcacgcgcccgaccaacaaccaccccccctcgccgcgcctgcaggaagccggcggtggagtgcgggtcgccccactcctcgtactcgtgcaccgtcagcgccaggtcaggcctgcactgcacggtcagcacgtcgaggaagggcgcctccaggaccagggcccccaccgccccggggtcgcgctgcaccagccccgcggcgaccacgccccccgcgctgtgcgcgctgagaacgatgcggtcgtagctggtgtaccctgcgtgggagtgcgagggggggaacggtgggcgcgagcggcgtgcaggtggtggcgcggtcccagaaaccagaaggaaggccggctgaggtgacgctgtccaggtgtacacgcgtatgaaccagtgcacgactgtcacccaaaccctcccccccgagcttgtcacacccactggctcnnnnnnnnnnaaaggccggctggggtgccgctgtccaggtgtacacgcgtgtgaaccagtgcacgactgtcacccagaccctccccccccgagcttgtcacacccactggctctgaaggaccactccccctccgagcccacctcgctccaccagcgcgtcgatgcaggccgccaaatcatcgacgcgggcctgcaagccgtgcacaccgcggccggccgcgtgccaggccctgcccagctccccgcccccgcgcacgtgcgcgccggcgagcacccagccggcctgcagcagcgccgcgcgctccggcgcccagtcgcagggcaggcagcgcccgtacgcgccgtacacctccacccaggcaggcgcgccgccggcgggggggttggggccggcgtgagagatggtcagcggcaccagcgtgccgtcggatgatcgtccatgtgtgcgcagggttcccacggctgcgctgggactctccccgctcagcgtgcgcagcgcgccggcgtccaggtccacgtccgccgccacgggcacacgcccaggggaggaaagcgtgacgcggaggctggccgcctcaaagtccgcgttggcgccggggtccagggcggtggcccaggcggggaggggcacggggacgagttggggcggggccccggtcgccctttccagtttgagcagggccaagagggggaggccggtggccgcgtcacgagcaannnnnnnnnntgcacggggaggggggggggcggggccccggtcgccgtttccagtttgagcagggccaggcgggggaggccggtggccgcgtcacgagcatacacggccagacatcgccggaaggcgtcaaagtcctccagtaccagcccctgcgtccccgcggggagcacacactcccagcgctcgggtgggggagatggggaggatgattccgccgggatcctgcatggaactcagccagggtgtcacagggatgagcatcggaaggagagggcagcgtgctcagcgcaggagcatccgagacattgtggaggccctaccccacggccactgtgtgatgtgcagagaaaccctcgtgtgaagtcgaagctcagccgccctagccatgccgcaggtcacttgtcatggcccagaaaccaagcccgactcccacaaacatcgctcggactcaccggaagagggagtactnnnnnnnnnnacgtgctcggcgcaggagcatccgagacatggtggaggccctatcccacggccactgtgtgatgtgcagagaaaccctcaggtgaagtcgaagctcagccgcccagccatgccgcaggtcactggtcatggcccagaaaccaaacccgactcccacaaacgtcgctcggactcaccggaagagggagtactnnnnnnnnnnatccaccctctccaccctggggggtgggcagggagtgtgcacctcacgccgggctgctcggttgccttccccacatgaccctcagaatcgcatctggctgggcttgctcagcgagcaccccccaaccgagagcatgccaacaaacacatgtgcccttccaaatggaaaatgtcacagtcagggcgcggttctactctacctgctgggccgacnnnnnnnnnngaccgtccccccgctgcgcgttgctcagcatgtagaagtacccgtcggcatgctccacaaagtactccagccccggcgagcgtgggtggaccaggcggaggctccctggtccctccccggcctcccagtccagtactcggacctcgctgctgcgcttggcgttgctgctcaccaccaggtacctccagtccttggtcttgccgatgtccagccagaaggcagcatccagctcctcgcagatgcactcaggcctggcgtgctcaggcgctgaaacgtccaccctctccaccctgggcggtgggcagggagtgtgcacctcgcgccgggctgctcggttgccttccccatatgaccctcagaaccgcatctggctggacttgctcagcgagcaccccccaacctagagcatgccaacaaacacatgtgccattccaactggaaaatgtcatagtcagtgcgcggttctactctacctgctgggccgacccagcccgtctgcacgggtgcagtacaggtggctgccgtcatggctccactcgatgctgacgctgccctccagctggggcagcctggtgccgaggcctgcactgcctatccgctgcacatgaacctgcagccgctcgctcccatccccggggtccacagtgtatgcgatgctgctgccatccctggacagcttcatctgcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaccccatccctgcgtccttgatcactttgtcccagcatgaccccatctgccctgcctggatcaaggagcacaggtccccatactctgtggccaggacgccttcatccagcagaacttcgacactcccaccggcccttgcgcggcgcaggtaacggcggtgaggggcctctgcactctgctcggtcaagtattcatggccacccacactctccggctctgtggcctggacatgggtacagggtaaacaggtgcagtctttgcacacgagnnnnnnnnnntggggatgcacaagcacggaccagtgagcgatgctttctggtcccctgccgggttgcttgtcttctcaaggaaacaggatcgccctctggtgttagcaggcgccctgtagcgannnnnnnnnncggggatgcacaagcacggaccggtgagcgatgctttctggtcccctgccgagttgctttgccttctcaaggaaacaggatcgtcctctggtgttagcaggcgccctgtagcgaccgcgatacaccccatccctgcgcccttgatcactctgtctcagcatgaccccatctgccctgcctggatcnnnnnnnnnncgcttccagccacctgataataatgtttatagtattgtagaccaaacatatcccccattcatcattgcacaatgcacagagcctcgttggcatcccccaagccatgtcggtctccatcagacctgaactcgtcttgccaggtgtgtccatnnnnnnnnnngcctccggctctgtggcctggacaggggtacaggggtaaacaggtgcagtctttgcacacgagtatatgatgcacagggcagctcacagattcaagccccatacctgctggtctggtagctgcgccagcatgctctcgagcaggctcgcctgcaggaactctgtcccttccatgtaatgccggaaagccgccgcctcatcatccagaacacgctgcacccgctttccgcctgcttccagccacctgataataatgcttatagtattgtagagcaaacatatcccccaatcatcattgcacattgcacagagcctcgttggcatcccctgagccatgtcgatctccatcacacctgaactcgtcttgccaggtgtgtccatgagcactcctcactgaaggtctgggcctgatccagggctgttcggtatgaacccctcgacacaatttaccagaggctgtgcctgactgtggctggtcaggggcgagcaaaagagggaggcaagtgagggtgtgggacagacctccacccaggcctagcctgggaaggcgcagaactgcgccaagtcctcgcatcactacatgaccagcaacctgaagctagaaaaagtataataatgaacaaattcgcatactgcgtcgatgtagatgtcatgcaggtggtggcccctacttgcttggcgatgggccgatcgatcgcgggcgccacgacatatcaattgttacgaagacgaacacttgcagcaagcacctcctcgctcttatcgcacagtgatcagttgcggataatcggcttatagacagcacgactgaacatatctcattagcccgggcgtcaacgcctgtgttttgttccggtacctcactcgatgtctgagctccgatagctggtgggatgcaggcagcggccggggttgctggccccccctcctcagcacctaccacgaatggatcatctgcagcagcagatgatagtgcaccctcccctgtgactgctcaagggcccatgccgtctctccaggcggtcccggtgagcagggaccattctgatataagaaggcactcccgggtgcaccggccatcggtcgcatctcttcacccgcactccttccctgtatcctccgcagtccatcaccaagcagcagcagagcgcccttgctgcgcaccaggccaagatggtggcagcacgcaaggccctcggcgcccctctccgctccgccaacctctcgcagcggctctctaccgacctgggcaagaagggcctgcccatgaagaagaggcggccaggggacacccgcctcccagagaaggcgagtcgtgcctgcccatcctgggggatggcgtttggcatgctcttgatttggcgctcactggctgtacagagtggcccaccgtgtcagcctgccttcaccgaagtgtgcttgccccaaataatttcccttgggggattcatgaaaaggcccagggtctccgatgcctgcagggcgggcttggacatcctcacgcctctccccacaccttcacaaacatgtccccccctgttcacccctcaccccccccgccaccgcccgccaggtgcgtgtgctcgtcccctccagcgcgctgctctgcgacctgcaggcggcggagcgnnnnnnnnnntcacaccttcacagaaatgaccccccttgttcacccctcacccccacgccaccgcccgccaggtgcgcgtcctcgtcccctccagcgtgctgctctgcgacctgcaggcggcggagcggcgcgtggacgcgctgctggcgaggaagcgcggcgagctgcaggacatgcacgccagcttccggcgaggcgcgcccggcaccgcgcaggcggccggcacgctgcgcaagaagctgcgagtgtacgtcttcaccgagcacgcccaccagggcgccgaacccggccccgacccgccctcctgggcgctgcacatccagggtcggctgctgagcgacggggggcccgccggcgccggcgcggcggggacggcggagcctggccccgccaccgcctcccagggccgcctgcccttcacccactacatccgcaagctcacggtgcggagttggtttgtatggcaaggggggggatggtctggaaaagggagccacatcccccaggcacggggctggaggagctgcgggcaggcccatgctgtgtggcgcccgcctcgctccccctgattgtgccatcttgtctgctctcctgactnnnnnnnnnnatgtgtggcaagtggggcgatggtctggagaagggagccacatcccccaggcacggggctggaggaactgtgggcaggcccatgctgagtggcgcatgcctcgctccccccgattgtgccatcttgtctgctctcctgactcaggaatgtcttcccctcccccctcctccctcactcacaccaaatgagagagcctccccgcccccccttcctctccctccacaccaggtccagctggacccggagcagtaccccgggtcgagcggtaccattgtctgggagcgggcgcgacacgacctggaggagcgcgagtcgttcatcgtgcggcgcgcgggtcggctgcctgcccgcgccacggtcagcctggagcttgaccacaacccgcagctgtacctgccctcccccgcgctggcctccctgctgggcctccagggcctgcactccctgccctttgtcctgcagatgctgtggggctacatcaagcaacacaacctgtttgaggtgaggatgtccgtgagtaggggggtgttttctttttgtgaggggggcgggggggatgggtggagagcggttggacgggaatgcgggggcaaggagaaccgcctgggcttgcattaaccgaccagacagaacaccctgccggataagaaggtaccaaactccttccactcgcaaacccacccaccccactctgcatcctccaccgcagtcttccccggccgcgcctctgatcnnnnnnnnnntgcctgggcttgcgttcgctgaccagacagaacaccctgccggatgagagggtcccaaactgcttccactcccaaacccacccaccccactctgcaccctcccccgcagtcttccccggccgcgcctctgatccgctgcgacgccgcgctgcgcgccgtcaccgagcaggccagcctgggcctggccgcgctgcaggaggcggtgcgcggccacctggcgccaccgccgccggcggtgctggaggtggcggtgccggcgggcgggccctccccctcccaccccgcctgctatgatctggtcaccgaggtgcccatgtcggccgcgctgcccgcctttgccgagcccgacgccggcgccgcggccgagctggaggcggccgacgccgcgctggccgccg

SEQ ID NO: 34427 - DNA, 74 bp, Chlorella protothecoides
cgcctgcctgcagctgctgctgcgcacgcgccacgacctgatgaagtcgctcggtgatactcaagctgacgcgg

SEQ ID NO: 34428 - DNA, 210 bp, Chlorella protothecoides
cattgttagctttggcatgattggtgttcgtgcggacccatggattggtggtgccaggacgccttgacccgctcctcaagggagtctaacgcaagacctaccgcctacccacctcctccttgtcttacgatctgtgtgggagaatttatgtgagcatgtggcccgccgcctggtattcttgatgctaggtcccccgctcaaccacacccc

SEQ ID NO: 34429 - DNA, 80 bp, Chlorella protothecoides
cacagtctgggcgagagaatcgcgacgacgtgacttgacgcttcccgattccaaacgtgagtcgcgcgagtcgacccaaa

SEQ ID NO: 34430 - DNA, 77 bp, Chlorella protothecoides
agcagtgtgctcttgccagagctctggggtcccataatggccacgacggtgtagtctatgccggtagactctactcc

SEQ ID NO: 34431 - DNA, 69 bp, Chlorella protothecoides
agatcggctgcttcgtgagttcacagggtgtgcgttggttttccttcacacccggagccgctcaatccc

SEQ ID NO: 34432 - DNA, 125 bp, Chlorella protothecoides
caaagacagcacgggtgcatagcactcttgcccgggcgcaggaaggcccgcacgcctcagaatccacttgacgtctccccgccagcggggcctggggcggagggaggctgacgacaggttgagca

SEQ ID NO: 34433 - DNA, 73 bp, Chlorella protothecoides
cgtgctccaacccacccagcccggctcgggcgcgggagctgcgggagcagcgccgccgccggccaagaaggcg

SEQ ID NO: 34434 - DNA, 71 bp, Chlorella protothecoides
cattgtggagaggcacctcgaaggtggggtcgaggggttgcttgaggggttggttgaggggttggtcgagg

SEQ ID NO: 34435 - DNA, 132 bp, Chlorella protothecoides
cgcagtggtcatgcagatctgacagcctgcagcacaatgcaggtgggtggagtgaggcggacgcagccggcatggggcagggacacatccctgtgcatgccagtggcctcgacagggcacagagaattcttt

SEQ ID NO: 34436 - DNA, 93 bp, Chlorella protothecoides
gggtttccaatcttgcggtgcgcatcggactaatcgaccttccaccccctgcctcctccctccccaccatccacagatgggacatggtgccgc

SEQ ID NO: 34437 - DNA, 71 bp, Chlorella protothecoides
cagtaccacattgtgaggaagaaggaggaaaaggggggagggggggggaggcactttggtgcagaaagaat

SEQ ID NO: 34438 - DNA, 2075 bp, Chlorella protothecoides
  modified_base (402)..(411): a, c, t, g, unknown or other
ggggggggggcatcatccacaagcagccgaccaggttgcccgcctcccgtgcttcataaaatccgttcccgttggcacacgccttgagcgtcgagcatgcacatctgggcacctgcacgtgcagccatgccgcgcccagtcccctcaggtccccagcaacccctctcgatgaggcttccagtccccccactgtcgtcgccggtccccgtcgtcttcgcctcactgtccacccaggcgcccccccccccccttccttgctttcctcacccatgatgtagaggaaggcgttggggacgaccacccccgcgaccaggaggacccaattggaaatcacggcgcaggcctgcgcgggctgggcaggggtgcgacccccccactcgcccagcccggtgtttgccacgnnnnnnnnnnaactcccgcgaccaggaggacccagttggagatcacggcgcaggcctgcgcgggctgggccggggtgtggccgccccactcgcccagcccggtgtttgccacgcgcgtgagcgcggcgtgcacgtcgtggatggcgcccccgctgggctctgtccagccgcgcacccggcagaagtccaagttgcactggagggccatgagggtccacaccacgacgcagggcaggcggcggtgcaggagcagcggccggcccagcagctgcagcgcggccatggggaacttggagccggcgcccaggcgcaccgccgcgcgccaggcggcctgcccgcggcgggaggcgccggagaccaggtccggggagcgggtgtagccgtggaagggcatgaccagggaggtgaagagcagcatggcctggtgcaggcgcgtgcggctgcgcaggtaggcctcggcgggcaggagcagcgccagcaggccggggatggcctggagtgagtgtgtgtggggtgggggccattaggcggaaggcggaggggtgagcgcgtggggatgggaggggggggagaggggattgccaggagacaatgatgcagcgagccgcgggttattttgctccgggcatcgccagagccagcggctgcctgtggtcaacagccatggggcatgcacgacgacactcatgaccgtgccaggcgcctgaatccatcgcgctactcctagccccacaatagatgcacgtatcaggaccatgcccgttcggagtgggccgccacgtccatggcgggtgggggtggtgcccctcgcccgcccattggaccccctggccagctcaggccccggtacctcgacgagggagtagagggccatggagcgggtctcgtccattgccattgcccacagctggtcggtctgtggccaggaaatggggggctttgggggcgggaaggcgtggcgtggctggccgcagtgtttcggagctgagggacaggtgagtgcaatgatgcccgccctgacccaccattctcgccatggtcaggagcgtcagcgtcagcagagatccggacaggatgaatgaacccgcggcatctccagctcgatgctgcgcgccatgctccagctcaaactcggcctccaggacagggtcgtgaaaaaccagggtgtgcgaccacggccagcgtggccttgccctggagggagatctctccccccgagccatcgttattgtaatgtcctttgctggggatccattgccagaggaaccagcactctgagggacagtgcccataccggaacttggtacacctctcgattccgattgtgtgtcgggcaaccgggcaccaagaatcaaatctgtgccacggaagctggggggtgggctacaacatcaacaccaggaagagcacataagacagagacatctaaacatgataaatgcattctatgcggttagatgtctacaacaaagaatgtactgcctcattgaggacacgaagggaggtgacgggtgatggcaatcgctgtacatgtatgggtacctgtgcgtcccgagtaggttcagtggtagaggctggtatgcttcgtaaagtttggtcacacgggtctccctccatcaccatgtgatctccaggaccctggtgtgcatgagataggcgttccagcgtgcaggg

SEQ ID NO: 34439 - DNA, 80 bp, Chlorella protothecoides
acgccaccgactggctgtctgtgcttcaccgcaaggccgccaggccgctgcgatgccagagcgatcccaccaacacacac

SEQ ID NO: 34440 - DNA, 160 bp, Chlorella protothecoides
aacttttgcgctcgctgactggaaagggggttttgcatgcttgggtccatgtgtgaaggcacgggtggggttctggggcacggcgctggagagggaggttgccgagggatggcctgctcgtcaacagaaccccccctcctcccctggccgcgtactcacg

SEQ ID NO: 34441 - DNA, 61 bp, Chlorella protothecoides
gcagccacccagcaccggcgagtgcaatgtaaaggatgttgctcgacctgactgtcaacca

SEQ ID NO: 34442 - DNA, 61 bp, Chlorella protothecoides
ggagatcggggaccgcagggcgcgcggcgcgctgcgcgaccccgggtcgctggaggcagag

SEQ ID NO: 34443 - DNA, 93 bp, Chlorella protothecoides
ggtggcgagggaggagggcttgggggaggtggtgagggaggagggctcggtggaggtggtggaggtggcgagggaggagggcttgggggaggt

SEQ ID NO: 34444 - DNA, 72 bp, Chlorella protothecoides
cgccgcggccgccgccgccgtgctcgggccggtcgctccctggggcagcggcggcgcccagaacgccagtac

SEQ ID NO: 34445 - DNA, 133 bp, Chlorella protothecoides
ccgcatatgactgtgcactgcttgtatggtggtgagagccagggtggtcgatcagcgtggctagggcagagtgagcacggaggcgcttcaagtcatgccctgcatgccctgcaggcaccagacaggattcagc

SEQ ID NO: 34446 - DNA, 61 bp, Chlorella protothecoides
atacatgctatatggctggttcgacccagggcaccaagctggagtgctctcgactggcaca

SEQ ID NO: 34447 - DNA, 64 bp, Chlorella protothecoides
tcctgaactgatcccggctctgctcatgcccgtcctgttgtacagacacagcgttgcatcatgg

SEQ ID NO: 34448 - DNA, 75 bp, Chlorella protothecoides
ctggaggcggaggcggcggaccgcctggtccccgccgccgacgcttacgagcgcggcatcagcctgggcgggctc

SEQ ID NO: 34449 - DNA, 102 bp, Chlorella protothecoides
ctcggcggcctcagcctccctggcctccctgcagagggattagaggggtctgggatcagcaggcagacagagtgacgaggaaagatctccatctggagggtc

SEQ ID NO: 34450 - DNA, 71 bp, Chlorella protothecoides
gtgggattcctcctgctagggtctggcgtcttggcggctctaccgctggcgtctcgggacccctgcggctg

SEQ ID NO: 34451 - DNA, 61 bp, Chlorella protothecoides
gcatggccgatgggtcaggctgagaggatccgactttgatgcattgcagccaccctcattc

SEQ ID NO: 34452 - DNA, 71 bp, Chlorella protothecoides
ggcatgttgggagtgtttgtgtggctgctggcaggttctcgatctgaaacagtcagtcgctgcgaggctga

SEQ ID NO: 34453 - DNA, 147 bp, Chlorella protothecoides
cgacccatgtccatgccatacttcacacctgtacacccctttccccctttggcaaagggacggaaaaacccctggccgcgcaccacacccacctgcgggcaggacgtcggccctggcccccagcgactccgcgctttccaccgcctc

SEQ ID NO: 34454 - DNA, 141 bp, Chlorella protothecoides
tcaccatcttctgcctgggaaggagaccctcaaaatccaaacagtttagcgttgaggccttaccgatgcaaaaccgagcgagtcagagcgcgcgcggaaagaggtgaggcaaatcccatcacgaggattcgatggacgatg

SEQ ID NO: 34455 - DNA, 239 bp, Chlorella protothecoides
gctcggcctgcaggccgcggacgggcgtggctccgcccgcgctggagggcgcgccctcgcccgcggcggaggtgccggcctcgctgcgcgcctcctcctcggtgatggtgggctgggaggagcgcggcccgccgccgccaaactggcccgaccccgcgcgcccgccgccgtaggccgaggtgtaggacgactgcgagccgagggaggcgagggacgagacgcgcccgtcccacgaggac

SEQ ID NO: 34456 - DNA, 64 bp, Chlorella protothecoides
gatccaagggagcagagatgcaggtgaggtggcaagctgtgttcagtgtactggcatctgggtc

SEQ ID NO: 34457 - DNA, 103 bp, Chlorella protothecoides
gggattgagtgggttggacaggcttactgggggagccaactcagaacctggcctcacacggccatgccccgctggacagctgccttggcactcacagaaggag

SEQ ID NO: 34458 - DNA, 61 bp, Chlorella protothecoides
agctgggcagcggccggccgtacgatcgccacctgccatgaccgcaaggggtggtgcctgg

SEQ ID NO: 34459 - DNA, 72 bp, Chlorella protothecoides
gagtgtttacgcttgtccgagatggctttgccgggatcatgtatcaggccagtcaagaccgatcgtggctaa

SEQ ID NO: 34460 - DNA, 73 bp, Chlorella protothecoides
agggacacaccagctcgccttggaatggtcccagccgcagcaccagcactgcgtctgtgtatggcgagggcag

SEQ ID NO: 34461 - DNA, 61 bp, Chlorella protothecoides
ctccaaggcagcgctgtcctggaccggattcatcctgttggccggcatcctgctgggcctg

SEQ ID NO: 34462 - DNA, 388 bp, Chlorella protothecoides
gcatccgatcggaaagcgcgccactcctcgtgcgctcgcgagcacgggtcggcggcatgcagggcggcgaccacctggtccggtgtgggggaagggaggaaaggttccgggaatgggagatccgtggtgccacagggctttggcgtgtgggttgccagatgggaacaccagccgatgtcttcagcccccgtctcgttccttcagaagtaggaacccctccagccccgccgctgtgatcccgcacgaagcaagatgcaccatctccagccgccttccttcctgcaccccccgcacacctcctcctcgagcaagtcgcggagagcctgcacgccagcctggaggtcggccgggtcgacgtctgcggcctcgcggcagtgccccagctggc

SEQ ID NO: 34463 - DNA, 160 bp, Chlorella protothecoides
ccccactgggagcatgtcttctggggggagactgaggccaaggcctttgttgccaaggtggggactcaggcatgatcaagggggaggggggttgacagagggggccaaggcagtgaagggccatggccgaagggcgcgtgcaggcatctttgggtacatg

SEQ ID NO: 34464 - DNA, 80 bp, Chlorella protothecoides
ggcgtgatgctcaggccggggtgccgggggtttagcgcccagccgccgcagcagcgtcgcccgccgcagcatcaaggaac

SEQ ID NO: 34465 - DNA, 144 bp, Chlorella protothecoides
agggggtcgcggccaacgtcctcatcgttgagagccttttgggcgaggcagcgctgccgatgcattgagtgcctgcagagaacaatccttgccaggtattcatcattcaaaaccaccagctcaccctgggcatggtctcggggg

SEQ ID NO: 34466 - DNA, 14985 bp, Chlorella protothecoides
  modified_base (414)..(423): a, c, t, g, unknown or other
  modified_base (2052)..(2061): a, c, t, g, unknown or other
  modified_base (3330)..(3339): a, c, t, g, unknown or other
  modified_base (4407)..(4416): a, c, t, g, unknown or other
  modified_base (4648)..(4761): a, c, t, g, unknown or other
  modified_base (6637)..(6646): a, c, t, g, unknown or other
  modified_base (7760)..(7769): a, c, t, g, unknown or other
  modified_base (8426)..(8435): a, c, t, g, unknown or other
  modified_base (9806)..(9815): a, c, t, g, unknown or other
  modified_base (10969)..(10978): a, c, t, g, unknown or other
  modified_base (11505)..(11514): a, c, t, g, unknown or other
  modified_base (12329)..(12338): a, c, t, g, unknown or other
  modified_base (12725)..(12734): a, c, t, g, unknown or other
  modified_base (13535)..(13613): a, c, t, g, unknown or other
  modified_base (13729)..(13738): a, c, t, g, unknown or other
gggtgggggggggagggagagtcgggtgggatgctcgttgtggcgcaggtgcttgtgtccgagactgggaggggattcggaatgcaccatcccggggtgacgaccagagctgccgccggtgaccccttccccagcttcctgtggcagcccacctgccgccctgtgaccccaccaccgcggtcttctactccatctccaacacccagccggggctggcgcgggtggagttggggcatttcctgataaaaaaggtgggtgattgagattgcaggcccggaatcctgaagatgtgtgtttgtagggcatggacctcggcattgagcctgcatcagcacctgtactggcggcgccgacaggggtcttgtgtgcttgttggaccctcctgtgtgaagtcattgtgctgggaaggctgcnnnnnnnnnntaaaaaggtgggtgattgagatagcaggtccggaatcctgaagatgtgtgttcgtagggcatgagcctcggcattgagcctgcatcagcacctgtactggcagcgcctacaggggtcttgtgtgcttgttagaccctcttgtgtgaagtcattgtgctgggaaggctgctgcaccccccgtgccgctctccatcaccattgacttcagatgccagccaccaccagatccctcccaattccccaccacaaatcccccctctccccccatccaatccccgccaagcaggtggccacggagctgctgaaggagttcgacctgcagacgctcgtcacgttgtcgccgctgcctgggtttgccgcctgggtcaaccatcggctgctggtccaggcccgggagcgcagcggtacgcccgagggcgacctcgccgagcggctgctggtgcacctggagaacgacgcctggctttcctgccacgaggccgaggccgtggtacggccctggctcatgcgtgcggccgccgtctacctcctttgggagaagcgcaggtgggcgctgcgggctagggttgtgagcgggggggtgggggagaccggggatgcatggctgctcgcaaagcctccaggactcctgcgaggcaaggctcagcatgcgtgcacggctggcactgcacacatgacactggctggggtgcaaggggagcctgctgtgtgtgtcgtgcccgaggtgctgccgcaggtcgtgcgccctccctctgcatcccatgcacgccacccagcacccacccttccaggggtctggcgctggaccccgtggcagcgttccacctgaagaatggcgcgacgtgctggcgcctgaactggcgcgccgacgtcagcgggcccggcctggagcgcagccacggcatcatggtcaactacatgtacgatctgggctcgctggaggccaacaaccgggtatacgtggtgcagggcaaggtagccgcctcggaggaggtcctgcggctgctggacaaggatgaggcatcatagggggactggccagttgaggtgggcgcagggcagcctcagaacgaatccggcagagggaaaggcgcagtgctcggaccagcatcccacatgcatgcccaaattttgatcatgggcttcactgaatgttcacccatacatttacacactgcacacttgtggccctgcacttgcaagtcttctcgttacattggacagagggtatctcggccggctcaggccggcaggaggggtggatgcaaagagaaacttggatggggaaacccaatcctccagcagccctgcaatgaaatcgctaatctctgggaccaagggcccttggggtcgagggcgtgacgaaaacatggccacaggcatcgatcgaggcgctgtcaaaattgtctgctgcataggggacccggctggcagcatgccccccctggcacgcagcatggtgtgcgtaagttcagagtgaggagagggcgggcgtcttgggcgaccagatggaggggtcggcggcgtccctggccaccacatccagggcctcggctgggccttccatcgaggcacggccttcacttgtcgcggcctcggggatcaggcccaggcgcgaggcggcggcannnnnnnnnnccatccaggtcctcggctgggccctccatcgaggcacggccttcatttgtcgcggcctccgggatcaggcccaggcgcgaggcggcggcatcgaagccgcgcgtcgcggcgtccagccagtcccccgacagcagctcccgggcggggtcgtacttggtcgcatggcgcggcgccgtcacggaccccagcccgctcacggggtcgtaccgtgccgcgccccgcggcgcggcggggacctccgggccccccgcccacccgctgcgcagccagtcgatggggtcgtagcgcacgctacgcgcctccggcagcgtgtgctgcagcgaggcccggagcagctgccccgccgcgtcatagcgctggggcccctgggtcgaagttgcacggccgccaaagctcgcggccgcggcggccagcatgcagccgacggcgtcgtacttgtccggccccgcggccgaggcggcaaaaaaggcgggttgggagcgcggcgcacgggagcgcgcgtccagcgggtcgtacttggaggagccggggcgagccgtgctgcggatggcgcggaccagggggtcatacttggaccagaccgtcggcgcagaccagtccgcgaggccgtgcagcggatcgtacgccgacggctgggcggggccccactcctgcgtgagggcggcggagggtgcaggatgacgggccgcccggcggtagcatgcatgaggcacgcacagccatttctcctcccttctgcctccatgagaacactggaataacataccagcttcgcccaccctacctgcagcagggctgccgcagctggcgaacggctggggcgcgcccgccgacgtcgactccggtcctcctgcaggcatgggaccggtgagacgaaatccagggcttgtccatgtgaagaggtccctgggagggtgcatctcaagcaaggtcctccgttccatgtagtggcatacatgacctccagacacacaggagccgcccccctccccaacaagcccgctcagctacctggagttccaagccaagcgttgccatgctttccaccagcggcatgaggggggccagcgccagggccaccgcgtcccagctcgccccggcggctcgccgacgcggtggcttcgcgctttgcctctcgataccgcgcccgggacgcacttcgggctcggcgacgttcgagggcttcgcccccctgtacacatcccgcgctgggctctcgacccgggcgccagctggagcctggccgctgggggtcggggtgttcgtggnnnnnnnnnntcgttcgagggcttcgtccccctgtacacatcccgcgctgggctctcaacccgggcgccagctggaacctggccgctgggggtcggggtgttcgtgggtgccggggcctcggcaagagcgcttgccgccgagctggtccccgccagcgggtcggcgctcgctgccgaatcatccctggctgactggcccctggtaggctctgcgattgtcacgctcgatgcagccgccaatgctgtagcacttccctcgctgcgagacgtaggcagcgggcccctgttcccgcccggagccgccgccttggcggctgactgctggaagaagcggcggacccagggctccggcgacttgggcacaggcctgggtactttgggtcccagcgggttctccacccctgtctggaggggggcgacctcggcagcggctggcgacggctgagaggtcgccgcgcccaggccggcggccagcgccgctgagacggccggctcgttcacgaccgactcgccactctccgctcccgaggcaagcggcccctcttctcccgcctgcgcctgcgcgtctcgcgcggcgtcgggcgcggcgtagaccctgggctggggcgcgccccacctctggcccaccagcccctgggccctgaggagcgagatgaggggcacccccatcatggccatcaccgccagcgtggccaggctgatggtgccggtctggcgcggcacggggagcgtggcggggcgctgactggacatggtcagcgagccccccagccccaccagggcggtggcggagcagaggccgggcgtcgcggccgccgacgccgcgccgggcggggacgcggaccagcgccctccgccctcagcggcgcccgagcgccgggggtgcgaagcgaggagggtggggccctggccctggaaagggcggccgtcgggcggctgcgcggtggcccagcgggagcgcgtcaccaggcccaccagcgtgaccgccaccaggccggcctgtacaggttgatttgggggtgatccggggctgaggcagcggattaagattgattcaatgtcctgggggacgacccannnnnnnnnntgtgaccgccaccaggccggcctgtacagggtgtttagggggtgatccggggctgacgcagcacattcacgattgattcaatgtcctgggggacgacccagattcctaagacccctcctcacccagaggccccaggtgaaatgccggcacccacccggacaaaggccttggagaagcaggcaggctccacccgatcctggagatccggaccggctgcgaggctcgcctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcgacctgtggcttccggcgctgcgtggtggcacggtcgtggcgtcggccacgtgcgacagggcctcgcgggcccacaggcccatgcctgggcccgatggagggccctggcatggaacatggcatgtaaaccctgagcatgatgggagcgcggggtcgggtacgcccgcgatgcgtttcgggattctgcgagacggagcctgacgtgcggttcgggcaggatcgctcttgtgctgcgatgcccacgatacaggggccactggatttccagggtcggtttgggttactccgatgcgctgttgtgctccttggactgggaggctcggggaatgcccatgccagatcttcatgagatttggtggaccttccccctttcccgccacccccgcgcgcacacatgagttggattctccccggagttctccctcattggcacactttggagcaggccgccctcgtcttcatctgttgcaaccatcctcgactgtacaaatcccacttttccagtcccagctctgggtggacgctgctgttgttgcccgctgttacacagacatccagatggcacggcacaacccccaggggggggggatcaccacacccgactggggagccaagggcacgatgggcgtgcccacgcccccccaactccacacgctcagcgagcctccttggccagcaccttctcgcgcttgcgcaggcgggcctggctcttggtgcccaggatgccgccgccccaggagatgcggccctcgtacagcgatgcggcgctctccgcgatcttggccagctcgcgctggtcctcgttcttcacgctggtcaggcacagcgcggtggcgttcttcttgtgcaccaccgtgcccaggcgcgccttgcccttcacgatgacgtatgggatgcccatcttcttgcacagcgcgggcagccagaccacgatctcgatggggtccacgtcgtgcgcgatgaccaccaggctggccttccccgcctccaccagctgcgtcacgtggttgatgccgaacttgaccaccacagggcgcttcttctccacctccacgccgccggtgcgtgcctcggcctccttcagcaggcgctcgcgcttggccgcgcggtcctcgggccggtacttgagcagcagcttgaagagagaggaggcagtggacttgtccagggtcttggtgaagcggttgagggtgggggggaccttcagccgctgggtcagcacgcggcgctggcgctggatgcgcacatacttgggccacttcacaaagcggtgcaggtcgcgcttcggggggagggcgccgccgatgcctgtgcacagggatggggtggggatggggtggggtggggagcgaggaatggaggctgcgtggatgcggaggcacctgacaccagccccggcatgggctgggcatggcagcctcagcccggctggcaggacgccagcaggcgcactcaggccttgaagaagctggcactcctcctgctcggcattgtcgcccccagtctggatgcacaattcccagccatacatccacaactagctcgacaggccgtgtccatccctgccccaagtccgtaagggcccctcccgcgcataggccccgagcagcggcgcaccgtatgtccggctgcgcttctcgaatagcgggttcacggccttggctggcgcagcggccttcttagcggccgcaggcgctgccgcgaccctcctttttggtgcctgcgcaggggacggaggtggacgacggggtgagcgtgtcaagcccgtcgcgctggggatgaaagccagcatccgcgcgggcactggtatccagtcccaaggcagtgctgtattggaatcgtaggcatccatccacacagccggcaacgtcnnnnnnnnnnaacggaggtggacgacggggtgagcgtggcaggcccgtcgcgctggggatgaaagccagcgtccgcgcgggcactggtatccagccccaaggcagtgctgtattggaatcataggcatccatccacacagccggcaacgtcgtgtacggcctgagcgcaggctgctgggaggtgcacagggccggcatcccacgcggaaacaccccgctgcaccgctggaggcggtcgctccgcactcaccatgatgtccttctatcacagcgggggaagagggagattccgtaggtgtcgagggtgatgggcaggggccgggctggagcggggcggcgagtaggaaaggccgactgcgaagcgaggcgcgctttcttcagtccccaaacgacgagctgcgaaacaggcagagggcagatgcaggacaaaaagacaatacacacaccaagggagtgacctagggtgaaaattttggtcgtaaggttgcgatatatcctgatacgatgtagagcagggtgcgccctagcatgcttcctctccattctggaccaccacaacccgggacgcacctcagtcataggggatccgcccaacccgctcgtcgcgcccggaatgtgaccataccctcaacactacaaactgctgtagctgtcttcatgttgtttgccctgctcgtggcgctcgcctaccgggcaagtggagacctggcactggcgcactgatgcagggttctttgggtacacggtcatgcaagtgatgaggcgctcagcctcctctccccctgtgtccccttaccaacaggctgtcggatctgacattcaagttgcccctgcatcgtccagacgtctgctccgagattcttccttctctcgtgcgcggaagttcccggtctccaacctcaccacgctcatcctggtggccggccactctgtgtacacgggtctggactaccatgacgcccagggctccagcagctggtacctcctcgactaccagaaggaggtgtgcattttgtgttggtcatttttactgaagattgaacaaacactggtatggagtcttgtttggtattcgtgagacattgttgcacaattaggaggaccggccgagctcgagctccccnnnnnnnnnnctgttggtcattttgactgaagattgaacaaacactggtatggaatcttgtttggtattcgtgagacgttgcacatttaggaggaccggccgagctcgagctccccgccacctgcacaggtcaagggccagacggagagtttcatggcacatatcaggctgggagtggagcaggctgcagcagaccccaagtcggtgctcctcttcagtggagggaaagcacgggccagcgccggcccccgggccgaggccgagggttactggcttgtcgccgaggccaacgactggtttgggttccctgaggtacgccgcagggcgttcacagaggtgagcggaatgggctgggaggtgcgaagtgtttgctccttccatggggggagttcttggagattgctgtgccactgtcactggagggactactacaaaggtactcccgtgtcctccacaccctcccttcatgctgctgggccccaacaggagaaggctagggacagttttgaaaacttgctgtttggtttgtgccgatactacgagctgacaggtgggatttgtatgcggcaagaatgcgtgctgcagcactcaatgacatttgcgcacatcactgctctggtggcgctgcaagcacgggcacatgcttccgttctgtccagtctctaannnnnnnnnncatgacatctgcggacatcactgctctggtggcgctgcaaacacgtgcacatgcttccgttctgtccagtctctaagcaccttcctcctgcctgccacccggcgtgcatagggcaccaccccacccatgtgacggtggtgggctatgagtttaagaaagcgcgcttccaggacatgcaccgggcggccgtgcggtaccccgccacctccttctcctacgtgggcacccccgccctgacgccctcggccgtggacggcgaggctgccgccgcggccgccttccggaccgacccctacggctgctccggcgccctggcggcaaagcgtgccgagcgcgacccctttgccgagggcgggtacggtccagacaggtgcccagccatggccggcctcctgaattggtgcggaccagaccccttcccgggccgcctaccatgggctccgcgacgttgacgcaggtcggaggagcgggggatcgttgtttgcgtactcatcatcgcgtacgtttattgggccagcctttttcctcaggacaacttcttcctcgccacctgtcgtccctggcttgaactcgcgcgctgcctccttgcaactccgcgccatcacattgtcatgaccctgacccgacgaggtcccttgatctcttttgcttctgcatcccagctttaacataccaacccgcggaagcctcgacactcctgaccgaccagatggccgttgatacattctgacgcagctcaaagtgggtaaatacactcgggggcatgtcagcgatcgtgagccgccacagtcggcggcacaacccccctacgcagagggggtgggtacctcctccacccggatgccgcgcgcccggatgcggtcgaggtaactcgtgccgcgcaggagcagccccggcgtgagcacgccgcccctcgccccgatggcgtcccgctcctccagcagcacgttggcggcctgggtgacaaagatggagcaggcaatgtaccccggctctggccccacgatacgcacgctgcggtgctcgtccggcggcgcgcccgcggcggcggccgcggggtcggcgtgcccatgcgcgatgtgtaggtactcgaagcgggtgtcgtggatctggcggtcggtggggccttcccgcgagaacacgccgtaggagaagaggctggggaaacggaggagcagggtccggccccaggcccggttggccaggaaggagaagatcgtgccgaagaagacgtacctgccagtatgcgtgggcgtgcgtcaggtggggagcgggtggggagccatggacgacaatccagcagcagaggcctttctttagaatgacagcgtgccgaagcacttcccaggttgcagggtctgcatggtgtgnnnnnnnnnntagcagaggcctttcttcaagatgacagcatgccgaagctcttcccaggttgcagggtctgcatggtgtgccggctctcgtggccctcccagacacatgcctggcccatcacagtggcatgccacgaccccttgcccagctcacagggccacagtccagcggtcggcgagggtgaaagagacagaggtgtgggctgcagcctcgccctgcttggccagcccggcccaggtcctcttgacgacggacgcatcggcagctgggggtccaggaggtaaatgagcctgggtcagcatttggaaactggagggcagggatgcactgtctcatgcacgccacatcagcgttcccccacaacgcaccgggaaaggggagggtccagcgccgcaggcgggcgtcccacaccggcttggcgctctggcggggtctcggccccgggattttcaggtcgaccttgcccttggcagccacagcctgtgccggtgatggatgagtgtcacgtttgggggtggtcctcagcatgagggtgtgatgggcagggggaatgccctgcgcccatgcgtggcaaacgtcatcgccgggaagcggagaccccatcgcactcgttctgtggttgaaaacttctccccctccttctttccctgcacagcctcccatccgaaaagccctcgcacctgcttgcgcagcctgctgagggactgggcgtgggcgtagccgaacaccgccgactcgtaggtggcaaagttgccccccagccccgcctcgccggcgtggatggagacaaaggactcgacccaggtgcatctcgcagggggcttgaacagggaagcagccagctgcgtgccgacgtcggcgggcacgcagtcgaacccgagggcggaggtgatgagcacgccggcagtttcagcagcctctccatactccagctcaatcctctccatgaactctgcaatggcggatgtggtgcgacggggaggtgggtggaggtggtctgcatgccatgcccagggggggggtgcatgttgaaggtaggcatgaacattactttacgatgaacgactgacacaaatatgtggctatgatgacttcagtaccactcggctgatgttttgattgctcatgtctcgcatcactccagtgtcgtggtgtcatgcacnnnnnnnnnnagctatgatgactttagtaccactcggttgatgtttcgattgctcatgtcttgcatcactccagtgtcgtggtgtcatgcacaaaccagatgcctccaccccaaccccccacctccacaaaataagcacgcctccatcatcatcacctggctcgccacagacatccagatagtcgcacttcccctcgatgcatgccttcaccacgggggtgccgtacctgcggaaggggcccaccgcactgatcagcacccgcgtggagcatgcgagggcgaggagcgagggggcgtccccgacgtctgccagcacgatgtcgggcctgacgctggccgacgtgaggtccagcctctccacgacgctctccagcttgctgcgggaccggccagccaccgcccatgacctgccgggggtaggtggggggatcaggctggcatgccgcctgtaattgctggtacctagaccagcaccctcatgatgccccataacgtacaggcctggccccttgaccaaacccattactagcaacccannnnnnnnnngtgggcggggggatcaggctggcataccgcctgtaattgctggtacctggaccagcagcctcatgatggcccatgacgtacaggcctggtcccttgaccaaacccattactagcaacccaccctaggaacttgctctcgatcatttcctcggcgatcttctggcctgtgaatcccgtggcgccgaggacaaccacatcatatgtgcgaccagtcgccatgctggcagatgaatgttagcgccctcaatgctgtgatcggagacgatacacgcggtgattaacaagttactgcatgttctcgctatgcaatgtgagcgcgacgagatttgcaagccgcgtgttgcataaaccgtcgcgatgggttccgcgcgcgaagacggattggtcgcggcaccagctcagatgcaacaggaggtagcccctcatgcgcagcatactctccctcgacccagcctcaagcggccaagtgtgtctgttgaggcggaaggggtgtaggggggaaggccctcctcacatcctttgcccctccaagggcattcaggcaccacacctcactgcatgcctggtggctggtctagttggggaaacggaatgggatctcccacagatacaaggtcacctcagctgtcctcatccgctgatgcagcctgcagcttcctgccactccccatctcaagatgagagtggatgggcagctctgttcttgatgtgcaatcccctggagaagttcgctgttagctaaaatggtgccataggcagtacagcttccttcagggttttgtaaaggactgcatgctacacgtgcactctctgcnnnnnnnnnnggctttcctcgtctgctgatgcagcctgcagcttcctggccctccccatctcaagatgaaagtggatgggcagctctgttcttgatatgcagtcctcaggagaagttcgctgttggccaaaatggtggcataggcagtacagcttcctttagggttttgtagaggactgcatgctacacgtgcactctctgctccgctgtcaggggtgcctgttcggcagccttttggaatgcctcaaggagccctgaagtaacctctggtggctggcccgggattgctgatgatgttcagcagcggtgatggtagattgttcccctcctcagaccgcgggatggtgacacttttcggcccgtccgtctcaggctctgtggttgagggagccagatnnnnnnnnnncccctgaattgacctctggtggctggcccggggttgcgatgatgttcagcggcggtgatggtaggttgttcccctcctcagaccgcgggacggcgacacttttcggcccgtccctctcaggctctgtggttgagggagccagatcgggagaggaagcaagtggcgttctgacacctgctcctacacctcgtcacacctcctgcttgtactgaccttgaaggatgccatggaccctgtctcgcttggcgacctcctgacggtgtggcggtgactgcacagcggccgtgccctaccgtggtcttcttgggatagttcacctagcaatacctggacgagctgtggacggcatgggcttcaagtagttacaaatcagggctagaggttgcaacgatggcaatcctggaaggagctatgttgaagccaccaggtgtatgtggccctgctcctcgatagactttgagatcctcacatgctgctcagaagaccattacaatggtggcagaaggttcgtgccgatcccatatttttgagtctatggcccaatgtgcccgcgctgagcacgcagcttccgatagcaatcttatcgaggggaagaaagggcctccgggacgtcgcccgtcagcggatccacatttccggtcagaacgtgtttccggggtgttcaggtagaatatccggtatgtagttcccccaatgaccataggggtccctcatcgttttggtagacattattgcattttcgaatcgactgatcttggccgagaattgctgcggcaagatgccgtcgcagcgacagacacnnnnnnnnnnnnnnnnnnnnnnnnnnnnnnnnnnnnnnnnnnnnnnnnnnnnnnnnnnnnnnnnnnnnnnnnnnnnnnntgccaatgacatctgtaggtgcgttctgaggcgatccaaggcgtggctttgcaaggcaagtccaagcctatgcatcgcaccacgacgtcagccacctctcaacagtgccatgtgcnnnnnnnnnncctccgactggcatgtgagtttctgctggattttgctgactttgcttggttatcaactggctcccggagcatgtggagcctggatggcgatggtttggttgtaccgcggcaggccggctgcgtccggacacgggttgctgaatattcaacccagccacaccctcccctttcctcacgtagttatgggccccatgtctacctgctcgaggccagcagcgccgatgacatctgtaggtacgttatgaggcgatccaagtcgtggctttgcgaggcaagtccaagccaatgcatcgcaccaagtcgtcagccacctctcaacagtgccatgtgctttcatcatgcaccgcaggtggatgggctacgccaaggcaggttctttcagagagaccacccttcacattcttggtgtttccgccagcgccatcaagatgacgccctttgaggtcatcaaggagcggtccaccaggatcctggtggccctcgaatgcctcaaggcaggacagaaggcttgcaccgctgacacggatggcaacattggtaccgggaacaaggggaagaacaactttggcaactataacgagggtaacaacaacattggtgagcaggcccgggaaagcgatggggtggtcctggggttctgagtgttgcacaagatgggtggagagatgtgccatacatgaccatgaccttgctccagtataacatcccagttttataatgcgcagggagcttcaacaagggaaacctaaactggggtctcaataacaagggcacaaatctgcggtgcaacgacgcggttggaaaacggacgacgattctcaacttctgcaacgtgaagcaacttcgcaggactgtgctcagagactacaaccgcccgccaccttcaccactcaagaaagcatctccctcaactcccccaaaagcgtccctgccacctcccaagacggcgtcaaagccacctacagtgaagtcctctccaccatccatagtgaagaggtcaccactgcctccattgcttcctcctgcttctcttcctccttctcctcccccaccgtctccgattgctacctctcctttcccctctcccccacctcctcctcccccttccccttctcctcccttccctcctcctccctcgtccctcttcccctctcctcccccctctcctccccctccctctcctcctcctccgtctcctcctccatctcctcccccgtctcctcctcccccccccccccccccccccc

SEQ ID NO: 34467 - DNA, 69 bp, Chlorella protothecoides
ggccattatgatgactcatccgattcaacttaccgtaccgccccccattccttcaccatcccctccctc

SEQ ID NO: 34468 - DNA, 124 bp, Chlorella protothecoides
cccactcggacgacttcaggcaagggaaattgagggatggaaggtggagtggtcccaatgctattcttccataagcgatccccgacagccccccaaaacattgcggtgcatcttgacaaggacg

SEQ ID NO: 34469 - DNA, 15046 bp, Chlorella protothecoides
  modified_base (503)..(512): a, c, t, g, unknown or other
  modified_base (770)..(779): a, c, t, g, unknown or other
  modified_base (2325)..(2334): a, c, t, g, unknown or other
  modified_base (4851)..(4860): a, c, t, g, unknown or other
  modified_base (5721)..(5730): a, c, t, g, unknown or other
  modified_base (6167)..(6176): a, c, t, g, unknown or other
  modified_base (6433)..(6442): a, c, t, g, unknown or other
  modified_base (6551)..(6560): a, c, t, g, unknown or other
  modified_base (6894)..(6959): a, c, t, g, unknown or other
  modified_base (7385)..(7532): a, c, t, g, unknown or other
  modified_base (7596)..(7605): a, c, t, g, unknown or other
  modified_base (8025)..(8034): a, c, t, g, unknown or other
  modified_base (8671)..(8806): a, c, t, g, unknown or other
  modified_base (8870)..(8879): a, c, t, g, unknown or other
  modified_base (9104)..(9113): a, c, t, g, unknown or other
  modified_base (9575)..(9584): a, c, t, g, unknown or other
  modified_base (10090)..(10099): a, c, t, g, unknown or other
  modified_base (10601)..(10610): a, c, t, g, unknown or other
  modified_base (10945)..(10954): a, c, t, g, unknown or other
  modified_base (11188)..(11197): a, c, t, g, unknown or other
  modified_base (11537)..(11546): a, c, t, g, unknown or other
  modified_base (12520)..(12529): a, c, t, g, unknown or other
  modified_base (14430)..(14439): a, c, t, g, unknown or other
  modified_base (14825)..(14834): a, c, t, g, unknown or other
  modified_base (14904)..(14919): a, c, t, g, unknown or other
tgccagccgtgcccgccgccgttcccgcccagccccgccagcgcggcgcgggcggcggcctcccagtcctcactgcgtgtgagctcccgccccgggcccgcggggcgggagtcgagggccagcgtgggcggcggcgtgcgcgcccgcgccggctcggcgcggtgccgggcgtgggtcagcatggtggccgccagctggagcagctgggccgcctcctcctggctctcacgcccaggcctggggtcgacccggtgggtgctggagcggtgggacgggtcgtcgctgtccgcgctgcggaagcgcttgagcgagcctggggtggggcagtggaaggcggagctgctgctgtgcagcagggtcgcggaggcggtctgcgagctgggcagcgaggcgcggaaggactcggcctgcttgtttgttttttggtggaggggggagaggggttgttgagcatggggaagggccctcggtacgacgggagtggggggggggggggggggggnnnnnnnnnncgactcggcctgcttgtttattttttgttggaggggggggaaggggttgttgagcatggggaagggccctcagtatgacgagagtggggggttggggagtttgggtaaggtcctcagtatgaggaaagtgccgaggagcaggcgcagaccacagtacttaaccgagactggcacaataggagccacaagaatggcgcatgagcaaacagggtctggatctgccgcatcacggcatgctcaccttcttggactggcgannnnnnnnnntaccgagactggcacaataggagctacaagaaaggcgaatgggcaaacagggcctggatctgccgcaacacggcatgctcaccttcttggactggcgagggccgcgcgtggaccgcatgctcccggtcttggcgtaccagagcccgcaggcattgcacctgcgcacaccacaaacggtgggggaaggagattgagtgggagggcaggacccggtcctgcaccgggtgcatggatgcgccatgcgcacgacagattacaaagggggtgaaacgcaatccgtttccactcccacgcacgcacagtgtgccgaccccccgggggcctcgtctctgcagcggcgtctggtctgctgtggcgctgcagttgtcgcagcgccacagcgggatgcaggcgatgttcacggtctccgtcatgcgttctgagcggggagggagggggttcctggcgtcaggcatgctccgtgtgagtacggatgggccgcgaccacacgctgtcgtaccgccgagggcatcaaacatgccgcaaagaccatgctgcgcctttgcgaggcagcggtggagctgctcatggacgtgcgatcagtaaggtcatccctgccccctgattcgcgcgaaactcacgataaggcctgccgggcggtgcgatcgtagctgcgcactccctcgtctccaccaagaggtccaaggaggagtattaagggatttcagacggatgttggggacggtgtgcgggcaacgtctcgctgggcttgcgatactcccgattccgcagaacggcagaggtcgaggctacaggcggcacgccagcccaaggtagccccggacgaagccgctgctggaatataatgtttacgagtcagtattgaagacgcttgacgggctgagcgcgaggactcgacgaaatccggggtcgaggtgtcgcatgggaagggagtatgggaccccacgaagccgccccggtatcaggtggaagcggtgccccggtttccatgatcggatcgcgatcggtatctcgtccaccacgattttctttcaaccccgggcctactttcgtgagcaacgccaaccgagtttggaactcatagtatttgaataatggttacaaaagctgccttttgtgttgaatcgatctcggttccctgcctcgtcagatcttgatcagaatcggcatgggaggtttttgagggtgtacgagatcgcggagcacgggtccgccagtcccacgaatgatgatggatcgctcccaaacaaacagctgaatgaatcatgattgcctcggaacctctaagacccctttcgaggtccggggtcgggcaccagcgatcacgcacactccttctcgcgatgtcggcgagggggagatcatacgtcagcctgaggtgatggggggtcaacagccaaccgggtgctcgggatgccatgtttgcacagtcagactgcaaccatgccagaacgtctagagtgtctccctctgagaccccccctccaggatgtgcgtggctttcctccttgacagcggggcacctcactgtgcccctgcctcgcannnnnnnnnnagggggagatcatgcggcagcctaaggtgatgggggatcagcagccaaccgggtgctcgggataccatgtttgcagagtcagactgcaaccatgccagaacgtcctgagtgtctccctctgaggaccccccctccagaacatgcgtggcttccctccctgacaacggggcacctcactgtgcccctgcctcgctcagagcgaggcgatcacgagaaccaagaggcgtgctgggcccgcagccaggcggccaggcgcgcgcagtgcgcggccacctcctcgcacttcgacagcgcgtcgtacgccgccaggagctcgccctcctttcccagcaccgcggccagggccaggcccgggcgccgctctacgcgcacaccgcacagcggcccctccgcctccgacccgcggtcgtacgccgcggcccgaacctggctgtacgccagcacgatggcctgggggggtggaaagggaggcgacgggggagaagtccggcggtgcctggggggactcatgacggcgcggggcagcatgcagggggctggctgcaggcatccccctccccaggtattgcgtctgccaggcccttcacaccccctgctcaccatcatacccccccacccggatccctcgtgcccacctgctgcagcctgccgtcgccgaccggcggcgaggccacgaactgcgccccgcccgtcaggcggtaggcgtagtgcaggagcggcgtcgtccccggcgggcccccgcccaggctggagggcaggtcgcgcacggcgagggagggcgaggcgccggccaggtggcctatgggcgccaggcgcgtggcggcggccgccaggctggcgcggtccggcgcgccggggacgagcagggccagggttagcggtcccaggccggccccgggcgacgcccccgcggtggatccctcgccgcccaggcgccggacgtaggcgtgcaggagggcggtggggtcggcgtgggggaggcacaccggggtcagggcctcctcgtcccccagcacgcccacgatgttgagcagcagcaggacctcccactgcgtcaggggggggcggccgggggcggcggccaaggccaccacgccggccgggcccagcagcagcgcgtagtgcccgcgcgtcgactgcgcgcgtgtgtcgtgggggagggatggagcgtgcgagcacgagggggagtccgtgcatgtgtgcacggcatcctgcggcgcaagcagccgagcagcgagacgggggcccggcactgcctgcctgccgacgctgcgccagctgcacgctcccgtctgcccatgtcagcatgcatcgacgacccgcccgcacccaccccgagcgcgatgtccaggtgggtggcaagcacacgccgcctcggctggggcagggccagggaggggtaggcgcccagcagggctgccgggctgcgggcccagctgcaaaccagggcgtccagcatcttctccgtgccgccttgggggggagggggggtcagtgcggtgggcttggctgcagagagacaggaccgttccccactcagaacgactcaggagccctttgccggccatgccctcgcagccgccccgctcacacccatcgggccgccgccccacccaccgacctagcaagcggcgcaggtcgtaggagggggccttcctgaagagcacgcccagcgcgctgcgtgtgagcacgctttccagctgggcgtgcagcagagagagctgcatcctgagcaccggtgcaggctccccctggttggaaaccgcaaccagggccaggggtggccgatccaggagcacgatggtggatcggccagacctgcaggcgcgagagctcagggttgggctggggctacacggcttgggctcgcagctggggcattggtcgggttgccaagcacacgcggggaggacttggacacagaaagcctagcctggccttccccagcggagcctcccagcccgcccgacccccagcgcaccgtatggaacggagttcctccccgcgactccccgcaaaagccaggaggccagccgccgtcgctgcgacgccgggcagaccctcgatctcctggggccagcagtagactggcttgccagaactgctcagtaccagtacagtcttggatggggtgttgggtatgggtgctggtggtgctggtggggaggctggcgctgaaagtgacgggtgtccgcgcgcggcgtcgataggggaggctgtggggctcggagtgcggtcgggcaaggcagtctcctcctctcgcatgggaaaggagtccagctcatcctgtgagcgcgcagacgcacgagtcagaggtgggatatgtgacaggaaaggaggagcgtcacctttcccccactccctgcaagtccatttactgcacggacgccacccctctcccacctctctgctcccaccgaggcgtggggctccctcttcatcgctgttcgagggcgacgctgcatcgacattttctatagaccctaccttgcagatctgtgatgcatgaagaggacnnnnnnnnnngaggaggagcgtcacctttccccactccttgcaagtccatttactgcacagacgccacccctctcccacctctctgctcccaccgaggtgcggggctccctcttcatcgctgtttgagggggacgctgcatcgacactttctatagagcctgccttgcagatctgtgatgcatgaagaggacagtgtcgagcacaatgttcccgattgaggttgaggccacagccaaagtggtcttgatttccctctcaccggcaggctgctcgccgacataggttctcgacgcgatcacgacatttctgaattcatacaagatgcgcgaccttggagaccgtccagcaatcaaccgaaacggcggccgcggtgcaccgtggaaagtgtcaagggtcgagcagtgggtgacggagaagccggtgtggatctccaacttgtcgtgtggtgtggtctcagtgattccacttctgtaatataagaatcgaccaaatggaatgccaggcgaggactgcgggtcgcaaacgttccatactaggcagggaagccaaggtctcccctgctcgtgctgctggcaccatctttacatgagctataggacacggttacaggggggcataagatcacttcaccacaaagccacaggcactgggccttcactcattctgcatcctttgcctggcctccaacgcggccttgatgatgtttccacgcgtgatgatgcccaccagtcgtttctgatcatccaccaccggcagcctggtgggagggcaggtcggtggtggacgcaagaggttgtggacatgtacatcgcgaactcatctgtgacaatagacatgctcatgttccagcagccatctcctctcgcaggnnnnnnnnnntggtggtagacgcaagaggttgtagacatgtacatcgcaaactcatctgtgacaatagacacgtccatgttccagcagccatctcctctcgcaggacattccctccacgaaatacaaactccatccttaaaggtgacccacctgccaatgcgcatgcgcagcagcaggttggcagcgtcctcaatggtcgtggatgccctcacacagacagggtccggcgtcatcacgtcagagatactgtggaggttgtgaggggaacacgactcagggatggagatcatggtcttccagcagggggcaaccatcagaagttggagtggcttcacactccacaatttgaaagcatgctgagatccatatgcaacatccttcctcgtcccaacctatgccgtctgaagccctgcacgacctcacatttttcctgcattcttcagcannnnnnnnnnaatcatggtcttcaagcaggggcaaccatcagaagttggagtggctccacactccacgatttgcaagtatgctgagatccacatgcaacatccttttttataccaaactatgccgtctgaagcccctcaagacctcacatttttcctgcattcttcagcatcagtttctgcacctcgtagaaactgtcccaggtctcgtcagattccgggaagagggaagcatctatgtgagggggggggggggggggggggggggnnnnnnnnnnaccgactggtcagctgaccagcaagcactacgcttgcagcgaggctggccagtctcccattcagccaagaggtctgcaagcgcacaccctcacaaccagactcctcagnnnnnnnnnntcagctgaccagcaagcactacgcatgcagcgaggctggccagcctcccattcagctaagaggtctgcgagcgcacaccctcacaaccagactcctcagatccatatctcagacccttgccatcattaacctgacccatacccaggccgtgcgctcactctggcggcttgggctcatcccctcgagagccaggagatcaaaatcgctgacaacccccacgatggagttgttttggtccaccactggcagccccgtaatccgatggttgacgagcagctccagtgctgaggacatgacacaggaaaggggtgagactcttgcaaggtgaaggggnnnnnnnnnnnnnnnnnnnnnnnnnnnnnnnnnnnnnnnnnnnnnnnnnnnnnnnnnnnnnnnnnntattgtggagccacagacagcctagccccctccacaaacctttgtctacggttgtgtcgggtgagcacgtgatgataccgtcactggtcatgaaagaggccacgttggcaatgggcttggcttcctgtgcaggacaggcggcacaggagcaaagtcagaggctcacccttttgaaactgaggagtcgctggtgcacagcgctcgtcgatcagagtcaggcagccgctcctccctccaagcttaccgggggcgcagcggacacacgaagacgcgcctgcccagcgggccttcttcccacagcccgagtcggttgagctgggcccgtcggaacaaaggggcggaccagccaccggcaaggagccacgcccgggggaagcatggccacgtggcgagattttagggagtgagacattgagcatgtgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagaaatgccacagtttgctctttttaataagttatatcgtgtgctgggatatttgtggtgannnnnnnnnnggcacggccatgtggcgagagtttagggagtgagacattgagcatgtgctcccgcacagtggcatgctggccatggcttcaaggggcgagtagtcgggcacgcggggatcgctcagtttggactctccgccagtcgacgatacgcggtgcagaaaaatgccacagtttgctctttttattaaattatatcgtgtgctgggatatttgtggtgacattccgtgcgctggtaatgagtgatcttcagcgtcacgctgctgcagactggcgcgcgcgcaaaaaatcctccgtaccgtacaaaaatggcgctggttactcctgcatccccatttcagaacattcaacccgctccctgttggtcagacacgattgatccatccactggattcaacgaaatcacgttcagaagtgtcctagggcgnnnnnnnnnnatgttggtcagatacgattgatccatccactggattcggcgaaatcacgttcagaagtgtcctagggcgaagcacttcccttgtgtaccgggtgttgacatggtgtccgaggaagacgtccgtgaagctatcgcggcacacctttctgacgccgaggtcaatgtgacagacatctcaaatgggtgcggttgtgtgctggcgagaagggaggacctatgcctcctacttgatgcttgatttcattacatgacactagagcacatcctaccgccctggttccctcccgaccaacaggtgtggcaccggctttgaggtgcaagtggtagctcaagccttcgaggggaaacgcctgctagagcggcacaaactcgtgaacgcagcactcaaggacatcatgcccaacatccatgcacttagcatcacgcgggcctggacgccccagcaagcagcagctgcctgactgataacttgacaccttggagcgtgagtggcagcatgcttctatccctatgcaggcgctgtgtcaagcacgaccggtttgaactctgcctggcccagccgcgctgccgtttccttgcgccggcgtttggatccccggtggcagaccaccggcctcaagagctccacggagacgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtgtcagtgcatggacttctccctcatcccacagtgctgttccagggaggtagtctccatgnnnnnnnnnntggtttaaaatctgcctggcccagccgcgctgccgactccttcggccagcgtttggatccccggtcgcagatcaccggcctcaagagctccacggagacgcttcatcatagctccctttgctcatcatgcgctgcagccatccttttctcagcctgcgacagagggatttgggcgaggagcacctcgcgtgtcggtgcatggcgcgtctgcccggccccagggcnnnnnnnnnncgtaacaaccctctcccacctgctggagggcagggcctccagtctcttcaggatgtcgctgtatgttggcacctcctgctctatgcccagcagctggggcttgccattctcatccatgacgtgcagctgtgaagtgagagtaataggatgacgtgagctatgtagctgtaagggtgaaggggggcagcaatgtccccagaccccagccaagcacagcctttgcgggtcccgcactcagcagcggtttgcttgtctcttgaccggaatcacctgccaggtgctggggtagcttcggagcagccgcacatcgtcgccaaacacgcggtaccgccgcaggacgtacacttcctcgcaggtgccgacaaagcgctctgcctgcttcctcgttctcccaaagccaaaatctacgggacattcaattcagaaggactaggttgctgcaagggtccgccatcacaaggnnnnnnnnnngtctacgggacattcagaaggaccaggttgctgcaagggtccgccatcacaagggcagagcgtcgcaatgcctcgtcagcacctcttgccgactacgggaagatgctcggcttgaacaatcagtacacatgcactgaccctccctcccaaccccaatggagatgttcaatatgcaataagcacacccacctgacaccacctggccctctgactgccactgcggattgatgaagagaagcaatagcttcccgccaggttccggccgctgcgcctgcatctcatgcagcgtatcggccgtcacaaacatggccgccgccagacgcgggctgcgccacagcgctgtgaaaaaggaggaggtggtaacttggatgctgtgctggctggcaggcagtaacaacgtagcagcatgtgaccctggagggtggcaccggaaaccgatcatttcccccgtagtcccaagccctacggcgcggatcgtcaaagttgaagcctacctaccaagcaannnnnnnnnntgtagtagcatgtgaccctggagggttgcaacggaaaccgatcattccccccgtagtcctaagccccacagcgcggaacgtcaaagttgaagcctacctaccaagcaaaccagcttcaaagaacactcctcctcacccacacagtctggctcatccagccacctcggcgtcagcctgcccgccaggtctggatgcttcttcagcctccggaggagcgcttctatgagtgggagggccgacctgcactgctgcctgatgccgccgggccagccgcgcccctcgaccgtgttcaactgcatgtggagccaagggagtagggatggtgaggggacgcatggagaaggcaaggcacgtcatgctgtactactacaattccaatcaaagtgggcgagtgcatgccaagctgtacccgactcgtgagcggtacagcaccagggtaaatgtaaagctcaatctccgcagcccatgctcgccctgcctcatgcctgtgggagcaggagannnnnnnnnncggtgaggggacgcatggacaaggcaaagcacgtcatgctgtatcactacaattccaaccaaagtgtgggcgagtgcatgccaagctgtacccgactcgtgagcaatacagcaccagggaaaatgtaaagctcaatctccacagcccatgtttgccctgcctcatgcctgtgggagcaggagatgtaccacctgcctgtccacaccatcctcccacgccctgatgaccgcatccaccgcctgttgttagacaggggagatttttaagaagagaggggtgggtgtgagcaggcgaacattcagcctcggccatgacagctggtctcctgccggccnnnnnnnnnncaataagaagggggtgggtgtgagcaggcgaaaattcagcatcggccatgacagctggtctcctgccggcccaccactgtcctaacccagccagaatccttgtgcgcctatcaagcccccgcaaactataaaggagatccatgccacagtcatgctctgaaattatgcaagctctaaacacaacaccggcgcaggtacccagtacgcccacctggtcaatgcactgctgccagnnnnnnnnnnacatgcaagctctaaacacaagtctggcgcaggtactcagcacgcccacctggtcaatgcactgctgccagctggtaggcagggggagcaccaccgcagcctctttggggcctcctaaactagccctgacgctgaaacgccccagatttgcctccgtgaggtgatgcacggtgggtggggggggaagccggggacggtgctccccgacgctgcctggactcttgccattgctgccaggggtggctgcgctcgggccagttgcctcctgcctgccagtgacggagtgcatggtgtacgctatgaggaggctagccgactgctgctttggggacagccgatnnnnnnnnnntagtgacagtgtgcatggtgtacgctataaggagggtagccgactgctgctttggggacagccgatctcgtgtgatgctggctcatgtccaagctgcttgtgcttggcacaagaaaacccatccaatgcccaggctcaccacctaccgctgtgagctgtcgctggcctcggtagagtggtcggctcctgcactattgctgccgggcgacacggcgtccgcaggctctcgctccgtctcctcactcgccttcttctccgcccttgccagttggcatgtggccttgttgtggccgggcagtccgcacaccgagcacatctggggaccagagctcctcttcttcctcggcttggcctgcagacacaaggcgacggttgtgagaggcagaactcggcattcccggactgccggtgtagagactgtctctcccagctcacacgagcccagacactgcagccgtagccccaggtgtaggcctctgttgaagacccgtccatcgctcctcgccactcaaacaccctccctgaagtttgaatctacaccacattccacatccctcaccgggtcttttggctggttggaagggtgatcagggtggaggatggggcaggtcttgatggtgtgccccttctccccgcagtgaccacaagactttgggatgcccctcccggcgaagcggtactcggggttcagagcatggcgctggcgaatggcgcgagagaggtgcctggaaggaaagtcatggtttggggggaacatatgcaggggcgtacagtgtgttgagtctacaacaggggtgtttgtggaggcaagtcgatgcatggcgctccttctgctgtccctgaccaagctggacattccccccaaacccacccatctgcgcctggacgcccagataaagcaagatgcatggcatgcccatcgtgccatgcaatgcatcagccactcacctcttgtgagactctgacaatgatcnnnnnnnnnntacccatccatctgcgcctggaagcccagataaagcaagatgcctggcatgcccatcgtgccacgcgatgcaccagccgctcacctcttgtgagactctgacaatgatccctggtgccgcctccctgcggcaatcgcctgcctctgtgcttctgacatgaccctggtcctcttgccgctgcttgcaggctcctgagctgaatcccccccatttccaacccctttagacctcccatcttgctcctctgaatcgtccacggcacgtctagcggcctgctctgtcaaagcgcggcggatcacctgcaagattgtaggcgcgaggacaggtggtcatgtggagattccatgggcctgtacgtcatggaccactcgttgagctgacgggctggacatgataacctgccctgtaactcacagggctatggtaacgctgtggagcagatccaagacggaagctgggcaatgggcgcctcaagggaccagaggggccgtggatggcgaatgacaggtgcatgaaggcccgcagggcggtgtcaacaatcagcgcatgcagcgagggttgctgggcgggccatgcctctgaacacacggactgagtttggtcacatttgtgtgctccctcatggcgtccaccgctgccttcaatgatccgggcaccatggtcgctccacccgattgaggccccagggcgcgagaacccgagtcccggaggattgggcatctccccctcgatcagaacatgctcacatacacccacaatccccatgcgccatgctctttcgaatctgatggcttagatgtgtgattgcatacgtccaggcgtcagtgcctgatgctgacgcagcatgcctcgtgccgagtgctgcccactggtgcctggcaggggcgtggtcgcacctgcccccggcagagcattacccgtacggcatgcgtacgggatggaacactgtttcaatcccaaaatcgccggcagtggctgcagcgtggtagggcactggtccctctaccgggcaccttgcatgggggacccccaccccctcccctgagagggaccggccagtatgcgcatcaggcacgcgcctctgccctgcccggcatgggtgcgctgcacctcgtcaggagtcacatcgaacctggggtgctgggcgccgccgcgagcgtatcagtgaagctcatcatgatctgctctgtcgtcgcctggctgctgcgcaccgagaggatccccgccgacaccgccaccaccctgagcaaggttcctcctggagggttggggggaaacgagagtgggtgcccaagggtctggcagcttcagtcgcgctctcaggccgtttcgaacctttgcatggcggcccctgccacgagtccatgtgccgcgctgtcgagcctcgagtcctcgctgcccatggcccaggtatgagccttccacaccccaactccctccctgaccacgaatacccacccctttgcagctggcgtaccacctgctcatcccctgcctcatgtttgtgcgggtgtctggcacgctcagcaccatcgaatcccccatgctcctggtcagcatcgccggcgtggcgacgctgcaggcggccctgggcgccgcctgcggcctcctgctggggcccctggtggacggcgcctacccacgtgcctgggcggtgggcggctggcatccgctccgcccctcccgccccgccctggagatcgccgccagcctggcggatgccgcggggttggatcgcgcacgcgccgacgccctggcggcccagcccgcacccgcgcctcaaggtgtgtgctttctgggacagcagggggagtgatgatgccgaagggcaccctgcacctctcgcacccctgctgcgcaccacaccactggctgctcgaggatcccggagctctgcaccnnnnnnnnnncctggggcagcagggggagtgaggatgccgaagagcaccctgcaccccttgcacccctgctgcgtaccacaccaccggctgctcgaggatcccggagctctgcaccaccgatcgcgagtcggttgcccccaacccccaagagcacaaccacccaccccccttcccctcattctgccgatgtaggttcccgccagctcctggtcctcgcctgcgcgtttggcaattccttcaccctgcccgccatcctgctgagcacgctcttctccggggcgcgcgcggacgcctgcgtcggctacgccgcgctctgcctcctagtcctggacgggctggtgtggagcgtgggcctgggggcggtgcgcgccgcgaccccgggcgcgccccgccgnnnnnnnnnnaccccaggagcacaaccacccaccccccgaccccctcactctgccgatgtaggttcccgccagctcctgnnnnnnnnnnnnnnnncgccccgccgctccctgcccgaggcgctgcgcgcctcgctcaacccgcccatgctgggcatgctggccggggtcgcggcggggctgacccccctgggccgccgccacctggtgctgcccgccgccgg

SEQ ID NO: 34470 - DNA, 80 bp, Chlorella protothecoides
gttccaagcttgggccaggttgcctggctcagccaggactccagcaatgtttatacaccttgtgttggaagcatgcatcg

SEQ ID NO: 34471 - DNA, 70 bp, Chlorella protothecoides
agaggtgccatgtggcgggtcggacactggcactggcccgtcaccaccctttctgctgtttccggccttg

SEQ ID NO: 34472 - DNA, 66 bp, Chlorella protothecoides
tgtcagaactcaggaagtatgcgttcaagacctacaatcctccatcacctccacccaggcgcatct

SEQ ID NO: 34473 - DNA, 79 bp, Chlorella protothecoides
cgggcgtcgcgcccgaggagaggctggcgagcatcacccgtgcccagcgcgaggccctgctggcgaccctggcggggtg

SEQ ID NO: 34474 - DNA, 61 bp, Chlorella protothecoides
aggaagggtgtctaagaaccgcagcgcacggcccgatgccaacacgagcgggctgcaggcg

SEQ ID NO: 34475 - DNA, 61 bp, Chlorella protothecoides
gagccctgactgcggaagcggcgcaggcggtcgcagctgcggcacgatcccatggcgccga

SEQ ID NO: 34476 - DNA, 148 bp, Chlorella protothecoides
ggtttggcagtacaagggttacaaagcagccgcaggaaacccaatgctgacttgcaagaaacaatcatgagggatcgctctctaactgcccaagcttctttcccctttctccctctctccaaccccttccctcacctctgcgagcgtg

SEQ ID NO: 34477 - DNA, 126 bp, Chlorella protothecoides
attggcggtgctgcagagggcgctggcgcgataccaggccgcccatccccctggctaatctggactggagggacgaggttgacaaataggccctgtctgcttctgtttacagccggactttcactt

SEQ ID NO: 34478 - DNA, 61 bp, Chlorella protothecoides
gttatacttgacatggctcccgtcgcagagggggaaggtgcccgaacgccagcagcgacag

SEQ ID NO: 34479 - DNA, 67 bp, Chlorella protothecoides
gatgtctgacggcaacaccagtcccctctcctgtctagctaccatcaaaactttggactccatcctt

SEQ ID NO: 34480 - DNA, 175 bp, Chlorella protothecoides
gctgcgcagctcggatgaggagttggaatgtgctcgacacaggattggcactgggtgggcatctgaaggggcacactgagcaacaaactcccagtcggctatacgccccgccgtcatcacccctcgtcccggccctaccttcccccttccgcacgacctcagcacccaccccacc

SEQ ID NO: 34481 - DNA, 72 bp, Chlorella protothecoides
ttgcttctcaggattgtggtgggttgtggagattgggcctgcacgtgccgatgccatcctgccccgctcagc

SEQ ID NO: 34482 - DNA, 75 bp, Chlorella protothecoides
gggaagggaagggaggggaggagggggtcactgggggggagggggcctcgtcgggcctggttccaggcggcacag

SEQ ID NO: 34483 - DNA, 107 bp, Chlorella protothecoides
cgtgctgatgggagtgcactcgctgctggggtgcactccagttccaggcacctacaaattgtggctggataaggcactgcacttggaatggtgcctctaccctgcca

SEQ ID NO: 34484 - DNA, 93 bp, Chlorella protothecoides
gctgacacacctggcagcaggaagggacagagtatactggctctgcctgcacaccccacagagatgctacctcccccacgctgcaggtcctgg

SEQ ID NO: 34485 - DNA, 61 bp, Chlorella protothecoides
gatggtccagaaccccctgacatcggcagggggtagccacgacagaagagagcacacacct

SEQ ID NO: 34486 - DNA, 61 bp, Chlorella protothecoides
ggacggcatgctcagcagggtgtcgatggatctcgggtcggcggtgatgttgcgtttgcca

SEQ ID NO: 34487 - DNA, 66 bp, Chlorella protothecoides
ctgcgcaggctgcgcccaggcacgacacctcggcctccagcggcagacgaacctcctgtaccaggc

SEQ ID NO: 34488 - DNA, 110 bp, Chlorella protothecoides
tcccctcgcccctgtaccgcctgctggccgtgctggcctcctcccccgcctccgccgccgccgccgtagcctactttgcccgcctgcccggcctggccaccctgcaggcg

SEQ ID NO: 34489 - DNA, 7904 bp, Chlorella protothecoides
  modified_base (662)..(671): a, c, t, g, unknown or other
  modified_base (1763)..(1772): a, c, t, g, unknown or other
  modified_base (2569)..(2578): a, c, t, g, unknown or other
  modified_base (2773)..(2782): a, c, t, g, unknown or other
  modified_base (4325)..(4334): a, c, t, g, unknown or other
  modified_base (5245)..(5254): a, c, t, g, unknown or other
  modified_base (5444)..(5453): a, c, t, g, unknown or other
  modified_base (6873)..(6882): a, c, t, g, unknown or other
  modified_base (7564)..(7644): a, c, t, g, unknown or other
ctcgtcgccgacgcgcgcggcctgcgcgtcgtcgtcgacggcggcaaggacgcgtgctaccgcgcgctggccgcggtccagcgcgcttggggcgaggccgcgccgcacaaggactacgtgcgctcgcccaagcccaacggataccgctccctgcacgccatcctgcacgcgccggggggagggttggtggaggtccaggtccgctccgccaagatgcacttcctggccgagtacgggacggggactgcgcactggcagtataaggagggcggcaaggggctgagcaggcgggccaggaggcacgcccgccccgacgcgcctgtatcagaggcctcctgggccaagtaccgcctggcgcagcaggtacgtggcttttagcttgtgggtggggagggggtggcggggtggccggttcgagagcgtgtgcctgccaggggaccatgtcgaggggcccggtgtagttgcttcgttctccatggagtcgatacattcaatgttgtcgcatggggaagtcccaccctgttctcgcatgaatacccaatcctgcctccaccgcccatgctgccagtgtgaccccccccaaaccaccccttcattcgtgcagctggcgaactcgcccacgccccacgttgccagcccccggtccttctggggcctggatnnnnnnnnnncctgtctgacctccctgaaaacaccccttcattcgtgcagttggcgagctcgcccacgcctcacgtcgccagcccccggtccttctggggcctggatggcgcggtggccagcaacagctgcccgcccttgccctcggccaggccccaggggtcgccgcccagccctcccctggacgcgcgtttcgaagcctacctcctggcctcgggccagaagccggtgccccccgccccggagcgcgtactggtgtgtgtggttcggccggcgccggccgcggccggcgccgcccccgccgccccgctcccggcctccgtgctggaggtggaggccggcaccaccctggcgcggctggccaagagcctgggcggccgcgtcacggtcacgcgcggcggcctggcgctgaacagtgcagccggcctccggctctgcatgggggacatggtgaggctcgtgcagacaacagcccccgccccggtggtctccaacccaaccctgccccagccggagcccctggccgcccccccgcgcagcagcaacaccgtggtgcccttcccctttcccaccacgctgccgcgtgtggcgaccaccccgtccacggcagtggccgcggcgtgatgagaaggagcgacgccgattgtatccccggcctcctgacgactgtgccataccagaccatttgattccaccccgttgcctcctcaaggagggccccatgtatgaccctgtaccactagtgctccctcgtgtaccttgccacaacccctccctctcgagcaatgaaccctgcatgagcttctcgctgcacctgttgtgcatggggacgccccccggcgcagctttgggggtgctgacatgcggacaaccttcttcccatacgtgtatagagtttgatctgatgcgctgactttgtctcactagcccaacatttgctcgtctcctgtaagatggtctgtctcgatggtcaggagcgtgggcggggggaccgagtgcttgcgtggaaaatgtttgaacatgagtaagcatgctgacgtcccagcgacatccgcacacgcctgcccccgctccagccggctcgccttctgatgccagctgtnnnnnnnnnnggtgcgcgttaggtattcggctgcagcaggaaccctcgaaattccgtcaaatggtacccccgggcgcgcgccgtacctcccctcggcagaaagcgatctcgcacctaccgggtcccgcagggcaaagccttgcgatgcaaaatcacccttcgaaggtcgtgttcaccactacaaagaggcatatctgcttgattgtatcgtagaaggctgagccagtgcgctgctggaggaagactgggctcgccatgatcaagctcttctccctcaaggtaggcaaggtttcgagcgggaggtttgctctcggaaactgctgctcagaccttgaaaatacgtcattcacaggagaagcaaaagcagacggccgctaccgggacaagaaccctcaagcagtccccaggcgagctcaggctacagaaaggtccgtgggctctggacaacattcgtagccggagtaggaatcagcccttcgctgtcgctgatacattaccttgttcacgtttcagacttatcggagctggacctacccagctccgtgaaaatctccttccccaatggcaaggagaagatcatgagctttgatgtggtgctgacgcctgacgagggcatgtaccggtgagctggtggctacatggaaaatcactctcgagccgatggctattgctgagcgcgatgtgttccagtatcctctccaatccaacccaggggaggggcatttctctttaccttcaccgtgccaccaacgtatccacacgatccaccaaaggttaagtgcctaacaaaggtgagtggctcgaccnnnnnnnnnnttttaccttcaccgtgccaccaacatatccacacgatccaccaaaggtcaagtgcctaacaaaggtgagtggctcgaccttccagcaattatcccactatagaagagttgatgcttggcatgcaagcctgaaaatagatgtccagaaggaatcccttcttcccgtccgcccctgcaggtgtaccatcccaacatnnnnnnnnnnccatgcaagcctgaaaatcgatgtccaggagtaatcccttcttcacatccgcccctgcaggtgtaccatcccaacattgacctggagggcaacgtctgcctcaacatccttagagaggactggaagccagtgctcaccatctcttccctcatatacggcctcaacttcctcttcctagtgcgtggagttggattgcgctcggggcggggtgtggagattgcgctcctctttgcctggtcaagaggcatccatattgcacagaggctggcgagcatcaagccgagtgccctctcccatgcaggcaccaaatccggacgatccactgaacaaagaggcggcagaggccatgcagaatgcgccgtctacatttgcacggcacgtttctgtgaccatcacgcggggaggcaccatcggaggggagtacttccctccggccaggggaacagcatcaggacatcacctgtagtgaggcctcggggagacgctgcagagccttgccgcacacttggcggccctgtgtctggcagtgaggtgcaaggctgggtctgagctcaagtgccctgacccatatgctggagcatttgaccatgagcctacgagcatgggccggtgcttgaatgccccactcccatggcaggcaaggaagctaggtgtactaagagcttgtacagaacattcgaagcagactcattttagagaatcccactccggtgcaagcaggggctcggaacgccctggcacactgtccagggtaggtggccaacactgtgcgccctcgaatacatcacaatgtgggctagtatatctcaggataccaagctgataaagcaacatagtcttccaggggcctgactcgactgcagcaagagtctcgtacataaggcccggcagacttgagctcataaaaagaagtgctcaaggattcgaccccggaaaaaacgcttgccggccgagaggcctagtccgcccaggccgacggaacctgtctctttcacatcgctggtaactcgggcggcagttgtcagcaaccatggcggacgagactcacaccaggaagcgtaccttcaggaagtactcctacaggggagtcgacctggagcagctcatggacatgtccacggatgagctggtggagcttttcgccgctcgccagcgccgcaggtacgcattgtcacacttgggtgttgggaggaaggtggagatgggattcaggagcgtcccacacagccgtgcacgtccggcgactgcatcgccgagtcgagctccatgcggggagctgtgtgggtgctcggagatgcagctcgtaatttcgcgactgagtcataagcgattggagtcctcggcggcctgcccttccctggcaatgcccttggcgcacctctggacctgcgacactttgagggcgctggcagccagtgcagggctgccctgccctcccacatcgcaactcgcccgggcccaagatgagcttccgcccagcacgtctgacagatattcgcgcccttcccacctccccaggttccagcgcggcctcaagcgcaannnnnnnnnnatccgcccagcacgtctgacagatgttcgcgccctttccacccccccaggttccagcgcggcctcaagcgcaacgctcttgctctgatcaagaagctgcgcgccgtgaagaaggacacccctgccggcgagaagcccgaggcggtgcgcacccacctgcgcaacatgatcatcctccccgagatgatcggctccatcgttggtgtgtacaacggcaagaccttcaaccaggtgcgggccggggtgctgcagttatcgtgcactgccggaggaaagggatcaagtccctggtgaccagggaccagggctccccctgttgcattctcctgggcaggcttgcattcttcaacaaatatgaaaagccgccgcaactatggattccgtgactgattgtcgacatgcagcctccaactgtccctcggctccatctcccaggtcgagatcaagcccgacatgatcggccactaccttgcggagttctccatctcctacaagcccgtcaagcacggcaagcccgggattggtgccacccactcgtcccgcttcattcccctcaagtagatttgctgcgtgctgcgcacctgtaaatcctctcgctgccaagtttatcgcggtctgtgtggcggaagctgggagttacagtgaaagggcaccagggtagagggattggctgcccaagggcagagcgtcccagcacaccgcccctgggctcggggatgataggtgcctagccgcattcgagccgtcagcttgaatcgagcgggccctccaatccacgtgctgccacggtctacttgctcttgtcggcctccagcttgttgtagaagtcctggcccatgcgccacaggacggagaagagcaggccctgcgtgggggggtggtgcgatggaggttgggcggtctgcagggctnnnnnnnnnngagcctttgcatcactttgacaaacgatcgagtattgtataccaccgtcgggcctctgctccggcgtcctcggtctcagggctggtcgccatgtacctgcctagcctgcacccaggatcgctttacaggacctctgagtctgccaggggcatgggatccatgcccagcatggcttggcctgcaagcacannnnnnnnnncaggacctctgagtcttccaggggcatgggatctatgcccagcatggcttggcctgcaagcacacaggcctttagcacccctatcgtccctgccctcgcgagtcagcctgggtactgcgaggcatttggcacccgatcacgccccggcctgcgtgatctggttcccgcggtggcataccagcccagtgaggccactcccctgtcacaagtcctgcgcaacgccggaaagaaggcgcttggcggtggcattcccggagccgctgccatgggcatccaggtggtgtccctcatgtggctgcgcaccacagtcaactaccagtaccgatgtgaggactgagggatggggcaggtgggagaatgggtggggtcagtggtctggcatcgccgtttggttccaaggtctagactgccatggggtgagctttggagatgggtggcggcggccagtgccaagacgcccagtctccagccatagctggtctggtccaggggaatgataccctgaatgcacggccagcgcatcgtcttgacagacatgatcctgcacgccaccctgtgccaccccccgcccctccccgcagatggcatgaccaccacggccgccatgaagacgctgtacaaggaggggggcgtgctccgcttctaccgcggcgtcggccccgccctcattcagggccccatgagccgcttcggggacaccgccgccaacgccggcgtgctcacgctgctcaacgagtcggcgtccaccaaggatctgcccatccccatcaagactgcagcggcgtcggcggcggcgggcggcttccgcatcttcctcatgcccgtggacgcgctgaagaccaccatgcaggtggagggcaagaacggcatccccatcctcatgtccaagatcaggaccggcggcgtcagcgtcctgtaccacggagctctggcggctgcggccgccacctgggccggacacttcccctggtgggttggcagcggtgggctccactgcatgggttgccgggggggtggcttgaggttgaacagtacatcttggaagtcttagatgagggcatctatactctgggttcaagctcttcagcgttgctgggagctgcattggagatgttgatgtgtgcaatgggaccaccgcacccaaccagcatgatgatcatgctgccctgggatagacagcaccttgctcaaactagtatttgttcagaacatctctcctgcgatatgtgctcctctggctgattgcaggtttgcgacctacaactacctgaacgaggtcctgccccaggtatgtcttgctgcggcaccctgcattctgggtttgtgactgtaccccatgtgaagagcggctgctgctgtgctgcaatgaaaccctgatacgcacctcacactccccaccctcatgatccacgcacacaannnnnnnnnnatgtgcaacaccagcggcccacggatcatggagacggcgcagcgtcagatgctgacccacctggaggccattggccaggattttggtcttcaggccccggcccatcaagcccaggatgccgtcctccttgatgaccatctgtcgcgagcgtgcaaggccgtaagtgtgagcggaagcacctgccaggagcagcaggcatcagaaacccatgcagcgactctgtgcaaggcgatcccgcacaattggctgcccttgccttgagcacttcggggtacgtcatgggcacagcagaagtctgcttggtcgtcttcaccacacggatggagttggacacggagtctgtggaaagggagggaggccaaaggccgggcgactcagggtgcctttactgtgtgctgcagggtcggccagcgcagggaccggtgcaaggtcctgcagcaagcagcacttaccagagatggcactggcacagaagccgatgacggcagagcgacccagcttccttgggagatcggtgtactgcagaaagggtgattgtgtgcgtggatcatgagggtggggagtatgaggtgcgtatcagggtttcattgcaggacagcagccgccgctcttcacgtgtagtacagtcacaaacccagaatgcagggtgcagcagcaagacatacctggggcaggacctcgnnnnnnnnnnnnnnnnnnnnnnnnnnnnnnnnnnnnnnnnnnnnnnnnnnnnnnnnnnnnnnnnnnnnnnnnnnnnnnnnncattctgaacaagtactagtttgagcaaggtgctgtctatcccggggcagcatgatcatcatgctggttgggagcggtggtcccattgcacacatcaacatctccaatgcagcccccagcaaggctgaagaggttgaacccagactatggatgccctcatctgagagttgcaagatgtactcttcaacctcaagccaccccctggcaacccatgcagtggagcccaccgatgccaacccaccaggggaagtgtccggccc

SEQ ID NO: 34490 - DNA, 152 bp, Chlorella protothecoides
gagaggcaggaaagggcagggagtggagtactcagcctggcacttgaacaatttgtgtctggatggttggaggagctagccgctgggttgcttcgtccctgcgctgttgatgtgtagtgtcaaacgctggagttttgccgatgacggggctt

SEQ ID NO: 34491 - DNA, 2557 bp, Chlorella protothecoides
  modified_base (177)..(260): a, c, t, g, unknown or other
  modified_base (338)..(347): a, c, t, g, unknown or other
  modified_base (907)..(916): a, c, t, g, unknown or other
  modified_base (1119)..(1128): a, c, t, g, unknown or other
  modified_base (1968)..(1977): a, c, t, g, unknown or other
gtccccgcccccagtcgtcttcccgccccccccgccctgggtggacccgctcaccgtgcccccactcctggcctgcccctgtgcctttgacagcaccgtggtcaagtgcacctgcaccgtgctcacccagttcctggccgaccatgcgatgctcaagatatggacggcggggggggnnnnnnnnnnnnnnnnnnnnnnnnnnnnnnnnnnnnnnnnnnnnnnnnnnnnnnnnnnnnnnnnnnnnnnnnnnnnnnnnnnnntcgtgacgctgtcgcccaacatgccctcccccccggcaccgccaccgcccccgctcccgcccagcccgcctccgctgnnnnnnnnnngacgagagggagacggtactggggcaggtgtacatggtgctcaacagcctggtcgcggggctgccgtccaacaccgtgacgctgtcgcccaacgtgccctcacccccggcaccgccaccacccccgctcccgcccagcccgcctccgctgccgccctcgccgccgccctcgccaccgccctcgccgccctccccgccgccggactcgctccccgcaccggccctgcacgtcgcctgccagggcatcctggggggcaccctctgcacagccaccgtcaccatcttcgacctggcctccaggacggagctctacatccacaacgcggacggcagcctgcacaccggcatcttctggctggccaacgcggtgacctcgtccaggacctttgtatcccaccagaacaaccagaccgccaccgcccgctccttcctgggcagccggacgtcccagatgtcggatgccgtggtgttggcgccgtgagggcgggcaggggggaaccctcctcccagctcagcacctggtggggggtagaccctgcctgaattcccaggcccatgcannnnnnnnnngagcccttatatcattcattcttgtacttccttagaacctcaacatgccctctgtagatttttattgtgctcctgagcctttccgtgctgacgtgtactgcccgatgtttgcatcaggttcggtggcgaccaaagaggggtgtgcagagcttcgcgtgcgtcaaccttgccagcatgcaccacaaatcgtgccgtccatgagnnnnnnnnnncggggaaccctcctcccaccccagcacctggtggggggcagaccctgcctgaattcccaggcccatgcagtcagcccccttctccccccctccagcagccagccagtccctgggagtcttgctgaacctcggccgcagtgtcacctgagacgcgatgcaatgggagtaacaaaggtcgccagcccttatgtcattcattcttgtacttccctaaacctcaagatgccctctgtagacttttgttgcgttcccgagccttcccgtgctgacgtgtactgcccgatattttcattaggttcggtggcgaccaaagaggggtgtgcatagcttcgcgtgcgtcaatcttgccggcatgcaccacaaatcgtgccgtccatgagctcggcgcgaggcggggcccgcgggcgggcggtggagcatgacggggtttggcaaggcctggtgtcggaggacgatggcaaggtcggtcgatcgccgggagccacggcctgacaatccatgcccatgctagtgtacctcgccgattctaacacaagtcgagtctccctgcaacaggcgaccatctccctggagtccctcctccgtgcccgtcgcgttccccagacccgtcgggcggtctcccacctgctagcctgcctcggcaggcatgcctgtgacccccgcctgggccccggggtgtggcagctggctgccatctggctccggcgcctggagctggacgcaggtgggtgcctttggtggtggctggggcgtcttccagatcacacgcaccattttggagcagcagctttctcaatacccttccactacacacctcgcgatcgcccctcccatccctcnnnnnnnnnngccagatcacacgcaccatcttggagcagcagctttctcaatatgcttccactgcacacctcgcgatcgcccctcccatccctcctcaggcgagcaaaaccccaccgacccagctgcgcgccaggtggcgggcatggccctgggcctgctgcgcagccccgacgcggctcgcctcccggactccctcttctccgccctggtgctctgcgccgggggggcccgggcatggctggacgccgccctcctgcgtgcctccctggccgaggccctgatggcccgtcccccgccccagtcctgggccagggcggggctggcagtgcacggcgcggcggctgcgctggagggcggcggctacgcgaccccggcgggggcctggctcctggccgcgctcctggcctgggtcgagggctgccccacgcccgcctccttggcgcccgcggtggtggacatggtcgggcgcgcggtggcggacaccggcggcgcgctgctggcgggggtggggactggctggacgtgctcagggcaccgcagcgcggcggcgcccctggcgctggccggcgcggcgctgggcacgccgggc

SEQ ID NO: 34492 - DNA, 71 bp, Chlorella protothecoides
ctgagctcaggggctgtgcaagaccatggtatccccagaccacccttcatcactccacgaatggcagcaac

SEQ ID NO: 34493 - DNA, 78 bp, Chlorella protothecoides
ggcgccggccagctggtctgcccgggccgtgagggagtggtgagtcaaggggatgggggggggggggggggggggggg

SEQ ID NO: 34494 - DNA, 19327 bp, Chlorella protothecoides
  modified_base (116)..(125): a, c, t, g, unknown or other
  modified_base (303)..(312): a, c, t, g, unknown or other
  modified_base (1030)..(1090): a, c, t, g, unknown or other
  modified_base (1329)..(1338): a, c, t, g, unknown or other
  modified_base (2018)..(2027): a, c, t, g, unknown or other
  modified_base (3695)..(3704): a, c, t, g, unknown or other
  modified_base (5042)..(5060): a, c, t, g, unknown or other
  modified_base (5128)..(5137): a, c, t, g, unknown or other
  modified_base (6665)..(6674): a, c, t, g, unknown or other
  modified_base (7124)..(7133): a, c, t, g, unknown or other
  modified_base (7606)..(7615): a, c, t, g, unknown or other
  modified_base (8637)..(8646): a, c, t, g, unknown or other
  modified_base (9075)..(9084): a, c, t, g, unknown or other
  modified_base (9184)..(9193): a, c, t, g, unknown or other
  modified_base (10428)..(10437): a, c, t, g, unknown or other
  modified_base (11144)..(11153): a, c, t, g, unknown or other
  modified_base (12572)..(12581): a, c, t, g, unknown or other
  modified_base (12957)..(12966): a, c, t, g, unknown or other
  modified_base (14562)..(14571): a, c, t, g, unknown or other
  modified_base (15006)..(15015): a, c, t, g, unknown or other
  modified_base (15573)..(15582): a, c, t, g, unknown or other
  modified_base (16597)..(16606): a, c, t, g, unknown or other
  modified_base (16697)..(16706): a, c, t, g, unknown or other
  modified_base (16779)..(16788): a, c, t, g, unknown or other
  modified_base (16875)..(16884): a, c, t, g, unknown or other
  modified_base (16971)..(16980): a, c, t, g, unknown or other
  modified_base (17130)..(17199): a, c, t, g, unknown or other
  modified_base (17595)..(17604): a, c, t, g, unknown or other
  modified_base (18303)..(18312): a, c, t, g, unknown or other
  modified_base (18909)..(18918): a, c, t, g, unknown or other
cagatgctgcctggcacatggggtcgggctaggcgtcgcatgcctggtggtcgagcggacatgggcccatgcgcccaggcctaggaccagtttgcagacacacaccccgccccgtnnnnnnnnnntggcgttgcatgcctggtggtcgagcggacatgggtcgatgcgcccaggcctagaaccagtttgcagacacacaccccgccccgtcctccagggcgccaccgcgccgcacctggggcaccaggttcagcgtggagcgcatgtggtgtggccccgccgaccccttgtccctgaccaccnnnnnnnnnnacgccgcacctgggggaccaggttcagcgtggagcgcatgtggtggggccccgccgaccccttgtccctgaccaccaggggggtgctgcaggggggcgggatggagtggtccccgccccgccgagtctcaaacacctgcattcggccggggcatgggtccgtggctggccggagggcaccgtggcaatcaccgatcgtcttggaagccgaatcagccacggacatgcccggaacaagaccagcccccgtgcaactcaaaactctacatgcctgttctcagccctgccccagcactcccccccagaaccacccaccatctccagctgcggtgacagggccgggcgggggtcgttccgcttggcaggcgcaggcgcgccaaagtagccggcgccggcggctccggggggggtgcccatgcgccccggcgcaatcatctgcgcagccgggctctgcccagtatacccctctgcaggtgggggcccgggggcgccgggcggccccggccacaggggcggggcccccgtgtaccctggcatgggccgggcggccagcccgccgcgatgggcggggccagcgctcgcctgcggggcgccggcaggaggcccccggccggggacgaacccggcgggcacgcccagcccgtggtgcgcccggggtggggtcgcgacgttgaccgcgagcgggggcgggctgaacgcgccctgtggcggctggcgcnnnnnnnnnnnnnnnnnnnnnnnnnnnnnnnnnnnnnnnnnnnnnnnnnnnnnnnnnnnnncggaccggggtggagggtgggtatgcgacgcggctgacgctgggctgggcgcccgtggcaggagggggtccctcctgcacgccggcggcgccgctcgaagccaccctgccgggctgggccggcgcctgagggcgctgggggccagtggcgggcggctgcccgggacgtgtccctggctgctggccagagtaggcccccagctgctggacgccatacgcccctggctgctggccgccatnnnnnnnnnnatccctggctgctggccagagtaggcccctggctgctggccgccgtacgcccctggctgctggacggcgcctgaagtacgcatcgcgcccggggccatgcgtggctgctggactgcatgaggtgctgccgctgggcctggtgggtatggcctcgctggctgggcgacttgctgtccaggctgggggttgtatgcagggatgggccgagctggacctgcggcgccggaggagaacacgggagcaccaggcgcgggagcgccaggccggcctggggcagccaggtgcgccgcatgctgcggtgggggctgcggctctggcgcaggccccttaccgcccaggtttagttgggcaaaccgagggggtacagcaccgagcggggtgccggacactggaggagctgtggaaggatggaatgatacctcttgtggctacagcaaacaaaaacgtcccagggccgctgcagagtcggaccccaggtcaggccgtgcatgccatgcgactgtcccaaggcgcacctgcacctccaacgccaggccaggccgggccaggttgaccattcgaggggggaccaggaggtccagacgggtactgcatgaccttggaagaggccgagcttccagctgtcgtcctggggtcgagatcgccacctgtgctgtgacacaccagcagggtgatccagnnnnnnnnnngggccgagcttccagctgtcgtcctgggttcgagatcaccaccagtgctgtgacacaccagcagggtgatccaggcttcaccaccggacgaccgtgcaccgggcactgatcgtgcggaccgatacctcagtcagggtgcatctgatggaccggatggcgatcgcgggggatacgtcctccgggcaggcttccagtgccctggattcctgcatcacacgctggtgcgctcagcattcgtggaagcaccgtttcccgcgcggaaatcgtgagcttgcgccatgcccgttgcagggggctaccgcggagcactcgaacgctccatgaccatttccttaccacaagcagactcttcaggcgcccccccgctctccaggcaggactgacagtttcgacctgagcaggccaaggactcctaaccgagttccctgggtgcgcgctccggctccaggcaccccttccccacaaactcgacagcaatgtccaacccggagtatgactacctgttcaaggtgcgcgcgcgtagccctagtggcaggccgcgctcacagatcgctggcccgctgtgtttgacttgtgccgacaacgcgtcaccccccatccctgactcgccgcagttgctcctgatcggggactctggagtcggtaaatcttgcctgctgctgcgctttgcggtgagtgcggttctggcacgaagccagcagcttcccgttgcttggggcctgccgtgagggagagcgtgagggtgtcgagcacccctgcacccgacagcaagggccctgaaacaacccatccccgcaggatgacacctacacagagagctacatctccaccattggcgttgactttgtgagcattcccttttaggggagaagggtttagcgcaggccttgtagcgctgccagggtttcagagtgcttccgtgcatgtgcttcgggcacactggcaggacctggctggccctactctggggcatcagagcccatgcctctgaccccgtcggggcctttggggaccaggaagcgctccctgccaccctcctacatgctcttgtgtgattgccgccaatcgatccccacctccccctccctccccagaaaatccggacggtggagctggacagcaaggtgatcaagctgcagatctgggacacggcggggcaggagcgcttccgcaccatcaccagcagctactaccgcggcgcgcacggcatcatcgtcgtcttcgacgtgaccgactctgagtcctttgacaatgtcaagcagtggctgaacgagatcgaccggtacgccaacgagaacgtgaacaagctgctggtggggaacaaggtggacctggtcggcaagcgcgcggtggactacgagacggccaaggcgtttgcggacgagatcggggtgccctacattgagacctccgccaaggccgccaccaacgtcgagcaggccttcatgaccatggcaggggagatcaagaataggtgtgtgagggggaaagggggcgatggagtgggggttatgttcaaagggatggtttgaggagagggggggaagtgctctgggcagccagccaagaaaagagccatggctgggaggggcgtgcaataaaaaacacatggctggggcagcagttcagtgttcgcgatgcgggaggtgcctgcagtgcagatgcccnnnnnnnnnnatgttcgaagggttgggttgaggagaggggggggagtgctctgggcagccagccaagaaaagagccatggttgggagggcgtgcgataaaaaaaacatggctggggcagcggttcagtgtttgcaatgcgggaggtgcctgcagtgcagatgccctcaccgccgccccgcgccttgcctgaccaccccagaatcgaccccctcggcatctgacaggatggcgagggagccggcgctgaacaagcccgcaaacacgatccggcccggcgacggcaagtccatcgccggcaacaagagcagctgctgctgaggtgggtggccgccaacgcgccggcgcaaggcgcccaggagccctggcgctttgctcgactcaatacggtggctgcgatgcacccatgatgactgccatgtattcccccacaccatgcccctgccgccgcggtcgacacatgtgaaccacgatcgccgacgacacatgcgaggggactccttgggggggcctgtccatcgaagccctgctcgttcgtgcgctgcctgagactgtttgggctaagtcgacacagaaagagcgggacatggggagcagagcgggacaacaaaatgcacaatggaaagcacggctcgtgggcatcaaattttccccccgaagtccgttcgtggccgccaccacctcgccttgcggcgccgccaggtcggggagcgccacgctgtgcatcccgccctacaccctggcccagctgtctggctgctgactgctgcgccgggcgagggtgggcggggacagcgaccccggccagccctttgccacctcgagggtcctcgggggcaagcggagatcggggagggaggtttgggtggacatgggctgaggcgtgccgggtgcaccagccaccagcctccacaggcggcgcgccacttgcacataaaacttccacggcgaagcttggtggtggcctggagggggtgtcaagggaggtggaaggggagccggcaggaagatttggatgggttggcgagggtcatgggcgagcgcccatgggtggcaagggctgggatgggctggcagggagccaggcgtctcaggtggtgcaccaccgtctgacagtcacctcccacgcatgagcgtcgaggtgggggcccagcaggctgcaagcagagttacttcctcctcctccccatccccactgccctcctgcataccaatgagtcattcggtcttgcccttggctgccctcctgccgtatacaaggatctgggccagcacaattgcgttcagcagtgtgcctgccaaagacggggtaaggaagggcttgtgggagagttcaaggcagagaccatnnnnnnnnnnnnnnnnnnntcttcccacaatgttccaagctacaggcccccatgccgcagaggcgcctcagtgctgccaggccctcnnnnnnnnnncagcatcacccactgcctcccagcagagttgggtgaccgagtcagggaccgaggtatggagggcttcccacaattttctaggctacaggctcccatgctgcagaggcgcctcagtgctgccaggccctcgcctgcatcccacagcgccctccaggaggagtgcctcaccccagccaaaaaacaaaatcgccgctcgacccacccaggatcgctccctgcagcatggcgggacccgccttctcgtgaatggaggtgaagatgcgggcccccgccccagccacgttgagggtgtaggtgatgctggacagctgccccgtgctgcccgcctgcgcgctctgcacgatctggggcacgcgggaggccatgaagagcaggttgttgaagctcagggcgagggccaccttgtcaaagggcagcgcgcccgcggtcagggccgccgcccaccccgccagggccaggaggaggcacagcgtgcgcgcggcagacttgcgctggtagtggtagatgagaacgaggagcagggcgttctggagcagcatggcctgaggtgggaaatgacagggtgtgtcgagggtggaagtggggctcgcaaagtgggcaagggtgtgtgtttgcaaagttgggggtgccctgggagagaccatcgacaccgcaagttcatcagtcccgtctgtaagctcgtcggccaggacacaaggcattcccatgcttctggagtcgatccgtaccatggtctcgccgtaggcactgaagggcagctgcttgaggaggccataactggcggagatggcgtaccccagcgtctccagctcgaccgatagggagctgaggccagcagcgctgcgtgcacgcacgacattgatcagttgcggcaccttgacgacagtggatcccaggaggatgcagtaccccaacccctgcaaagttgcgagagggcaatgggggggacggaattgggtgcggaaggggtggtgaccaggttggtatctgagggaaggcgtctgcagtgagggcttaacaggagcaaaccccacttcagcacagaacacattccatcatttaccctgctcaggagcgctttgaggagtggggacgggggaatgcggccatttccaaacagctcctcgaacgccaggcggaggaggacgaacagtgatgcctgcctcgggatctccatgcttggagcaccgccacgatcagattacgcaaagaggtagtgcaaggaccagagttataaccgggaagacgggcagggggttgccttgtgaacgaggtttcgggcaagggtcgtgacgttcggcgccttccggtctggatccccctggcaccgaaaggggtgtgatgcttgaaaccgcccgcactttctcaacacaaggacataagtgtctttggcgacacatcagatatactcagagcattcgtgccgacccccgataattgcatcgtcgccgtgtccctgattgtgcttgccgcaggaacctgctgtgccccactgaggctgcccttgtctcaagtgggcgcccatgcnnnnnnnnnncttgcatcgtcgctgtgtccctgattgtgctcgccgcaggaacctgctgtgccccactgacgctgcccttgtctcaagtgggcgcccatgcaagatgccggacccgatgccaccatagatccactgcgtcagctggaggacaagctggatgaactactgacggggctgagggagcagacaggtcaggctcaagcgcaaactctggaacacctggcctgctacagcgagagtctggacgagttgcaggtgatggggccaggaaaaagtggtgctcgtagttccaagcatcatttgggtcgggccctggaaggctgaggtggcaatgcaatactctgttagtccttcaggactgacatcaagatatgatgcaatcagtcgcctcatcggctgctcttctattcaactgttttcttttacaaccccccgcatgcacaatccaagcaggcagcnnnnnnnnnncccttcaggactgacatcaatgtatgatgcaatcagtcgcctcttcggctgctcttcgattcaactattttctaacaccccccccgcatgcacaatccaagcaggcagcggtgaatcaggcattgtatgcccagaagctgctggaggagtctagccggcgggcctccaaaggacttgagagggtggacctgcttgccagtcaattagctggtctcaaagaaagcgttgggcagcttgaacaggccgtagcatcagtcctgtcgtgatcagaatgtagcatagtcgtagcattgtgatctacttgaggacctttgtggagtggagctgtggctagcaagtgctcagcgcgctctccgacgacgatgagcaccatcggcccctaccagtgcactttcgcattctcatgcggtggcctatatgctatattactagatgtaataagcctccctacatgcccgactgtagcacgcgcnnnnnnnnnnaattctcatgcggtggcctatatgctagattactatatgtaataaacctccctacatgcccgactgtagcacgcgcaatggcgtcagtactggtcagtgccggtgaagtcgagtatgtacggagggggttcgaggccggcgtccgtggcgatgggcgggggccactcgacttccggcagatagagatcgagacgggggtcatcggccaagccaccggctcggcgcgcgtgcgtctaggcaccaccgacgtcctcgtcggtgtcaaggcgcgccaccctttgggttgggtgcaagggtactcaggcctagcacttcctgtgcacctgcttgcatgcaggctcaaacctcctgccggctcactcatgacaggcggaggttggcccaccagcagagggcgcgcccaaccagggcaggatatcctttgcgacggagttctcccccatagccagccccagcttccaggggcggggcggggaggagctcgcctcggacctcaccgccatgctccagcgcacattcttccgcagccccgtcagcgggagtgagctgagaggggtggtagagggctacaagtggggctggtgtagtggattggttttggccagccatgtggagggctattgtgatgaatgttggaagccatcgccagaccaaggggtgagggaggcctccaaccctcctcctcacccaccacacggccttgccatgccatgccgcggcgacgcaccacagccacctccccctgcttgcaccctccgcaggggccggcctggacctcaccaccctcagcatcgtgtctggcaagtcttgctgggtggtgtatgtcgatgtcctggtcctcgctgtcgggggcgctgtggtcgacaccgcctccattgcggtcaaggtgcggctggtgctcatgatagggaggggcccggcctcagctcattacccgcgacagcccataggcatcggggccggtgcaggatgtgtgcgcagtgccacctcacccccccccccttatagtatacttcccatcnnnnnnnnnnaacagcccataggcatcggggccggcgcaagatgtgtgcgcagtgccacctcatcccccccccccttatagtatacttcccatccaaacccaaacaggcggccttgacggccaccctgctgcccaagatcgagatggtggcgggggaggaccccgaggacgagcccgactacgagatcgacgatgaccccagtgtgtccgtcccgctggacacgcggtacgtgcccctgaccctgacggtgtcccaggtgggcgtcactccagcgctggacctggacctactagaggaggccagcgccgccgctgcactgtcggtgggggtggacgccgagggcagggtggtgggcaccacgcagcggggagcgggcgggatcagccccgagacattactggtgaggcaccagaagttcattttttggggggggggggnnnnnnnnnnccagggacctcgagtggcagttggtgtccaggctgaacactgcttcccaagacccaagcacccttgccacacaggacatgctggacatcgcagagcagannnnnnnnnngccagggacctcacgaggccagttggtgtccaggctggacactgctccccaagacccaagcacccttgccgcacaggacatgctggacatcgcagagcagaggggcatcgccctgcatgccgccatcgacgcgcacctgaccagacagcgggcgaatggtatggcctgaggtgtggcacctgttcagcaccccccttcctccccggtgccccggtctggcgaagatgtccgggaccgcggggtctcggcgtgcctgattccggcgaaggaacgatacatacccaggcacgatcaaacctcttttgcgtgaccgatccattgtgaggcacatttgtaagaggaacgacatagaatggagcgcgcgctcacctccatcctggccctgggcctgggcatcaccatcgggcgggaactccgccgctggatctcggccccagggacggaagaagatcccctgagcgtcgtatctgactccgcgagggtcatcgctggtgggtgcctgcatcgtgtctcccgggtctgcaggatgcgggtttaacactcgtactggtagcactggcctcctggttgccccggagacagagagtcgggtttcccttgccaccccgcagcatggagggccttggaggctgaggagccagagcctctggtctacgatgaattcgctgtggcgctggcaggcccatcggcgctggcatcagccagggcatgtgcacaggtactcatgatggagggcacaggggcccgccggtcagtgcacgcaaggcaggctgcccaaagggagccagccaggcccacaagtcgcctgtgggagggtgggtctaccatggccgactctcacacccctgatactccttctcatcgcagccgttcacgggcgcagccggccctgggaagccccatcgtgcccgcaagctctgcctctccaacgtgacggcacgtgtgtggtggttcgatgagcagatcagggctgcgctttcttctggaaccaatgcaccacgccaggtggtggtgctgggcagcggcatggacacccgcccctggaggtgctccgatttccctcctggtacgcaggatgggggttgtgggaagagggatctggaatctgcaggagggctggcctgtgatcattcgctgtaggggggggggatccaaccatgcagccatgagggtgggaaggattctccatgctgtagctgtttgagattcctgcacgagtttgggggggtgcagcnnnnnnnnnncgggggttgtgggaagagggatctggagtctgcaggagcgctggccggcttgctgcacgagggctggcctgtgatcattcgctgtaggggggggatccaaacatgcagtcatgagggtgggaaggattctccatactgtagctgtttgggattcctgcacgagtttgggggggtgcagccatgcatgactcggcacggctgccccatccttgcaccacccatggcatcaccagccagatagcgtgcccgcctcctgtgacccacaaagccagcccattgaactgcctgccgcaggcctgctctggttcgaggtcgacctgccggccatggtctctgccaagggccgggcgctggacgccctgggcgcgcaaaagggcacggggccgggcgagggggcgcgcaagcaccccttgcacgtcgccagctggcacgcgctgaccgccgacctgtccggacccgactgggtccaggccctggccgcctgtgggtttgaccctgggcagccgaccctgtggattgtggaggggctcttcatgtacctggagccacgagacggcaccggcctgctgcacaccatgcagggtgagctggtgcggtggagcgtgggcacagggaggggatgggaagctggggcaggggcaggaacttgttgccagtgatgctcgtcggcagctggaggggctggagccagacatggaccagcacgnnnnnnnnnnaacgggcaggaacttgttgccagtgctgctcgtcggcagctcaaggggctggagccagacatggaccagcacggcctgccaccctttgccgaagaaggaatgttccaaacccgacctcccaacaataatcccccggcaccccgctttccagggcactctgcgcctgggagccggctggtgacgcacaacgtcacgcaggagctggtggacggcgtgcaggacggctcgataacagagtaccccccctactcccaggacctggttcgcacctggcactacggcttcccggcgcccctggagcccgcccttgccgagctggggtggcgggtcactacaaaggcctcgcgcgcccaaatagcgcggtccatcttcggcgcaggctcggacgaggagctggagggctgcgtcgagtttgatgcgcggttggggtgtgcgatggaccgctactcggtgtttgtggccgccaccgttgcggatgtcaagccacggacgtagggctgccgggcacgaggcacggacaaggtaccagcagggacggcagtctgggggcagtgctctgcgacctcaacagcatgctgtcgagcatgggacagcgaggcagtggcgcttgccttgtccatgcggtacactgggtgcagctgcaagcgaggctccagatgcatgtccaggagagggagagtcgctgtccagcaaccgcaaatgcacgagtctccaccgatgctcggaactgcttcgcaccgtgcgggaacccaagagcatgatccgctcagctccagatgtcgcgcacgtaccgcccctcccgcgccatggcggccagcgccgcagcacccgccttccagtccgcgcccgatgcaaaggcccccggcccagtcagcacgcgggccagggcctcgttgaccccggcggccatgcccgcgccgtcgccgcagacgaagatcgaggccgccggatgcgccagcagggcggctagctcatgggcgtgcctctccaccaggtgctggacgtacaccttgcgtgcctgttggcgcgagaaggccacgctgagccgggagagggtgccatcagcctcaaactcctggggaaagggggggttggggagggtgtgcaatttgccaggcacagggcgacctgacgggcgatttcagtgcgcagaccggagcaggattacccctgcgtctccgtctggccaccctaccgtacctccagctcctgcttgtagaggtaatcctggtctggatggcggcacccaaagaagagccaggatgggcctgcctcgaacccaaggtcagcagctgccagcctgtgtctcctgtcttgtaggaacccgctggaggttgtttgggagggggtatatggagagcatttagccatggtgaaattggtatggtgatgaatatgcaccaagccttatccaagggnnnnnnnnnngggggcagcagccgccagccggtgtctcctgtcttgtaggaacccgctggaggttgtttgggagggggtacatggagagcatttagccatggtggaattggaatggggatgaatatgcaccaagccttatccaaggggttttgatgctctgcagcagtaccctgcccaggtacctgcttcccatggccagatacatccccatcccctcctcctacatgaagggtgccaccccggtgccgggacccagcatgatgagcggcccctccagcgatgcaggagggcggaatgcgcctccactaccgagacaggggaggtgaggagggacttcagttggaggatgcattgacacatccagagaagtgcagtcagctgccannnnnnnnnncccccatcccctcctcctacatgaagggtgcgaccccggtgccgggacccagcatgatgaccggcccttccagcgatgcaggagggcggaacgcccctccactaccgagacagggggaggtgaggagggacttcagtaggaggatgcattaacacatccagagaagtgcagtcagctgccatgtgcttcccatcaggccaccgcgccctgccatgcgggacagcagcctcaccacgcacctgcggaagtagatgggaatccgtgggacggcggttgtggggccctccgcgcctttccaactgccctgcaccaggggagccgccttcctttccagccaggtagtagccacgccctcatgctccgtgccgcacgccttggtgaaccgcacgatcgagagggccatggcaacctgcgggcattggtgaaagggggggacaggggatgctgatccaagatggacagccaaggaagccacaacaagtatgcctacaacccaccagtccaagattcattgcccttgcagccctctgcttcgtctcaccttgccgggctgcgcaaccgccgcattggcgatggagtaggggcgtgggaccagggccggcagcgcgtccagcaatggcgcaaggggagggcgggagtcgaaccgcgtcagcaggtccagcagcgagggccgcccctccagaacctcctgggggagggggtggggaatgctgttgaagtgcaggcttaactgccaggcatgcacttgtgtacgagggtggagcacgagcatgtgagtgccgggccgggcgctgcatccatcccgcatccctgcctcggggggtcaccttggcatactcgtcgcgaccggctcgagacgtccagcgcagcagggtctgcctggcctcctcaccagcgcagtgctccgctagcagccgcagcagcgacttgcgcggcggggctgcgatgtccacagactcctgtggaggcattgcaaaaagagggttgaccgtgtgaaggggactctccagtgggagacctggctaccttgtttgtcacccaccatgaggcgacacgaatcagcaacacaacagcttcccatcccagctgcacagcccaccgtgagggcgtggccaatggagcacggcgtgtgcaggtgggggaggaggtgctgcgtcgcaactcccggcctgggccgaacgtcgaacaccgccgacgcctccaggcccagccgggctgccagcgcagagaccagcgcgggggggttggccggcttgacgcccagcgagtcgccggggtgggtcctggcacccgacccctccacccccagctcgcagtgcaggaccctcctgtcgccagcggcgctcgtggtgagccaccgcgccgcgatgagcggggcgtggaagggctgctccggggagtagagtccctctgggtcgcggtggcccagctcctctgccgtggccccagcggcttcctattgcatgacaatgcaggcagagagctggagtggggtgcgaggcccaggcccaggggggcgatcgagtctccactacagcaatgccccatcacaacaagcactgctcccaaccaaggatatgtcaccttgtcgagcannnnnnnnnncctcctctgccgtggccccagcggcttcctgttgcatgacaaggcaggcagagagctggattggggtgaggggcccaggcccgggggggcggtcgagtttccactacagcgatgccctgtcacaacaagcactgcttccaaccaaggatatgtcaccttgtcgagcacggcctgcgtggcactgcggtcagtcagccactccacctcgatgcggcactcgggcaggggcaccggcttggtgctggcggcgtgctcagggggtaccgtctccttgagcccctctgacgccgcctgcgtttgagtaaagacaggatgaggacgtggggcgagcaggagtgtgaggcatgtatgagctgtgcaatgcaaggcaggagcattcattgaacaggagggcagttctaggggcaaaatgtcgctgatcgggtgcaccctggnnnnnnnnnncgagctgtgcactgcaaggcaggagcatccattgaacaggagggcagtactaggagcaaaatgtcgctgatcgggtgcaccctggcccaaacagggaccaacacggcacagacgagtgccatccctgcatcagctgcccctctctacccgcgtccacatccccgacccatagcccccatacaaggagcgcacggccccacctctgcggcgactgtgggcaggcatgcgcgcttcagcgccggcagcatctggtccagccatgcctccacgacatcctccagcccgtccacctcgtccgcgtccttgccgggatgaaactcccccgcccccagggccaggacctgggaccgcagcgcgcgcggcacgcggcagaactgggtgtagttggagtcgcccaggcccagcaccgtgaaggtcatgccctggaggggcggcattgggatgacagttattgaattcatcagcacaggaaccctgcttgcgtctcgacggacgcttcaagcagagcaagagcaagtgtcagcgacccatggctcctgtggccctgggactgcatgnnnnnnnnnnaacggacgcttaaagcagagcaagagtacgtgtcagcgatccatggctcctgtggccctgggactgcatgctccatgatcacacgtgatcctgcctcccccacgcttgcacaccgaccttgaggcggtcgggttgctgcccgcgcttcttgatctggccatagaagcgggcagcattgtcaggggggtcgccatcgccggtggaggatgagacgaggacgaggacgggcacggttgctggcgtgagggcgtccagaccaaactcgtccagcgccgccacctgtaggtgagaaaggaggtgggcctgtgtcttacaaggggatcttgacatgcattgttggaggcgtagtcaaggaggccctctttctttgccctggcttgggagcagtgccgccccttcagatgcccattgagcagagctaggtctggcaccttccgcgacctgagcctcccggtcccctgcaacatacccttttccaacatcctaccagcacccacacaagaagatagtcgcccacctttgcaacaaggcccagctcccgagcccggccaccaatgttctgtgcgatttcctgggcggtccctgtctggctgccgtacaggacggtgacgggcttcggagcagagactccccctcccgccgccgcccctgcagcgccaccaccccggccgcctgccctctgcgctcgcaggcgggccaagatggccgcgccacccgctgcagctggcggagctgccgcctttggggctgccccgcccccgtcaagcttggacggcgcgggcccagctgggctggctgtggtgtcccgcgatgcctgatctggaggttggggcgctgctgctggggagggcgccggcgttgatgacgtgtcagactcgggctccggggagcccggcccggggccatgcccagcgctacctttgacactggcaggctgtgcggtggtcggctgtgttccacccccaccggctgccgcattctggtctaggggtgtggcatcaagctgtgtgccacnnnnnnnnnncttggggcgctgctgctggggaaggcgccggcgttgatgacatgtcagactcgggctccagggagcccggcccggggccatgcccagcgcnnnnnnnnnngctgctcgaagttgtcgtctgtctggccctgtgcatcactcagcttggtcggtgctacagctctcgccacaannnnnnnnnntgaggtgttgggtctgacttctgagcggatacagcccaatccccacagacactgcaaatgacagccatgcttttctgtgtattgagnnnnnnnnnncgaggtgttgagtctgacttctgagcggatacagcccaaccctcacagacactgcgaatgacagccatgcttttctgtgtattgagnnnnnnnnnncctgctcggagttgtcggctgtctggccctgtgcatcactcggcttggtcggtgctacagctctcgccacaagcttagatttgggcgttgtgtgtgctgcgccagcttgtgcggcctcctgggagggcaatattggcgagctcgtttggnnnnnnnnnnnnnnnnnnnnnnnnnnnnnnnnnnnnnnnnnnnnnnnnnnnnnnnnnnnnnnnnnnnnnnaaggtacacgcaccataaatataccccttgacacacctggaatgccctgggccgagcagggggcggcgaattcagcagccatgcaatgccagctccaaccacaactgtcgccagcaggaacaggcgtggaaggacaaagggaaggacgaggatgctggcagcagcaagaatggagggcgtgatacgtgttgtctccatctcgagacgacaccggcctatgcaagtgtttcacttgatgatgtccacactgcgccgcaaggggttgggtcagcaacgagtatgcaagcccgacactgggtccctctgagatgaattgcggcctgaatcggtgcttacgtatttatttgtacccctgacttccgtgtaatcgttgtcctagggcgtgttgcgtgtatnnnnnnnnnnaatatatatatttgtacccctgacttccgtgcaatcgttgtcctagggcgtgttgcgtgtattccgtggagtaggatcggcatgcagctcggcgcgcaatttggatcgatgagcggggcgctgagtcttcagatcacatacgtggtgatcagtctgaagcatcacagaatttgaaggctttgccgagagtcacatgtaactcttatcaatttaagttctgtaggaactcgtgatctcggacgcggcgactctgcgcctggtcctgccagtggcatctggacactcgagaagacgcggtggccaggctgggtcgcaatgtcttttgatttcctagcaagccagaagcggttggagcagaggggtaaagcctttgatgagaagactcggcgaagagccgaggtggaacgccagcagaaggagcgcgctgctgcccgggctgctgccctggagcaggcccagcgcgagcgccgcctggagcaggctgcagcggagcaggcggtgagtttcgtcgtctattttactgtacagggcgactttcgtgcctttgtggatgtttctacgcatgggcggggggggtgggtgggtgtttaagtgctggggctgcagtgtcgcgatccgggcaggcctccctgtcatgacagactgctccccactcggggtcggctgtatgtcctttgcagggcaccaaccaccctccannnnnnnnnnctgtgtgaagtgctggggctgcagtgtcgcaatgcggacaggcctccctgtcgtgccagactgctccccactcggggtcggctgtgtgtcctttgcagggcaccaaccaccctccatcgtctcatcccttggagacccccctcattccccccacacccccgagactcatctcacaggagcgggaccacctggcggcggagctggagcggaaccgcggcgtcacgtggcgagcgcggctcgccgccgtccccctccccgacgccgtggcggcggggaagggcctccggcgcgcggcggacaagatcctgctccccgcctcggcgggacgcctgctcatggaccaaggcgcgccgcgcaacggcgccatgcactttgaactggtgtgcccagccaccggcgcccacacccacgcaggccttctggagttcacggcggcggaggggcaggcggccctgccccccgccgtggcgctggcgctgtggggccccgacggggagtggggcggcgatgatggcggcggcgacgctggcggctgcgccgccaggacgtccccgccggcctccgtggaggtgcggtatcgcctcctgccgcgcggcnnnnnnnnnncgcgccgccaggacacccccgccggcctccgttgaggtgcggtatcgcctcctgccgcgcggcgagcgcgtggtgctgcagccgcgggcggcggccttccaggccgaggtggggccaggcatgcgcgaagcgctggaggcggcgctgggcgcgcggtccacgctgaccgagggcgactgggtgcgggtggggcagcacctgctgcgtgtgcgggagctgcaccccgaccgccaggtcagcgtgctggacgccgagctggaggcggacatcgccgccagcctggagaccgaggagcggattgggcgggaggagagcgaggcgcggcggcgcctggagaccctggctgcagaggccttggaggcggcgcgggaagccgaggtgggtctctgtggggggaacccgggggggg

SEQ ID NO: 34495 - DNA, 75 bp, Chlorella protothecoides
gttctggtccagagatggatctgatgagagcgctcactggttgcagtcctcttgaaacccagactcccattgttt

SEQ ID NO: 34496 - DNA, 70 bp, Chlorella protothecoides
gggggggaggcggtcgtagcggggcttgagagtaaaaataccctgcacccaggcctcaccggtgcacact

SEQ ID NO: 34497 - DNA, 77 bp, Chlorella protothecoides
ccctgcacccaggcctcaccggtgcacactctgcaccgtgccacgtcgcgccgtctgcgatggagggccagggaccc

SEQ ID NO: 34498 - DNA, 61 bp, Chlorella protothecoides
gcccaataagctggtggagagtccgcgtcaggggatttccccgctgctgtgactgctgggc

SEQ ID NO: 34499 - DNA, 102 bp, Chlorella protothecoides
acacacagtgtcgcaatgcatccagcggatggggcgtcagtgctgagtggcgacgcggccccacctgcgtccagcgaaaagtgcttcaatgctcctcggcag

SEQ ID NO: 34500 - DNA, 61 bp, Chlorella protothecoides
gcattcaccttttggggggcgttgcaagcacgcagccggccctgcgcgggagttcgggcct

SEQ ID NO: 34501 - DNA, 12822 bp, Chlorella protothecoides
  modified_base (1524)..(1533): a, c, t, g, unknown or other
  modified_base (1913)..(1923): a, c, t, g, unknown or other
  modified_base (2874)..(2883): a, c, t, g, unknown or other
  modified_base (3345)..(3371): a, c, t, g, unknown or other
  modified_base (5308)..(5317): a, c, t, g, unknown or other
  modified_base (5692)..(5701): a, c, t, g, unknown or other
  modified_base (6256)..(6265): a, c, t, g, unknown or other
  modified_base (6951)..(6960): a, c, t, g, unknown or other
  modified_base (9432)..(9441): a, c, t, g, unknown or other
  modified_base (9586)..(9595): a, c, t, g, unknown or other
  modified_base (10181)..(10190): a, c, t, g, unknown or other
  modified_base (11479)..(11488): a, c, t, g, unknown or other
  modified_base (11597)..(11692): a, c, t, g, unknown or other
  modified_base (11958)..(11967): a, c, t, g, unknown or other
cggcggccagtggccacccgtgtcgcggcggcgcgtccgcatgccgcgcccccagccgcgcccccagccgcgcgcggagccgcccggcgcatggcacgtagcgcaggcagaggatggccagggtgggcaggacgcccgtcaccgccaccagcgtcagcaccgaggtcagcaccaccgtttgcgtggagatgcgccctgtgtgagcgagggtgagagagggacggggggtgatgagagaggagacggcttgtgttgtaggggagggagaccaaggggccccggaagtgacaatgaagagggagccgcccctgggccggccggcacggtctgcagcgggcgacggcctgagaccagggcggcgcagcggcgagtctaagaattgacggctgcgatgcaggtcccagccaggcggcgagagcggcaccgggcatgattgaaaatccatgctctgtcccccaaaaatagggacgcaccgctgtggacccctgccccgtcgccgccgtggcagttggcgggggagcagggctgccccagcgcggtcccggccgcctcgaggtgcaacgaggccggggctgcatgcgccggcaggtcgccgcagatgccgcaattgttgaacaggcccagcagggtcaggcgcggcagcgccagccaggcgggcggcagcgtccccgtcagcgcgttcccgcccagatccaggctgcgcagcgcggccaggcgcccccagtccgccggcagcgtgcctgtcagcgcgttgccggccaaggccacgcgtgccaggttgccagcgtaggcccagaagggcggcaggcgcccggtcagcgcgttgcctcccgccagcagcgtctggattgcggtccgcccgagtgcggcgggcagcgtccccgtcagcgcgttgccgcccaggtcgaggtaccgtagcgcgcccagcgcgcccagcgcgtcgggcacgccaccccacagcgcgttggaggacaggtccaggcggcgcaggcccggcagctggcccagcgcggggctcagcgtgccggtgcagccggcggagggcagggccaggcccaccaccgcccaggcctcgcaggccacgccgggccaggcgcaggcgggggaccccgctgcgccgcaggtggccgcgctgcaggggtccccgctctcgttccaggcgggcacggcgcaggccagctcggccccggcctcctgcagggccagcactgggcgggagaggcggaaggggttcgttttggggggagggggaggagtggggcgctgtatgttgcaagggaggccacccccggttttggcatggtgggcggggcactgcatggtgagccccgctgatagactcaggggatgggcactgacagcgctccctcttgctctcactggccacacaaacagggtgcaatccctgtaacataccagtgtcggggtctgtccttgcatgggcggggttccaggacaagacgaggccagccaggaggcaccaggtcccgaggctaccctgccctgtgacgcggtgcagggccnnnnnnnnnncctggccacacaaacagggtgcaatccctataacacaccagtgtcggggtctgtccttgcatgggctgggttccaggacaagatgaggccagccaggaggcaccaggtcccgagactaccctgccctgtgacgcggtgcagggcctgctgaggcatgggacacagcaaaacctgatacgtccgagcttcctgatccggccaggatccctatgacatctcgtgccctgcagcaggcatgcggcggggtgcaggcttccccgcctcacacggcaccggagctagggctggccggccaggtaagtcgattcaggagatactgtataaagtataagagagcaggaatacgttatcctgtatcacatgaacatgcgggtgcgatnnnnnnnnnnnggactcaggagatactgtataaagtatgagagagcaggaatacgttgtcctgtatcacatgaacatgcgggtgcgattcagtgagggaggccgcacgcccacgaaaggcacgaggagggtcaggcgcccagcgtcaatgtgggaacctacaaaaattcgtcattacaagcctgcgaccacagcaagttcatgcaagcgtgctgggtacaatccgtccgacatggagctcggtgtctacagatcgtgaccacgccagtactgccatggaacccggatcgtattctcccaaaactttcacaactcagacaggggagcacgcagcgtacaacgggaaacgagatttcaaacgggggaaatgggccccggacagggaaaggagactttgaagtttggtcggcatgaggcagggtcaggtgtgtggggcaggggggcgatgcagtgcctctttgctgggagtgtggctcccccaggggcttgctccgcgggcatggcagagcatgcccgcagccatcaaaagaattggtctctcttctttggtccatggacgcgggggggagggggaggggtgtgtgtggcggtgccaccccaggcctcctcacttcctcaacccccggtgctggtagaccgggaagaccacggggtccagcgggtcgccgccggccgtcgcttcgtcgtctgttgtcgcctcgtcgcgacgcagtccgtcggatatgcagaccatggacacgcgggcaccgtcgggcatggccacctggaacagctccgctgtgtggaagggcggggtctcctgtggcgccctgcgggtcgaggagggatacgcgcggggaggggtggatgatcggcgccaggcgtcacagctccacacccaggcgcagtgcaggggggaggggggggggaggaggcgcgtcctcccccccgccacatgatggggtcctgcggcggtccggggannnnnnnnnnaggaggcgcgtcctcgcccccgcaacatgatggggtcctgcggcggtccggggatctgacggccgcgcgaggacaccccgactcacacccacagcaggaacgggcctgcaaacccgctgcgcaccccactcacttctcagcgtcgccgggatcggcgccggcgcgcgccgcgtcgaccctcgcggcatgctgcctcagcgatcggcggatgacgaagatggcgagcgggatgaccaacaggaggaagaggcccagcacacatgccacgatgatgggcgcccactgccgcgcaccggctgtgagggcgggaaggaaagggcggcgggggcggtgaacggcaagggacacatgagggggggcccatgagcggcggcagtgagaggacacatgccagcttgctgcgtgcctctcctccacagcaaagaaagaaagcacccccccccccccccccccccccccccnnnnnnnnnnnnnnnnnnnnnnnnnnnaccaggcgggtggcaatccaccgtgtcgcaggactgccctagccccgttccgctggagtccagctgtagaagggggcggagtgcgggtgtcgggtggggctggcacagattgacaccttcgcgagcatgcaggcaaggaaggggcagaggcgaaggggcagaggccctgttccacgatgctgggaggccaccgaccaactcccccctaccctcccgaacactccaaccccgatctccatcccgacccgagcgcccacctggaagtccgggctgggcggatccagcggcgggccgcagaggccgcagttcccgctgacgtccatgcgcgacaggttgctcatcgcctgccagctggtggggaaggggcccaggagctggttgctggccaggtgcaccatgctcaggccctggagcctgaaccactgcggcggcagcctccctgcatgggcgggggaacgcggggggtggtggggcgatgacgaggggcagggtacctccagcgctcagaggttgactgcgctgcctcccaggaaggcgccgcacgattgcacgctggccattcccccagcccctttgcgagagaccacgccgacaccctgcggcgtgctccaccctccctcctcataattaaacaaaccattcctcgaccccgcccctgcctccccacctgacagctggttgccgtccagatccagcaccacgagcgactggaggccgccccaggcgtctggtaggctgcccgccagctcgttggcagagagctgaagcatgcgcaggctgccgcaccccgccagggaagggggcagctgccctgtcagccggttctgctgcaggcccaggtactgcagctggtccagggaccccagggtcacggggatgctgcccgtcagctggttgaagttcaagtccagggacaccaggctggccagggcgccgaggccgggcgggatggtcccggtgaggcccagacccctcagctgcagctgatgcagctgggtggcattggccagggcggcagggagggtcggggatccggggccggggctgccggacccagagagggtgatgcccactaccctcccgcctgagcaggacaccccctgccaggccgaggggcagggctcccgcgggcattccacgccggagcatgggtccaggttctgtctgtcccaggaagacggtatgtcggggagggtcgaagccaggctttgaagcgcgagcactgcggaggggtggaacgccgggaatgggggccgtggagcgctggtatgaggacgtgcccgaagcccagcgccatcgcagcgctgcgtcgagcgatcgcagaacttaccgtcgccgggatccccgatggcggtgacgtgcgtcatggacatggccatgatcgtggcggcgattgccagccagtgcgcgcaggtccagctcctgccggggtggtgcggcccccgtggaaggctcatgccgggccgcagaggcccagcgcccgtcctaaatatcattataatgagcactggatcagagcttcatactgagaaacacctgcgcgccacaccagggacggattagtcgcccctaatgctgagcggcgtacggagcgctccacccaatcgagccattctcgtgtgatggagcaccgggcagggtaaacccacgaagcacaggagtatccttgaccttcaggacaccttatggctgcgcctatcccaccacgccccttgagcgatgacagcaccgcaggcgagattggtcgacgtacggtttcccgccacgcttaagttctgtgtaggacgggtcgtacgacagcacaggaccaccttccaagggtggggttgtacagcacacggacccctccttgagtaagagggaaattgagtactgacaatgtgcgtcaattcgatgcatgtggcactgcgctgcgggcaattgatccataccatacnnnnnnnnnnaaaattgagtaaggtcaatgtgcgtcaatgcgatgcatgtggcattgcgctgcgggcaattgatccataccatacaaccctagcgtgcgccgtggtttcattggagtgcagtcacccctccgaggaattggtgtcaccggagacactcacaccactgaaacaggcatggggccggatcaaactgcgcagaggaatcaatgtgaaacaaattcgacccctttgtgtggctgggtgagcgggtatcgactcgatgttcatgcgcgctgtggtaaagcacgcgagaatttctgcctcgtttctgcctgatagagaccggtatcatggctcacagcttgcttacagtttcagaatgtcgtcaatgtcaagctcgacccnnnnnnnnnnatttctgcctgatagagaccggtaccatagctcgcagcttgcttacagtctcagaatgtcgtcaatgtcaagctcgacccaaattctccggaacgggggcgcgagggtatgtgaaagaccacgcagcaggcacccctgggcacgtccgcacgaaagggacactaaaaaaatgttcagtgcagcactccggtgtacatcaccctgaaggtttaccggccgacctggacgcgatggcccattccttctcattcggcatgatgactatgattggaccgctggttgatgtggaggcggccagcgtcacattttcgccgccgcgtttcctgcacgttttgtgttgtgtgagtgtttgtgtttctgaaagttttgatggtggaatctggcgaggtgctgtgcggctggagcggcacagctgaagcaagcctgacagggattaggaatgggtctcctgccttccaatgaatgcaagggctgacatccagtcaacctggtgcccctgtcatgcaaagcgtgcctgcagtcctatcccatccttcgggtggcgcacctggggtnnnnnnnnnntgctgacatccagtcaacctgggtgcccctgtcatgcaaagcgtgcctgcaatcccatcccatccttcgggtggcgcacctggggtggagttccacagctccagcctgccggtcctccacaccaggcagtgctggtgccacgggcggagcacgctgttttctgtagcaggtgcatagggccacagccgtcgcaatggccgccagcggcaggaggatggccaggcagagcacacctgcgcttgaccctgcagggcggcgagcagcagggtcggctcgtggagatcacgtgcgcccctgattccctggacacgccgcaataccctcgagggttgagcggaacaatgctaccccgcgggcgcaggccagtgaccgctggcatatcctgaggcttcgtggggcggacattgtcccgacttccatgcaaggtcccacgcgatgccttaccatgcgcggcaccaggtgcggccggcgtggtgaggacggaagccagtgcatcctcccgttcgctcgagtcctgtgggtttggtgatggtagcattgtcgtcctgcgctgtggataggcctcagaaaaggcacgagccgcatgtgcaaggggcaagtgcagggcataacccaccttttggtgctgaatactgctcacacacaccaggacaatgctgggggcctcaggcaaggtggggccgtcnnnnnnnnnncgcgcaaggggcaagtgcagggcgtgacccaccttctggtgctgaacagtgctcacacacaccaggacaaggctgggggcctcaggcaaggtggggccgtctgcgaccagtgattgcgtagagtttcagggtttcgagtgctgcagctcctcactgctgtgccagcgccacacgcctggcaggcgtgcatgccaccgcagggacctggcccactcaccgacggccaaggctccacagtcctcttgccagcctgctgggaggggtcctgcaaatggggcatgccaggattcagaagcgtaggatcaggggggggtgcctgaaacgccatgcgctcagagccacaagtagaagcagacgatccatcaggaacagccatgtcggcaaggggccagtccggcacccaccatcgatccggtttccctggagccacacgcgctgaaggtggggcagggaggcccaggattgaggtatggtgccgctcaggtcgttatgggccaggtttatggttgtcagttgcaagggcatggctgccgggagggggccgacctgtgcaggagcatgggcggcgccagtgacgagcgaggggaaggtggaaggggtaagggatgattcacagggcttcaaagacaatacctcggcttccttgggtgctcaacgtggtgtctatgcactgcattcagacgcctcaggtccgacatccctaagtatatttgcacaacaggcgctccttgccaacccctcccagcgcaccagctcattatttcgcaggtccaggactctgagctcgctcaatgagaacaggttggacggaaattgcattctcaagcctgctcctggcagagtgagctgcactaccttgcccttctcacaggagacccctggccaggaacactccccaactccgcacgtggggtggggacaaatctttgtaccccggctcgagagactcaacatctgcattaggacactttcagtacctgcaagacacagaattggaaggaggtctattgtgtctccatggatagtattgagcgagctcgcaagcatgttcttgtaccacgtacttggagcgaaatgctcgcggttgacatagctgccggagacttgacttagctcgaacagcgctccgaccaggagcgccacgagcctttgcatggatgaagtgggaccacgtcgtaccagaatactgtgcatgatgggtttggggatctcttgtttccgcgtgcacgcgggtccattcgactgggaaggcagaccactcagcagcctcgctgcggggtgagaccacacaggcttacgcggcagccccatgacgaggtaccatggagcatctctcaggacattcagactcgccagaccattggagctctgaattcattattacctgattggaaggcgccaagcgggcggctctttacctcccgactttattcctcgctccgacaccccccggaaagatctcagagtctagacatcttcttcgatgtcccccaaagctccccctcgagactaatctgcacgccctcctgtgcaatttgagactttctccggcgacaattgtgtggccaccccccgcaatatcccagtcaggaatccagcgtgccccgattcgctccccatgtggcttcctgcggctccccggatccgacggcacccgctcgatcaacaggccggtacctcacggtcatgtacgctgcgacggcgcggcatgcctgtgccgcaggcgcacaccgcatcaagctcagtctcgttgaagggcacgggaggcaggcatcactcccggccgactctgcacacgaggacgctgatgttgtcctcactgccacgcaggtaggcctccgtcgccagcttgcgggccgccacctctgggctggtggacttccgcgccatcttcgcggcgtcctcgttggacatgacatcccagaggccgtcggagccaagcacaacccacgtcacggcgtctgtggtggggagggggtggggggatgttacccaaggcggaggggacaacagtctggccgtggcgcggcaagggggggagggtcgtaggggggcaccgccccgataaactgcctggccacacctgccttcctggaggagcaccacccctcagcaccccaaccccatcccattaaccaggtcatgctggacagcagggtcgccaggctcaccctcgctgaggatgtcctcccggatctcagggtgcgggatgatgaactccttcatcagccggttgccaaaggagcgcgacacggccagcacgccacccactcgccaggtgcctgcccagacgacgctgccacccgagccctctatccgaatcttctcgtcagagcggttgggcttgtgatcccgcgacagcatgacagctgcgccgcgaaagggaggtgggggtggggacgtttggaagatggagatgggtggggggtggacactagaaatgcacgggagcgcaagtaccagagggcatgnnnnnnnnnnggatggggaggggtgggggggtggacactggaagtgcacgggagcgcaagtaccagagggcatgggtccaggtgcggtgccgtcagatgacagcctacacaaccagacaccccactgcaccaaacaattcctgagagcacccacnnnnnnnnnnaatagcctacacatccagacacccctctgcaccaaacaattcctgagagcacccaccttgccgaccgtcgtgcatgactgccctcgagtcacccacatgcgccgtgatcaatcgctgacccacgaccatgctgaacagctggaaaggaggagggggagcggacaaagtcggatcccttgctgagaagcagagctccaggtcccagcctgcaggcccagtgggatgacaacgaagaaccaccctgccagggcacaattgcgccgagaggaggccacccctcattccagcccttggtcccagtgcttggcactcagaaccccattccccccttcccaagctctcactgcggtcgtgccgtcgtcgtttgtgatgtgcttgtcatccttcaggtacctctggtcagtgttgatgaacccctcctctgttgaagaggcaggatggtgaaattggcacagtgaacagctgcgggcagtcctgcagtccaagcggtaaatgcaagtcccaaggctcgttccagaaaccctggaacgcacatcaacgccctcacatccgcgcgactcacccactgccttgaagaggtcgctannnnnnnnnntgggcagtcctgcagtccaaacggtgaatgcaagtcccaaggctcgctccagaaaccctggaacgtacatcaatgccctcacatccacgtgactcacccactgccttgaagaggtcgctatgaaaactgtcgtggttcagtatgttgtggggcaggttgtcacacacgtaggcggaggcggcagggcccccatgacctgccgagggaaagtgggtttacggatacataaccggtgctgggggtgccgttgcacacagcagccttgcagaggggcacactcgtccctgctccatctcaaagtctcctacagagcgcccctctcaccgtcgaagaccccaaaacagcccacttccatgccatccttgttgagaaactcgcagaacacacagtcctcctgtgtggaccgcttcccttgcatgctggcccagccggcctggacctggttgtcggacctgaggtgcggggcaggggcgggccttcctgggacgggatggggcgaaaacccttccaaagtatggaggggcccatacctcggcgggtcccgaacccacggcaccgcaccttgcgacgctcccggacttgagtccatacttcctttcgagcttatcttggaccttggtttgggagcatttggcctcgaacatctgtttgaaggcctccatcccacccggtccgtgtcggacaccgacccacgggggaactaccgtggcgtcgcagcaggtgccgtcttcatctcacgcccgctagatcaaactgtcgaaggattttgcgtcggccgcccgacattgcccgagaataggcagtgcagttccgtcccatcttggctgacgtcagcatccctggtttcgtgagccggttgcgagctggttcggccctccttcaaggtcccctggggggccgaccaaggctgtcataagagcggggaggatcctggtgcatttgccagtccaatctcaagggatgtcagctagatcaatcaagaccatccaaaccccgagggaaatgcaacgggctggaggtccgcaaggagaggcacagcaaggggcaagcgcaaccgaggtgcaaggagaggagcaaggggcaggcaacaaggcgacaataaatgctggtcctggtgaggcaagagagcagggggcggcaaggcggagcagggaatggatcaagatgtcaaccccagtgggtcggcggctgggggcccacagtgatcgcggggcatgtgcttgcccttgagggacacagattggcacgggtgcaacgatccagagagatgtgagggcccggccgcgagnnnnnnnnnnaagcaaggagcaagcccaaccgaggtacaaggcgaggagcaagaggcaggcaacaaggcaacaataaatgctggtcccggtgaggcaagagagcagggggcggcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcatgtgcttgccctcgagggagacagattggcaaaggggcaagggtccagagagatgtgagggcccggccgcgagagcgccgcgcccagcatgggtccacggcacttgggcgacgccgctgttgagctccagcagacgcgccagactcccggtgttggacagggcgggtggggtgcctcccggtgacgccgggcccacacatcatccctccgtccctctcacccccctccacacctccagcggctcagtgggaggtcttgcnnnnnnnnnnccccaccgacgccaggcccacaccatccctccgtccctctcacccccctccgcacctccagcggctcagtgggaggtcttgccgcagacgccgccaaacacccagagggcgtggtgcaggaaggcgtgccaggtcatggtcccaccctggagcagcaggatggcggtggagatgcccatggctgcggccatgatccagacgatgagggcgcgggagcccgacttggcgctgagccagaagaccaggccctggcccagggctgtgaacacgagacccaaggcggccagggccaggccgtagtccaggggcacggcgccgagggagacgaacaccaccgaggcggagacggaggtgaagaggatcatggtggcggaggtggcggcggtgacgtccggcagcacgcccatctccagcatgagcggccccttgacgatgccgccgcccacgccaaacacgccggccgccaggcccgcaaaggtgcacagcgcggggaagaggagggtgctgcgcgcgtcccactgcacgtcgccctcctggtactggtgccctcgcgcggccaggcgctccgcgcggcgcaggaggtaggccctcgccgccagcatgacggtgagggtgagggggagcagcgcgcccaccaccgcccagtaggcgggggaggggcagcggaagcgggtcttggccaggtccgaggccaccacgcaggccagcatgaggaagagcacggccagcttcaggccggggacctccacgcggtagtgcgccagtgcgcggcgggccaggcgcttgacgcgctcgcgccggcgtgggcgctgcgccggcggcagcagcggggcgctcgcgccgtcggtcgccgcc

SEQ ID NO: 34502 - DNA, 78 bp, Chlorella protothecoides
ccatcctcgcccactgctctggtggggggggggttccgaggggggttggttctgtggaggaggggtcgggtgagcgcg

SEQ ID NO: 34503 - DNA, 73 bp, Chlorella protothecoides
gagacccggagccaggtggcaacggcgtgagttgtcacgctggtgaacaataatgtgccaggaggggagagat

SEQ ID NO: 34504 - DNA, 61 bp, Chlorella protothecoides
gcgccgcacgccagcatggcaggcgcatggggaaggagagcatcctcccctgaacagaaca

SEQ ID NO: 34505 - DNA, 63 bp, Chlorella protothecoides
gctggagaggggggctgcagcccgcagatgggaaaacccgctcatcggtcaccaggaccaggg

SEQ ID NO: 34506 - DNA, 80 bp, Chlorella protothecoides
agtaccgcctggcgcagcaggtacgtggctggtagcttgtgggggggggaggggtggcggggtggccggttcgagagcgt

SEQ ID NO: 34507 - DNA, 147 bp, Chlorella protothecoides
cggcggcggcatgcttggaggaggggtggagggggttgagctgcagcgctctgttgccaggagcgcaaagatgtggggccccaatagtggcttgggtgtcctcttttgccattttgtagtcatagccttctccttgacctcatgctc

SEQ ID NO: 34508 - DNA, 93 bp, Chlorella protothecoides
ttcaatggttgcggatggggggacaccaacgagcgggtcgcggcaccgaccctcgccctgatggaaacagagcaccctgccaccttgatgagg

SEQ ID NO: 34509 - DNA, 11438 bp, Chlorella protothecoides
  modified_base (1259)..(1336): a, c, t, g, unknown or other
  modified_base (2299)..(2308): a, c, t, g, unknown or other
  modified_base (2564)..(2573): a, c, t, g, unknown or other
  modified_base (3469)..(3478): a, c, t, g, unknown or other
  modified_base (4094)..(4176): a, c, t, g, unknown or other
  modified_base (4312)..(4321): a, c, t, g, unknown or other
  modified_base (4418)..(4427): a, c, t, g, unknown or other
  modified_base (4524)..(4632): a, c, t, g, unknown or other
  modified_base (5705)..(5714): a, c, t, g, unknown or other
  modified_base (5971)..(6009): a, c, t, g, unknown or other
  modified_base (6192)..(6201): a, c, t, g, unknown or other
  modified_base (6697)..(6706): a, c, t, g, unknown or other
  modified_base (7463)..(7610): a, c, t, g, unknown or other
  modified_base (7694)..(7703): a, c, t, g, unknown or other
  modified_base (8046)..(8055): a, c, t, g, unknown or other
  modified_base (9434)..(9443): a, c, t, g, unknown or other
  modified_base (11256)..(11265): a, c, t, g, unknown or other
caagacgctgctggccaaggcgacggcgggggaggcgggcgtgcccttcctctccatctcaggctccgacttcatggagatgtttgtgggggtgggccccgcgcgcgtgcgcgacctgtttgcgcaggcccgtgcccaggccccctccatcatcttcatcgacgagatcgacgcgatcgggcgcgcacgcgggcgcggcggctttgccggcggcaacgacgagcgcgagaacacgctgaaccagctgctggtggagatggacggcttttccaccaccgccaacgtggtggtgctggcggggaccaaccgccccgacatcctggaccgggcgctgatgcggccggggcgcttcgaccgccagatcagcctggaccggcccgacatcgcggggcgggagcagatcttccgcgtgcacctggcgcgcatcacactagacaaggaggttgggtactactcggagcgcctggcggcgctgacccccggcttcgccggcgccgacatcgccaacgtggtgaacgaggcggcgctggtggccgcgcgccgcgacctgcgcgcggtgggcatgcccgagttcgaggcggcggtggaccgcgtgattgggggcctggagaagaagaacaaggtgatcagcggggaggagcggcgcaccgtggcctaccacgaggccgggcacgctgtggtgggctggttcctgcgacacgcggagccgctgctcaaggtgtccatcgtgccgcgcgggtcggcggccctgggctttgcccagtacctgcccaacgagaacctgctggccacgggggaacagatggcagacatgatggccatggccctgggcgggcgcgccgcagagcaagtcatgctgggccgcatctccaccggggcccagaacgacctggagcgcgtgaccaagatggcctacgcccaggtggcggtgtacggcatgaacgacgcggtgggcctggtgtccttcccgcaggaggagggcgccttcaacaagccatacagcgacgacaccgcgcgcctgatcgacggcgaggtgcgcgcgctggtggcgggggcctaccgacgcaccctggccctgctggaggagaagcgcggcgccgtggaggccatggcccaggccctgctggagcgcgaggtgctgggcaccgaggagctggaggcgctgctgggcgagcggccctaccgctccgcggagctgcgcaacatcgacaagttcagggacgggttcgccagggaggcgcccgccggcgaggcgcccnnnnnnnnnnnnnnnnnnnnnnnnnnnnnnnnnnnnnnnnnnnnnnnnnnnnnnnnnnnnnnnnnnnnnnnnnnnnnngggagccgctggagccgccgacgccgcccccgccgccgcccagcgacgggcccgggggagggctgcgtcccgcgctggctgctgaaggtggggcagcggggcccaaaatcgtggctacctaaatacggggtcccgggtgtgctgcagggtccagcagccggggaggtggacggaatgctggtcacctcttcagcgtcggatacccactcccctcgtcctgctggcgttcaccacactccacatccccccctgtgcattatttccctcatcttggagtgtatgctgctgccccaagactgcctggtggagcgcacagcaaagatgctctgcgctaaatgtaacccacgttgctcatcaccaggctcgccctccatgcccgctccccagccgacgggcagagtattgtgatccactctgccgcctctaccgccccctcactcaacccctcatcacaatgcccccaaacattgtgctcccggcgagagagttacagagggggggtgacagccatcagacgatggtgttggcggcggcggccacgcggggccagaggtcggcgcactccttggccacggggccggtgatggcggagcccttcatctcgcccttggtgttcacgatcacgcccgcgttatcctcaaagtagatgaacgtgccgtccttgcgcctccaggccttgcgttgccggatgacgatggcaggcatcactgcggaggggaatggggaatggggggaagggagggtcgatatggcacgggtacgtcaagcagaggtggtgcggcatacatgcatgcgttcgagatggccatcgctggtggcgtgggggcggccgccgcctactggtcgcagaggcagaacctctcggagatctgcaactggcaggcacacagggccatacgttcccgagcctgcccgacaggaaccagtggcaagctgcagaccatccagggcaagggctacagnnnnnnnnnngagcagaggtggtgcggcatacgtgcatgtgttcgggatggccatcgctggtggcgttggggcggccgccgcctaccggtcgcagaggcagaacctcttcgagatctgcaactggcaggcacacgggccatgcatgcccaggcacgcccgacaggaaccagtggcaggctgcagaccatccagggcaagggctacagatagctcattccggcctatcagtgatgacagcgccaatctccacccacatctgccctcnnnnnnnnnnactcattccggcctgtccgtgatgtcagcgccaatctccacccacatctgccctccacagtacccacggcagccagggcctccctcgcgcactctcacccttcttgcggaggtcgggctttcccttcttgcaggtggccatgatcatgtcgccgggcgcggcagcgggcagcctgttcaggcgtgctccccagccgtgcacggaaatgacgtacaggttcttgcctccgctgttgtccgcgcagttcatggtcgcagccacggggagacccagggtgaggcggaacttgttgccacccactcctcccttacgcttggtcgccatgacgtctaaatttgtggaatcacctgtggggagtgaggtggcaggccctgctccgtcagtggtgcaggcgcggggagagacggcgcgagctccagcacctggtcaatcgcgcaagtctcctgactgacacaatcctcaccttctgattgcccaaagagggcctggtggtggcctcggtggggaatgtagcgagcctctacgagccgacgggaccccttggtcgatcgacgcatgccccacccccgcccagctctactgaaatgcttgtccagcctggcacagcgtgcacgtctgcatctgatcacgaagtgcacaccgtctgcccacgtcgatttccattgtatatagattgataaccgcagccatatcagcattgtggggaatccagctgccgtgaggctgggtcctgggtccgtgccctctcggccagatgcgccgagcagtggtgctggccactcgcgccttggtgtccagctcgcagccggcaaactcgtttacctggacatgcttggctcttcgggatgcccaggcatcgagtagcgcggcctggcaagctctggagcggggacccnnnnnnnnnnatttacctggacatgctcggctcttcgggatgcccaggcatcgagcagtgcggcctggcaagctctggagcggggaccctcagcccggtcatactcctggtggggtgggaagcaggccgagcccgtcagtcctgcggcccagcctctgctgaccccgagtctggacgaggcacccggggctggtgctgacctggcatcgcaggccttgacccccatcgctgccagcccctcgtcctccctgctggacccctcggccatcgtggacgccgccgcggtggcggaggcggccgccatcgcggaggccatgtccgaggtctgggcccccttccgccccatcacctggttcttcagcgccacgcacgacgcggtgggcggcccctggtggcacgcggtggtcctggccacggtggcgcagcgcatcctgctggcccccgccgtggtctaccagaccatccacggcaaccgcttgcacaaggccaagccggacatgctggccatgcaggcggtgatggcggaggagacggcgcgcggcatccagactcccccggtgagagtgctggttgcttcaagtggaaggagggggctgcgggggaaggcggcgctctcgcggaggggnnnnnnnnnnnnnnnnnnnnnnnnnnnnnnnnnnnnnnnnnnnnnnnnnnnnnnnnnnnnnnnnnnnnnnnnnnnnnnnnnnncaacacccaccagcgatctcacctccattccatccaagccccctcctgcctcgaaagaacagatccaccgatccctcctctgctcccccctccctcccctgatacctcgcagctggtgcaggcccagcgcatgcannnnnnnnnnattgccctggcccccccggctggcccccagggcgccgggccatgtgtgtcggggcgccgagtcccgaatctcctgtagactcctccctgccccatcnnnnnnnnnngttgccctggcccccccggctggctcccagggcgccgcgccatgtgtgtcggggcgctgagtcccaaatctcctgtagactcctccctgccccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatccctcctctgctccccctccctcccctgaaaactcgcagctggtgcaggcccagcgcatgcaggcggtgtaccgcgggcacaagacgggccccttccgcatcctggtgggcatcgcggcccagatgcccgtggccatcggcgtgttctccaccctgcgctgcctggccgcggcgcaggtgccctcctacgtccagggcggcgcgctctggttcccggacctctccgcccccgatccgctctacctgctgccgctggcggtgtccgcctccttcgccgccgcgctgcgcttcggcatggacggcatgcagcagcccgacggcagcgggcagacggagaccatcaagaccatgatgcggtggatgccctgggtcatgggccccgccaccgccttcctctcctccggcatgcagctctccttcctggtcagcaacgtcatcggcctggcgcagtccatcgtcctgcgcagcgcccccgcccgcgccgccatgggcctggacccgctgccgccacggggcggcgccgcgcccggcgcggcgcccgtggccgcccgagacgccacctggacgctggaccccaggggcagcgtccagcaggtcgtggtgggggggccggggcagagcgcgagggccgccaggcccgcgggcgtggcctttgctccgccgcgaaggaaggcggggaggaaaggggggagcaaggcgtagtttgcatgggtgtgcactccttgcggcagggggggaccctcatcgccgcacccgaccccagaagcctgctgccctgcccagcgtgcctggggtgtgcaggcggcaccgggtggcggctggcacctcctgtacacacatgatgagcagtcagcagagggcgacagtttgggagcagggtgagagggggcacggcagaatcgacggtgcagtgtgttcccggcgcaggacatggcattgcagtcaaagaggtgaaagagagagtgatgccggctgcaatggcagtcctggcagggaattaggggggagtagggaaaagagattcgtgaaatgaggggttttggcacctggccccgctctggctcccatnnnnnnnnnnaaattagggggggagtggggaagagagatttgtgaaatgagggggtttggcacctggccccgctctggctcccatggcaccgggtgcctcggcggcgcaggccgctgctgcccgcccagcaggccgctattgcacgcccagcagggccgggattttggcgagggtcagcgccaccaggcaggccaggcccaggatgggccccagcgccagcgccagggagaggcaggagggggcggcgggggcgcgccccaccgccnnnnnnnnnnnnnnnnnnnnnnnnnnnnnnnnnnnnnnncgcgcgaggaggaggtggggccgcgcgatgcccagcacgaccatgagccagtccagcgcaaagttgcagcgcagggtgcccgtggcgtcggggcccagcaggcggcgcggcacggcggatcccaggcccagcgaggagaggcggagcagggcgcggcccagcgcgctgacccgcgcctccacnnnnnnnnnncggcccagcaggcggcgcggcacggcgggtcccaggcccagcgaggagagtcggagcagggtgcggcccagcgcgctgacccgcgcctccaccgccgggtcccaggccctgctggcgcaggtggcggcgttggccgcggcgacgacgggcagcgtggccgccacgatgcgccagttgtgggacaccatgagcgggtgggccaaggtggggaaggccaggggcagggccttggaggccaggaggatgagggggaagaatgccgcgccggtctcggagttgaggcgcgggaggatgccgatgtcctcgccgcccgcaaacaggccgaggagccagagggggctgagccggaccactcccaccacccaggggcgagcggggacgaagtaagggtcagggaggagggtcaggatagccggggcggcctgtgcatggcgaagagagggaaggcgggggagtcggggggggtatctggggccgcagccgggggtcagcaggnnnnnnnnnncgagagggagggggggggagtcgggtgggatatctggggccgcagccgggggtcagcaggctgtgcgagggcgccgcgccatcgcgaggggggcaaggaggggtggcgaggtgggcctgcatgcttcctcccaccacaacgcgagctacaggccggcccgacgccgcctgcggctgcatgcagtgaggagccagccggcaccggagcacacctcgttgagcacggccaggccgaccatgtacttcttttcccccaccagcctgatggcgtgccgggcctggggatgcagggtacgtctgagtcggtgcaaggtgacacgccggcgtccactccccaggtacgggactgctcaccccatctgcgccatgagagggcgaccccccggaacacccctctatgccatcccacacagcccatgctcaccaagccaatcatccagagcatgatggtgacagtcgagccaatcctgtcccatcgcctgcaggacagtgccctgaagtgcctgtacgccttctccgtggaagaatcctcaaatggcatgccgacgaggctcacaccccgaacctcggggggttgggctcgccccgccggctccatgacgccacgaacccagggtgtataacactatcgccccaaatatatatccgtgggccagacgggttccgggaggtgctgctgcgccgtactggcgtgcgacagcccgcttgaccagcgcaggcaagtgcgtgtctaaaatgtgtgtggcagcatgcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgaagaaatttactattggggaaggtcgctggggagacgcatagttccccccaactgttgacgacactcttgtccgaaannnnnnnnnngatccattgatggggacatgccggatttccagatgttttgcccgaaatttgcgcgctgcagatttgaagagatttactattgtggatggtccctggggagacacatagtttcgcccaactgttgacgacactcttgtccgaaatctagcattgtgcactcgctgtcgcaggaccgacggccacagggtgctcggcgccccttcaaaatcttccgacgcctgactttagcatcttgttgagcacacacacaaataaattcaagcagagagtttgagagtataagaaatttaacatgcttgcagacattaggatagacaagtgtctacatggtccgcgcacgcannnnnnnnnnggagtataaggaatttaacatgcttgcagactttgggacagacaagtgtctacatggtccgcgcacgcacgtagagcaccccagatctggatcgagtcggccatcctgagaaaagcgatttgaaggagatggcaggaacatgctccccatataaatcacccccaggctgtgatacttgcaacaatcgatcgaacggagcatatacgggccgggcctgccgtggagtacgatcgcaaggcgcagctgagggccatgttggcatcggcgggcgcacacgcttgtaacgcatcctcctacacgtccctcagcacgcctcgggggtgcgatagcacacacaatgctgccgtgaggtttgaggacagagagatcgtggatttgacgcgcttccacgcccttcagtcggaatggacgcattcgggcctggtaccgaaggtctccgcggttcgaccccggccgatttattggggggagttattactgtgaagtatgaggtattgttcccccgtgtcgtcgcgagaagtcagagactattcagactctcgagcgggatcaaggggtcagaagcgtagcacgtccacgaggagtttgcttcctcggctcccgatacaagcccttggctttcctcacgcgctcaagtggactggcgtaagatagcttcgaccgactaccaaaggtgtgaaaccacaagaattccatatcgaggctcgaggacggcagtttgagggcaagttgctgtgcaaggtaagaccccgaactctcatcctggccggaggcaaccctaccgcgaagtcacaccgtcaggacgcaatctccggccatgggtggctaggggggcatgaaggcaaggatcttcgtctagtgtcgacaaatatgcttccgacactgagcaagtcgtccatccctgctctggaaggttctggcgcaccctcacccgagtcctgggcgaggaggacggcgaagcccagcaggccccagcctgccatgggctccacccccgatgatcgactgctagagcttgaagagagcgaactgttcgacgatctcgaagtttccaccaaccagcccacccccgccctcgccatcccccctcggccctccccgcccgtccgaccgagggcggcactctcggatgcgagcgggtcatcggacagcgaggacgatggcatcgtcctggactccgacgaggagctgtcaggtggggcgtcaaagacggtcggagggtcatcgtgaacatgaggtggggctgcatggtcctggcagcaaccccgcccaggccgctgcgacgccctccagtaccctcctcactgtccgcaccggggtccccggccacgcctcgccctggcccgacatgacgtgcgcctgcccatcccgggtgctgnnnnnnnnnnggcaaccccgcccaggccgctgtgatgccctccagtaccctcctcactgtccacaccggggtccccggccacgcctcgccctgccccgatatgacgtgcgcctgcccatcccgggtgctgctggccctcactcattcctgagcactgacaccccctcccacacacgcgcacacaccctgcagagcgctggacccgggacgagacgtactcgctgcagtccagcgcaggccaggccaacatgagcccctccatcatgtccggcgagacgggggcggggcgtgcgctccagccccagcccgtcctcatgccctcacccttcttcgtccccggctcgctcccctcgcacgcggcaggagggcccggcgcgcgcctcgcccgccacatgtccaacgtggaggccagcctggcgggggccgacgcggcctcggccctgaccctgggcacctccatgcccatctccatccccatgatgccgcggccggccaagcccgctgcgcgcggcgagggcccgcgattcgtccccccccacctcctggccgacggcgaggggctgggccccgagaccgacgtcgcggagctgctgggcagcagccggctgagccccaccacctccttccgccgcgacaagctcactacgcgcaacgccatcatgcgcgccaccggcttcctcgaagtgccaggtgggggggcatggcgcgggcgcggggccggagggtagacgggacacgtgtgcagcagaggcatgcgcactcgcatgcccaccccctggcgctggaggattcgggccagaatcctctccacacacactcacttgcacactgcgcagggcacgacatgccgccccccgtgctggagaccgtgatcgagaccgacttccagaccgacttcctgacgcagtcggcgctggtgggcagcgtgcccatgcgggcgatggcgcggccgggcccgggccaccgaccgacctcctccctgacggccatgctggggacgcccagctgatcgagggatgggcgaggcgaatgggggactttttcgatgcctggcgagccggggggttgccaagggcatggccagccttcgcggccagcctcagcctgcgaccgccaccccggctctggcaacaggagagcgagcgtgcaagcccctcaatcccatggctggaggagctcgccacctgcggcaccggcctgagtgggggcggtgccgccttttcattccgcagccgttcctcgaccctaatatgcgccctcgagcgcggcgagggtggctgccgcggagcgcccgtgagaccgatgcagcaatgttcagcgtcctaccctccgttgtaccccacctgtatcgcccccccctttttggtatgggtgggagctcttgtcatgcctggccccccccctggcacacaccagcgatctcacggaagcccatgcgtgtttgagcctgggccgcccaccttgcgccctcaaatcctgacgccccgcatgatattccctgcataaagcccctgtcaaccgtggatccgtcccgcaatgcaatgcccgcccatgcccttccctccttctgcgccatgcgtgtgctccttcatgtgatcccaggcacaggatatgcacttggcgagacgaatggttgcgtggtggaaggggatgctgggtgttgtgaggtgactcctgacagtgcctccacccgtgtcgacctgtacagatggactgtgctgcgcccaccacaagcagctatcccaatcctcgggaagagtatgggtgctgggtccaacaactctgccgcagaccagcttcggcaaacaacggtgcggggacannnnnnnnnntccaccacgagcagctatcccaatcctcgggaagagaatgggtgctgggtccaacaactctgccgcaaatccagcttcggcaaacaacggtgcggggacaaggcaggccccacaacagagctggtcagattgcgacatactgcaataagctctccaagtgtcactgctgtctc

SEQ ID NO: 34510 - DNA, 63 bp, Chlorella protothecoides
catacctgtttgctggctggtgtgaatgattgtggtgtcctccctgacaggctgccaaagcac

SEQ ID NO: 34511 - DNA, 120 bp, Chlorella protothecoides
aatctacacggccggcaacagcttgcaaaattcacttctcgtcactgctagcccagggtagcattgatgagacagccacggttcttacaccactatacaggagtggggcacactgccaaa

SEQ ID NO: 34512 - DNA, 119 bp, Chlorella protothecoides
gatgtgctaatggtgcgggtgacactcctcacttcacggatggttgctggggggttgccctggcaggttctgtgcccctcacatcagccctgcagcagccagcacacctggcattatgt

SEQ ID NO: 34513 - DNA, 73 bp, Chlorella protothecoides
tgacacaaggcagacgagcgccctggaaggtggggaaaatgattcctccaaccagccatccggccagggtgac

SEQ ID NO: 34514 - DNA, 77 bp, Chlorella protothecoides
agacccctacgccagccccagccggtgccgggtggtggtgccggccagcacggccggcctcccctcccacctgctcc

SEQ ID NO: 34515 - DNA, 487 bp, Chlorella protothecoides
  modified_base (263)..(308): a, c, t, g, unknown or other
gcggccaggcagcgcggtaccgcggcctgctgcgccgcgcggggcccgaggctctggggcgccgggtggtgccgcggggcggcgcggctgcgtcggatctcatgccccagggccacccttttttccttgcgcactgcgccgcggtgaacgcgcgggggccgggggcggtggggcggggcgatgcctcggaggggcggggtgatgcctcgttggggcacgacccagccttggagacgcacgacccggccccagcgtcgcatgannnnnnnnnnnnnnnnnnnnnnnnnnnnnnnnnnnnnnnnnnnnnncgtcgcgtgaagcatccgccgcagccccctcctcatcgcccgacgtggccgtggcctcgtcggccgacccagcgtcggccgactacccggcccgcgcctacgccgcgctggagctgctggagctgcgcgtggcggccctgcgcgagtcgcttggcggcgcgccgcgcgaccccggcggc

SEQ ID NO: 34516 - DNA, 112 bp, Chlorella protothecoides
tgccgaggaaggaggtgccatcgggagtgagccctcactgaatggccgcgaggacgccccgggaaggtgcctccgccaggctgcaaaggccccctggacgagactctccggc

SEQ ID NO: 34517 - DNA, 61 bp, Chlorella protothecoides
ctgtacagtcccgccgacaggctcggaccccaatcaccctcacgtacatgcccagcagccg

SEQ ID NO: 34518 - DNA, 85 bp, Chlorella protothecoides
gccatccttgcaacatgttgctccctctccgaggaaatcgagtcttcatggagccatggtcatgacaacctgcactcttcctcac

SEQ ID NO: 34519 - DNA, 122 bp, Chlorella protothecoides
cccctctcctgccctacaccccttgcgtcatactcaccccacctttcctcgacacagtactccccccccaaacccccacctcccaaacatttacagacggagggcatcagcgaggaggaggc

SEQ ID NO: 34520 - DNA, 74 bp, Chlorella protothecoides
cgttagcttctgaatagagtatgcacgacggtaacaagaaaaaggcctttgatcaatgtatataacgtacactt

SEQ ID NO: 34521 - DNA, 109 bp, Chlorella protothecoides
ggaacggggaggtgggctgggttgggggggggaaattctggcggtcatgtgtgatccctagcccaaacagccatgtagagcctggcaacggggttgtgggctcctggca

SEQ ID NO: 34522 - DNA, 77 bp, Chlorella protothecoides
ggttgatgaggagggacatccaaacgggtgcgggtgcatgcgctggccctctccacgccggcaaggaagcaggcaag

SEQ ID NO: 34523 - DNA, 109 bp, Chlorella protothecoides
gccgtgcgaccatgcgtgtgagagtcagcaatggcggtcagcctgtgtcatgcatgtttggatgagactttttccaagagaagtacccgtcgcccagcccacccacctc

SEQ ID NO: 34524 - DNA, 154 bp, Chlorella protothecoides
gggggcacgcggacggtgagggtgggcagcacgacgctgtgcgtgctggggacggcatcgggcgctccggcccgccaaaagagcacgccgcactcccacacaaccccccacccctgccgccggggaccccagtccgccccactcgccaggcccc

SEQ ID NO: 34525 - DNA, 11389 bp, Chlorella protothecoides
  modified_base (333)..(406): a, c, t, g, unknown or other
  modified_base (872)..(881): a, c, t, g, unknown or other
  modified_base (1097)..(1106): a, c, t, g, unknown or other
  modified_base (1358)..(1367): a, c, t, g, unknown or other
  modified_base (3207)..(3216): a, c, t, g, unknown or other
  modified_base (4045)..(4054): a, c, t, g, unknown or other
  modified_base (5007)..(5016): a, c, t, g, unknown or other
  modified_base (5356)..(5365): a, c, t, g, unknown or other
  modified_base (5752)..(5761): a, c, t, g, unknown or other
  modified_base (6871)..(6880): a, c, t, g, unknown or other
  modified_base (7429)..(7438): a, c, t, g, unknown or other
  modified_base (7547)..(7556): a, c, t, g, unknown or other
  modified_base (7700)..(7709): a, c, t, g, unknown or other
  modified_base (8055)..(8064): a, c, t, g, unknown or other
  modified_base (8455)..(8464): a, c, t, g, unknown or other
  modified_base (9352)..(9361): a, c, t, g, unknown or other
  modified_base (9736)..(9745): a, c, t, g, unknown or other
  modified_base (10211)..(10220): a, c, t, g, unknown or other
cgtcgagtggctgcacgccgtggtgcacgccgcggcgcagcgctgcgagagcctgcaggccgcgcagggcgccggcgccctgcgcgcggcggcgctgcaggcccagctggatggcctgcgtgacgagtgcgagcggctgcacggcgccgcgcacgacgccgagcggcaggtggtcggggattctttggcagggattgggccgaacggtaccgaggctgcctgactgtgggcccacctgcggccgcatgattcattctacctctccacgtaaggtgtggatgcttgctcttcgtgacgcctgactcgccctctccctcatcaggtggcggcctnnnnnnnnnnnnnnnnnnnnnnnnnnnnnnnnnnnnnnnnnnnnnnnnnnnnnnnnnnnnnnnnnnnnnnnnnnccaggaggccctggcggcggcgcgcggcgagctggtgggcgcccgggccgagaccgccgcagggatggcagagcgcgaggcggcgacgcgcgaggtggcagacgcccggcaggcgcagcgcgacgccgaggccgccgtggcggaggccggccgccggctggccgtggctgaggaggcggtggcgaccaaggaggcccgcctgcgggagatgcggtgggtggcgggagctgcctgcagtgcaggatgtgggagtgaaggtggagaacggggcgcggtggcaggtagcatgtggtgcatcactcagactgtgcctgggtgcatttacagagtgcgatgccatgcgattcatccgcgccgcacccacgcaggcgcgccatggccgaagccctggacgagcggcgcgacacggcggccgcggcggagaaggaaagggcagagcggcgggagaccgagcgccagcactgcnnnnnnnnnngcggcggccgcggcggagaaggaaagggcggagcggcgggagaccgagcgccagcactgcacgcaggccgccggcctggtcggcgccatgctggccggcctgcgcccgaccgccggcctcctgaccgccggcgacgccgcagcgggcagcacgggggatcgcgcagtgagcgcggagggcgacaccacgagcggcagtgccgaggccgccttcctnnnnnnnnnnaggggatcgcgcagcaagcgcggaggaggacatcacgagcggcagtgccgaggccgccttcctggcagggctgcagcaagccgccgaggtgctggcccgcccgggcgccgccgaggacgaggggctcgggcccatgcagtgcctgactggcacgctgagcctgttgtgcgacgccgtgtcccactacgcttcggtctggagggactgggtgcaggtgtgtctggggcagagagggtccccagagtgttactnnnnnnnnnnctcggtctggagggactgggtgcaggtgtgtgtggggcagagagggtccccagagtgttactggggtgggggggggggggggggggttactcaaccccacgacagcaccggagcccctgcggggatgctgccacccacccatcaccaccgtcggcatggattcacggtctgtttgtaccaccacccataacatcaggcccaggccatgctgcgagacatccacgccaaagtggaggcggcggcagctgtagtgtcgacgcccgccctttcagtgccgtcgccggggtcaagtccaggtgggcctgggctccggcgcgagggggcgccggtcacactcgtgcgccagctgaggcggctggcgtcctcggtgctgcgcgcgctggagttgctgcaggccgagcgggagggcgcccgctccgccctgctcagctccgccgaccagcgagacgagctcctggacaaggtgggttgcatggtgggccgtcgaggcaaggaggggaagggaagggggcggtctgaggttggtaaatctgtactggagaagggggggcctgggcacattgtcattggatgaagctctgctgaaccccccctgcccatggggacatggcgatgccaagcacagttgactgggctgctgctagcttgcgcagatccgagacttgccgtttctgttgtaagacaaccaactccgcgcttccttcaatcccacccagattcggcagctggagcagtccctcgtcacagatcagcccgagcctggccagcggccagggtcgaattatgctcaggctgagctggaggcggccagggaccaggtcctggcgctggagcaggaaaatgctgagctggagggccgctgcgctgggctggagggcagactgagggaggagagggccaaggccaccagcgactgggcaggtagcggctgctggtgttggatgacgggctgagtcttcggtgcttgaaacaagtgagggcaggacaggctaaagaggggtggtgctaccgtgcttcccagtgcacgcatcctcatcccatcccatgtgaccccaactgcagtggtgcgacgggacattgcagagctggtatccgctgtcgaggccgcccagctggacgcgcagcgcgcggtgcagagcgctcggcgcgagtcccagcgcgccacgtcggcgtccctcctcaccaccccttcccccctgcgctccttcaatgcgtgattggctggagggcgacacgaccccgcactaccgcaaggagtcctgatgccgcggcggcgcagcggcggctgcaggcacccttgccgttggtccgtcagccggtgccgccctgacccaacatctcaactcgaaaactccctgtctgccctggcccccactcgcgaccacatactacacatgattcatgtatcatcatggcgtttgccccctgcacgcgcaggcatggtgcaccagacgtgcagcaggggccggcaatgcttgcaacaaagatagttagtcgtgggcaggggcgccgcagcatgacaatggttttattatccaaacacgctgcgagcctggctgctcaccgcatgcggggtcgtcgactggtgtcccattcacatgcgtacgaggctgggccgcgccacactccgacccaggcaccccttccctgcaaggccatccaagcatcgccgcctacttgatgtcatcccagtacttttcggcggcgtggcagttgccgtcgtagtcggcgagccaggggtgtgcagcagcgacgcgcttgccccgcgcactccccaccccgcccaggcgctcgagcaggcgcggcccattgaagcaggccgcccccgcctgcggcttgnnnnnnnnnncgcgacgcgcttgccccgcgcgctccctgccccgcccaggcgctcgaggaggcgcggcccgttgaagcaggccgcccccgcctgcggcttgaccttgaagtcctgcaacgcggcgtaggccgccagcaggtcgcgcgtgtacaccaccgcgtcttccagccgcacattcccgtgcaggaagtcgtagcccgcccaggcgatctcccagggcgtggccgcgctgccccaggagtaggtaccgttggcgtcaggggcgggcacgtcgtcctcgctggcgccggccagcagcgctgcggcgcctgggctgcgccgcagctccgccagcgcgcgggccaggctgggcgtctcctgcttgggcccacgcagcgcgctctggcccaccgtggagaagagagtgttcatgtcgcgcaccgcggcggccgtctcgttgcacacgtggtcctcctcgttggtcagctgcacgtagtcgcgcccgggctgcagcccgcgcgtccagaactcccagtactccatgcggaaggccaccaccagggagccacaggccagcttgtgcttgaggtcgcgcgacacgcccaacgcctcgacgtgcacgtcataccggaagtcgcagacctcctgcagcgccacgggcgagtgctggacgttgaacagcaccgactcggaggggcgctcctcggcggacatgcgtcgcccgcactctgagaaagcgcgcctgaagtggtggtgggaaaggggggggggatgagggggaggaaatagaagcggtgggtcgagaacgggtgcggtggtatggcctggggaatcggtcgtcctttgctatcaaagagcnnnnnnnnnnagcggtgggtcgagaacgggtgctgtggtttggcctgtggaatcggtcgtcctttgctatcaaagagcctcgcttagtcaacccgcccatcagcactcagcgtcttccccccatcatcccccatccagcagccagtacctgagctggccgcgctcgggatgcttggcgtccagaacgtcgccgcgccacatggcctggggcacccgaaccagcagcgaggtgttggagtacttttcctgcatcaggtgggaggcctcctgccagctcactacctcctcgccgtccacaccctgcatggggggttgggtgttgaggaggaagtgagaggggaggccaggggcgatgtgagagggtgcaggacgcagggctgtggccaggcattcaggtttgaggcacatggaagacagagcgcagaatggctggaatcccgccccaagagccctatggctggacgtgagtcatctcacgcatcccatccacaccaactccccacacccgcccccttcccttgctccccactgcgacacctcagcacctggatgagctggagctcgtccacccacagcgtgtagtcaggcagcgggacgtcaaaatggcgtaccgagccctggacgcccagcaggacctggggcgggccgccatgcatccacttcttgcgcatgcagggcacgtcgcccgcgtggaccaccgcatccacgtcagggatctgtggtttcaaggtgggggaggtgaagtgagggtgacgagcattggagtggggcaccctgggatgcaaagtcatagagaacggtgacgccaccgtcggtggtagcctggtgtagtcctgcccatagcattctggcattgagccacctacttcccccaccccccacgcacacacacctgggccccaaagacgctgagcgcgtccatgatgcccaataggacgtagtccagattccgccactcctgannnnnnnnnngcctgggatgcaaggtcatagagaacggtggcgccaccgtcagtggtagcctggtgtagtcctgcccatggcattctggcattgaaccacctacttccccaccccaccctacacacacacacctgggccccaaagacactgagtgcgtccatgatgcccaggaggacgtagtccagattccgccactcctgatctgcgcgagtgaagggtcagggaagacagggatgggttcaccagacacaggcgctcggcctcgccatgtcctcaggccactcgcacatcgtgtcgcgaaatgcaaggcacggcacattcacctgtggtggtgttgggcgcgtccagnnnnnnnnnnatcagggaagacagggatgggttcacccgacacaggcgctgggccccgccatgtcctcagcccactcgcacatcacgtcgcgaaatgcaaggtacggcacgttcacctgtggtggtgttgggcgcgtccagccgcgtcacccacaggctgccgcgggagatctggatgcgggccatgggcgtctcgcagatggtgctcatggccgtcgagaagcccagcagctcctgtgtgatccccgacgcggcccagggctgcaggtcagagtcgatgaaagacttgtactgggaggtcctggagagcaactgttgtacggggaagtggggttggtggggttactgcagcacggcctcggcccggtgcacctcgtcatgccaggccagattgaannnnnnnnnnagggggtggggttggtggggctactgcagcacggcctcgggcccgtgcacctcgtcatgccaggccagattgaatcctggcgagccaggccagccaccaggctcccccaccagcctcaccgtgtcctggtaggtgaggttggtgtggtactgcccagccatggctgaaggcgggacactgtgcttgaggtaggcatgggagtttggtggggggatggcgtagttctgggggtggtgcgaggtctggtaccagcggtcggacagggtctgaaccccaccctgcagcggcgtcgaccacaggtgcagggtgatcgccagcagcgccagcgaggagcaaacaaggatgggaatgcggaagcgggacaggcccttcttggagctgcgtgtgggagcccgcagcattgccacgcccgtctgcgtcaggtgctcggcagcggggtggttggcggaaagtgtctggggcggcaagagggtgctgcgcgcgcgttagtgcccttagttgttgatataatgatgtcagtgagccgttccaagtttgcaacaggcagcggacagggccgatctccgtgcgggcgaccaggtttctcagggcttcgcctggcccatgaactggccttggaccgcctgtaccaatcgtttgtgggcgctgtgctacggagcaccgacgacaaatgctttcaggcaatgagtgccctggaaccgaccaatttgctgtggttgcaccttcccatgagccgttcaggtggggaggtcccccacgtgggcaatgagcgcggaggccttcgcgggtcgtgcattcaactcacactccgatctcgacccgctttctaggggtttcgggacatgtcgcgcatcccagggaggaagatcccgcatcgtgtgcaacatcattccaaaaagcatatcgctagtatcgaaggattgctgtctgtgcttccaaaaagcccgctacagaacttacgggatgtcccaacatgcttgcttgctagccgtgcagtctccgacacccctgtcgcaatggcgatgcggcgcccttactggtccccaagcccgtagacacccgaagccgtttattaactcatccacacatcggatttaccgtgtctggcgnnnnnnnnnnacccttactggttccccagcccgtagacacccaaagccgtttattaacctatccacacatcggatttaccgtgtctggcggtccaatgggggcccgtgtgatgacacgcatggggcaggagggtctggtcacagcgtgatagtgcgatccgcccaagcacctcccaccactaacgacgaggtaagtagtggggatgcacttgaaatgcatgtccaagccgatcacccgttggaaaggtctatcaggacgcccagcttggtcctccctcactccccagcagctgcccaaggaggcgggctttagccatgtcatgctagcaattctggacagcaacaagggcttcagcaccgcttccctgcaagcgctccacacggcgggtgacttggcggctcagaacaggtgtggttggtggggatgggggtgaggtgttggaatcgaaccgcgcggtgctcgtcctcgacagggtgccctgctggggcttggcgaagcatcacgagccttcatcgcgaccggccgccgtccaccttccaacagagcgaagcttacggnnnnnnnnnnagcgcggtgctcgtcatcgacagggtgccctgctgcggcttggcgaaccagcacgtgccttcaccgcgaccggccgctgtccaccttccaacagagcgaagcttacggnnnnnnnnnnggggattgacagcgtcaggcaggtttttggtgttgcgggtttgtcaggcagcgcacgacgccacaagtgctctgcttgacgagctctgggtgcgtcctggctgccgcatgtggcctcgtcgtggaccacttttgaagccacttnnnnnnnnnntgatgtttttggatgacaaggacgcctcgcagctggatggcaaggtcgacaaggtgaagaggtgagactagggactgacagcgtcaggcaggattttggtgttgcaggtttgttaggcagcgcacgacgccacaagtgctctatttgacgagttctgggtgcgtcctggctaccgcatgtgacctcgtcgtggaccacttttgaagccacttgcctcccatgacccacacactcctgcctgtgggtggccccccagactcgcgctgtccactcatctcacccccggtcccccacacctgagctctctcgcccgcccacccacgcagcgagctggccggcaaggcgnnnnnnnnnnttcgcgttgtccactcatcgcacccctggtccccctcacctgagctctctcgcccgcgcacccacgcagcgagctggccggcaaggcgctgcagggcctggactttgccgaagaaaccgtggcgtacaccgagggcaagagctgtgtggccctgggcgaggcggtggacgccgtcagcgccgacgtcctggttctggcctcggccgaggtgcacgccgggcgcctggacgccaacctgctggccgagttcgtggactgccccctgctgctcctcccttgaggcggcggggcggcagggagtgggccgcgcccacaccaaccctcgaggacgaggtctgctttgtgcaccctcctcgcaacctcttgatacactgagcagtccaggcctgcnnnnnnnnnntgcagggcgtgggccgcgcccaagccagcctcgaggacgaggtctgctgcgtgcaccctcctcgcaatctcttgatacactgagcagtccaggcctgcacgtccttcactccgcgtacctcccccttgctttcccagccctgcatccaggggctacagcctgtgcactggacttgtctggcgtggtgcgtgttacacaagatcaactgtacagtgtgatacgcgtctaccctagtgcaaggacaggcatgccagcacttctaagaagaggatctagctcatgcgtgcggggcgaggctcgggtgccgcgcccacggggcgcgaggatgcggggcgccgacgcctctctgacaaccccccctcgctccctccgggggcgggccgggggaaggctgaggaggggcgagagggggacgggccccgccagcgccccgcggggtcctcagcggcagcagggccccgacatgcaccaagcattctctactcctagagacataaaccgatatgaggagctgatgggggggatttcggcacggggcactcataggcaagttcgggggaggggtgtgtggactgcattcatgagccaaaagggggctgaaatgagagacacggaagggacgtgcgggagggtgaggtaatatgcgccgtggtacgcggcgagggcctcgggcgaggctggcgcggcggcgccgagggcgtgcccggaggggtgacagcggcgtagcgccccgcacaaggcggtctgccgatctgtcctccgggcgggcacgagatgtcgccgcgccactatcatccatcgcgccgtggggatccatgccccgccgcggcggcaagccatgcggggggttagggggacgccgccgccttgcggcgcgggcggggcccnnnnnnnnnngccgccgcggcggcaagccatgcggggggtgaggggtccgccgccgccttgcggcgcgggcggggccccctggcggcgctcgagcactcgagcgccgcgccccgatcagacgttgatgaagctgccgcagatgggcgactggcggtagatgccaaacttctgcaggcacagctcccacatgccgtcgtccagctgcgacaccccggccagcgcgcctggtggtggtttgaatgggggaaagggggtgggttgaggccgtgtgcacgcgcgcgggggtgggtggcaagggggtggtcagcggcggtggacctcgagggcagggacccatgtgcgcctcaaagactctccccatccgagtaggggaggacgcagtcnnnnnnnnnnaatggagctcgagggcatggacccctgggcgcctcaaaaaccctccccatccgagtaggggaggacgcagtcacagtggctgaaattgcccccctcaccagccgcccccacccccctcctcacacacctatgtatccggcgttgctctcgatgccgacgcgggtggcggtgctgtcgcgcacgtcggcaaagtcgtcgctcctgccggagccatacacaagcgagccctccagcacatgcgtgtcctcctcgggcgataggagccccgtcacgcgattgcacacctgtgttgggaggcggagtttgggaggcaggatttgggaggagggcgccgggaatcggtcctcggcgatgcaacatggtgccagctctccaggctacggcctcgactggcacacgtaccccttccccaaactccccccccccccaaaaaaaaacgaccaccggcatcgcacctgtggcgccnnnnnnnnnngggaacacgtaccctttccccaaactcccccccccaaaaaaagaacgaccaccggcatcgcacctgtggcgcctccgggcaggcggcgtcacgatcctgagtgcgcgtgggtgggttcttgcccacgcccaccgtcagcgagcggcccgagtcacccaggacgtagcggacctgggccaggccccagcagcggtaggtgaacacggtgtcggcctggtcgtcgcccagcacgtcggccagggccagcgcggcaaaggcggtgttcatggtgctgcccagggaggcggagaaggcgttgtaggcgcgccccttctccgtgtagttggcggccatgttggagcagatccaggacttgaggtacagctcggactgggtgaggaaggtggcgccccccgtctcctgcgccagcagcacgttggcgggccagaagacgttgtcccagtcgaaggcgaacttgaagtcggacaccgcggcctcaaactcgaggtgcttgacgtagtagtcgtagacgtccgacaggtaggcgtcgtcggcggtggccttgaacagccaggccgcgccccaggccaggtcgtcgtagaaggtggagctgttgtacacggccgagatgttccagtcctggaccgagtagtagcccaggttggcggtggaggccgcgtacaccgacttggccttggccagcagcgtggccgcgtaggccgtgtcccccgtcccggagaagacgaccgaggaggcggccagcgccgcggccaccgacccgcccagatccgaggcgcccttggccatgtccaccacgtaggcggggcggggggcggtgatgtcctccagccggcgccagagcagctcctcatccgccacgctgccgatgcgcgacaggatgtaggtcgacccgcccacggcctgcaccgtcttcagcaggtagtcgctgccccagcggatgttggacagcaggtcgtcggccgcacccacgtccgagaaggcggccgtgtaggactcgtagccccaggccatgaccgcggtggagaaggcgatgggcagcgtggccttcagcgcgcccgcgtccatgcccgtgacccagccgccctccaggtcccagggtcccgactccagcaaaaaggcctgggggatgaccacagcgccgccgggcggggggggtgggggcggggggg

SEQ ID NO: 34526 - DNA, 1802 bp, Chlorella protothecoides
  modified_base (149)..(246): a, c, t, g, unknown or other
  modified_base (375)..(384): a, c, t, g, unknown or other
  modified_base (1681)..(1690): a, c, t, g, unknown or other
ggcctgggccaccagcgtcacggcgccggcacgggaggtcgcggcgtgcgccagcgcggtcgtggccgcgcctggggcggcggcggtgcccacgtcggccgccagctggccgacgccagactggagccggagcagggacggaagcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacaggcacacacaaactaggattgcatcagacccaggacactgagtccgtggacaatgaattccactgccctagctctggctcaaccatgaggacaccaggcacagggtaccgcccttcccccatnnnnnnnnnngcgggaggtcgcggcatgtgccagcgcggccgtggccgtgcccggggcggcggcggtgcccacgccggccgccagctggccgacgccggactggagccggagcagggacggaagcacggtgccgcgcaggagggtctgcgcgccgtccagcgtgcccagcagggcgggaacgtcgggcagcgcgtccagccatgggcgcaggcactccagcgatgcgtccagccccggcgcgtctacgttggagcccaggaaggactgtatgtcggccagtgtgccgttcagggcctctgcgtccgccaccgcggcgtcggccgtgcccagcacgcctgccacgtagccctaaggagagtgatcattgatggggagggaagggcgggtttgaaaacatccggacaggcacacacaaactatgagtgcatgacacccaggacactgagtccgtggacaatgaaatccactgccctagctctggctcaaccacgagaataccaggcacagggtaccgcccttcccccatcccaccccacccaagcgcgcacccccaccaacacatccgcctcacccgggcaccgtccaccacctcaaaagtcctgggcacgatgtggggcccgccccagggccccgccagcaccacgccgacaagcaccccggcagcgcacagggcgccggcagcgccccagacccggacgcgatgcagggcgcggaccttccgcaggcgcgccacgtgggtgagctggcgcgggcgggcgaggagcacgcagcgtcggaccgcgcgccagaggatgagggtcagcaggaaggcggcggccaggccggtcacgaggaaggcgggccagatggctggcagcacgatggacgtgtagtatggcagagattcgggtacgaaatcagtgttggatgcgggatcagccaggggaagggcctggcggtgggggaaaggcgggttgatggtgattggccgggggtgctgctactcgggcagcttcggttgtttgatggttccgagaactgccacacccgcccaggccggtcccatccacgcaccgtccagatcgcgtcctgacattcgtccacattattcataatgaatgtgttggtgctcgtaccgatcagagcgtgggcaagcagagcctcggtgttgccatgtcgatcccgctccgcaggtcaattagttggagacagcggtttgatttactgtcgaaagcagcttatgcaacacgagcaatctatgagcatgacattaccagattaaatcacggttataaaacgagcggcatgccgcattcgtccttgtgtnnnnnnnnnnctttgattcactgtcgaaagcagtgtatacaacacgagcaatctatgagcatggcattaccagattaaatcgtgcttattagacgagcggcatgccgcattcgtccttgtgt

SEQ ID NO: 34527 - DNA, 113 bp, Chlorella protothecoides
tgcccaaggtgaggcatgcagatggtggggcgcgatgaatcgtttgctgggccggtcagcccatgccagacatgaagcagcctccagcctccagccgcctcgcctgcacctgc

SEQ ID NO: 34528 - DNA, 123 bp, Chlorella protothecoides
ggatccgccgatgggattgaggtggaccctagtcccctgcccgttatgcaatccccgaccgacgagtccagattcggtgctgaggacgcggccaactgtgggcgacaagaggtggaagaggtg

SEQ ID NO: 34529 - DNA, 75 bp, Chlorella protothecoides
catgccacgcctcacgcacctttatcacttttttcccaatcagaaaaacaacgaggtgtcggaccagtgggttga

SEQ ID NO: 34530 - DNA, 7651 bp, Chlorella protothecoides
  modified_base (725)..(734): a, c, t, g, unknown or other
  modified_base (1100)..(1109): a, c, t, g, unknown or other
  modified_base (1173)..(1182): a, c, t, g, unknown or other
  modified_base (1406)..(1415): a, c, t, g, unknown or other
  modified_base (1621)..(1630): a, c, t, g, unknown or other
  modified_base (1731)..(1891): a, c, t, g, unknown or other
  modified_base (2073)..(2082): a, c, t, g, unknown or other
  modified_base (2945)..(2954): a, c, t, g, unknown or other
  modified_base (4045)..(4054): a, c, t, g, unknown or other
  modified_base (4690)..(4699): a, c, t, g, unknown or other
  modified_base (5093)..(5102): a, c, t, g, unknown or other
  modified_base (5508)..(5517): a, c, t, g, unknown or other
  modified_base (5696)..(5705): a, c, t, g, unknown or other
  modified_base (6305)..(6314): a, c, t, g, unknown or other
  modified_base (6515)..(6524): a, c, t, g, unknown or other
  modified_base (6914)..(6923): a, c, t, g, unknown or other
gctcgcgagcacgggcgggcggggcgaggaggcgagcggcgagcagcgcagcgacgcggccgcctccacgggcctccaccccgggctggccgacctcggcatcatggcgctcagcgccgcggcggccgaggcggggccggggcagggcccgcatgccgcagggccgcccgacgcggagcgtcgtgcctcagatgtcgctctggcgctgagagtgctgatctggctggtggaggccggggccatcgacccggcgcgccgcgaggcagaggtgttgcccctcctgctcggcgtcgcccggggcgccggccctcggccaggccagccggcggcgcctgcgctggaggctgtacgcctcgtggcccgcctgctgtgcgcggagggggctggccagggcagcgaacaggcgcagaccgtgctgctggcctgcttgcgggcagtgcacctgcacgcggaggccggcgcggaccccgctgtgagtgctgcagcgggggccgtgttggaggcgctggggtcctgcggagacccgcgccgactgctgaccgccggcctggccggcttgcggggcggtgccgcgctgcgcaggcccgccgcgctcgccgtggcgcgggcctgtggcctcctgacgacgcagcagggcagcgggagcggcacggtggggtacagtgggccggagtccggtctgccgtctgtgtcagagctgctcgacatggcagtgggagaggtgnnnnnnnnnngcgcagcagggcagcgggagcggggcggtggggtacagtgggccggcgtccggtctgccgtctgtgtcggagctgctcgacatggcagtgggagaggtggcttctggtaatgaggaggtcgcggggcagggtagcgatggtgactcggccgtcgccctgatctcggcgctcttgtcattgggcgaggcggcgtccgcgctaggcgctggcacgcgtcgcacagaagaagcagcgtcggccggagcactggaagaccgcaacagcccggccaccgcgcggtgcctgcgagccctccacgcactggcgtcatccccagcggcgaccgcggcggtgcaccaggccgtcactgacaacctggcccgcccnnnnnnnnnntgcacagaagcagcagcgtcagccggagcactcgaagaccgcaacagcccggccaccgcgcggnnnnnnnnnngggcgtaggacgaggatgggcgctgcgctgcggggcggcggtcctcgcgccttccctggacgccgcgcgtgccgccatgctggccggcccccaggtgagcacgtgcctttgccactccggcgtgttttggactgctgcacgtttgccctgacttgggggttgctatgaacagagggaccgatgtagccgtgatgaacagcagatggcatgccaatagcgcatgnnnnnnnnnntggcgtgttttggactgctgcacgttcgccctgacttggggtttgctatgaacagaggggccgctgtggccgtgacgaacagcagatggcatgccaatagcgcatgcacttgttgctgttggatgccacgaccttgattgagcagcatgctcttactgacgcaacagatcatgttgcaatgacagcctcacgctgtgctacatcannnnnnnnnncggcgtaggacgaggatgggcactgcgctgcgggccggcggtcctcgcgccttccttggacgccgcgcgcgccgccatgctggccggcccccaggtgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgttgttggatgtcacgacctcgattgagcagcgtgctcttactgacgcaacggatcgtgtggcaatgacagcctcacgctgtgctacatcacaacaaacccatgtgcaggggatgcgcggggcttcggatgcgctggcggggctccgctccgctgccaggttggccgtgctgacggcnnnnnnnnnntgatgcgagggtcttcggatgcgctggcggtgctccactccgctgccaggttggccgtgctgacggcaaacgcggccgccgtcgccggccgccccgacctccagccggccctgctcggccgcctcctcccggtgctcgtcgcggcgggcgaggccgaggcaggctcctcgtcccaatccctgccccgcgccgcgcgcgcgctggcgacgcagctcgccgccgcccccgcgaccgccgcccctttctctgcagcggtggcggcggccgcgccagagctccgcgcccgcctcgccgctgccctgcagaggggggccgaggcgggcgagacccctgcggcgggccgggacgagggcgagggcacagcggccgcgccccggcccgccatcgcactcaagagctttgggggcgggggcctagcccggccgccggccttcagccggtcggctggggtgaaggcaagccttggcccagccgacaactcagacgatgacgggtggggcgacgactgacgcacaccgctcaacccggcgccgccgtctctgcaccatgctgtgccatgcgggccagcgactctcgcacaaacttggcctggtagtgccggaggaccggctgggccagccaagcaaggggggttgcagggcgggaaacgctgcggatctcaaacctgttgagagggatgtaatgaacaggatagaagcgtggtttgtggaccagtgatgcagtgatccagggacaggggactcttgcgagctgcagtgtctctctcccaaacaggctggggtccccggcacggagcaaggaatcactttcattctcaccctcggaggcaagccaagagtaccacagacgccactcaccagacnnnnnnnnnntctcttgcgagctgcagtgtctctctctcaaacaggctggggtccctggcaccgagcaaggaatgacgttcattctcaccctcggaggcaagtcaagagtaccacagacgccactcaccagacatcgcccccagtctgtgggtaccacgacacgctgaaggcctcctcgccgcagatctggtgtccctgcagcgtggtggacgcaaactccagccgccggggcgagcggctggcgcggctgatgcgcagggggttgcaggaccacaggcctagcgagcgcgcagccacgagcacgatgccgcccaccacgggcgggggggcgttggtgaaggcccagcccagccggaagtggtcccaggcctccagcatcttgactcctctgttgaagaccttgcgtccctgacccatctgcagggtcgcattggactcagacttcaggtggcggcattgcaagtgttgagaaacacactgcgcatgaagggtcacccaaccggactcatccactcatggggggacccatctccctatcactcatgctgtcgcaaattccaccctggaagatcaccttgacgcggtgtctcgcactcttatacccagggatggctggagcgccgctctcaatcagggctgtagagcccacatgaggaaagttgtactccagcctgcaagggtaatgaagggcacttgagctttgaaggtggaagggctatgctcgatattgatgtttcctgcactcgaagctgagaagcacattgcatggatcacacctctgggaagctgcctcgatgtcctccagctctgaccgggtgggggcctgcaaagagaaaggaccgatgcgaaacccaggcatgctcaagcgatcgatcgacaagtttgcaatacagtttgaatttgtattgagttcagtacgctacacacgggtgtttcagtgcgtaggagcgggccatgtccacaattagatcggtgcatcgctgctgctgagcgaggcgtgcaatgttgggttacgagggcgccaccaaacagtggaccatcagattgtctatcaggacatgcatagaaacaatagaaaatttacatggccaatcttcttnnnnnnnnnncaggaacggtccatgcccacaattagatcggtgcatcactgctgctgagcgaggcgtgcagggttgggtcacgagggcgccaccaaacaatggaccaccagattgtctatcagggcatgcatagaaccaatagaaaatttacatggccaatcttcttacagaataacacaattttatgcgtggcgagcctgtcgagggaagttcacgcaagcacgccttcgtaaacctcttgtctcccaagccagcgtacctacattggcgattcacagtgtacctactccaacaaaaacatagggtgtggtttgttgaggagcatggccatgcgctcgatcgtacgcgcgtgctcacccctcggaacgctggcaggcacctccggctccaggctggcaacccccgcgatgctagcctgtggaggtgcttggtactccagtggccaagagcctccgtccagcaccgaacctccatctaccggcgatgtggtgcccgcagagggtggcaccgaacccgagaccagcgaggctccaggtacccagagggtccgttgtagatccttgtggcggcatgcgtgggtttagatgcagctgttgaccatacaccaaaacacgctctcccaccatccgctcgcagtcgataggnnnnnnnnnntgagagggtctgttgtagatccgagtggcggcatgggtgggtttagatgcagctgttgaccatgcaccaaaacacactctcccaccatccgctcgcagtcgataggtacgcaggcctcgacccaaactaccagtacagcaaggcgcagctggcacactacgctcccgacccagagaagcacaagaggttcttgccccgtctgtcacgcaaagaccgcagcagctatgccgacccacaggtcgagcaggagttcttcgaagaggtgcgctgacatggtcgtggtgcaaggctggtgggcgtattgagggctgctcatgggctctgccattggtaaggtcgagggtttggtgtggtgcaggagtcggtgcccgtttcaatccatgcctaggcatgnnnnnnnnnntgggctgctcttgggctctgccattggcaaggtcgaggttttggtgtggtgcaggagtgggtgcccgtttcaatccatgcctaggcatggcatggcacctctgaagcccctacatgccctgttctagatgccccactgcctggtcccaatccatcattgcaggcggagcgcttcccgcgcgtccccgagggcgtccccctgtacaacctccgcgatgtcgtccctgagatctaccagtcccgctcaggtgggtttgggccgggtttgtgtgctttcctggctgtgcacctgggaccctagggagctccaggggtagggtgcgactggaactgcctggacagcccacacagtcgtgtgctgcgtgccatgtcgccttgcccctctgccacgcactgtgcatcttctnnnnnnnnnngttgttccccaaggccaccccagaagaacaaccctggacccctctcccacaacacccaacagacctgcacgagacaatcaaggcggccaagcaggccatgcccgacaagtccttggatgagatcctggcggcggttggcctgtcgcatcccggcccgccccagggtcgcgagggggcgnnnnnnnnnnattgttccccaaggctgccacagaagaacagcccttgacccctctcccaaaacacccaacagacctgcacgagaccatcaaggcggccaagcaggccatgcccgacaagtccttggatgaggtcctggcggcggttggcctgtcgcaccccggcccgccccagggtcgcgagggggcgcgccccatcctggagtgggagagcacactggtgctggtgacgggcgtgaccgagtcacaccccgccaactggaaggcgcggtgcagggtgtacctgcgcgacctgcaggccgaggcggggctgagcgaggcggcgctgcagcacatcgcgcgtatcgccgggccacggtacgaccgcgggacggggcgcctgcggctcaccagcgcccgcttccccaaccgcgaggacaaccggcgggaggtgatgcgggcgctggaggcgctggtggcggagggccaccgcgctttccccagggagcaggcagaggcggctgccgggcaggctgcggcgcctcgggcctgacgcgtgctgcatcagggctgaggaccggtgaatggtgtcatgcaggctctggacggcgcagtgcaggacacggcgtggcnnnnnnnnnnaggagcagggagaggcggctgtcgggcaggctgcggcggctcgagcctgacacgtgctgcatcagggctgagaactggtgaatggtgtcatgcaagctttggacggcgcagtgcaggacacggcgtggcacaggcgcctctgactcggcgcatttgcacccccagaatcatttcccatgtgcgtgccccctgtgctgtctnnnnnnnnnnacgcgctcgcagtcccaggatcctttcccatgtgcgtgccccctgtgctgtctaaggatccacgacaacatgtgcgatgacagacagctgactcagaaggcaaagctcagcgggttgtgcatgagggggggggtggcacccaggggcccgctgccgcccgagtcctgcgcccgcgggggggagggtgtggcggctgcggcaaggtagtcggccgtgtactgctgcgacggcgacatgctctgcgcagatggtcacaaaaggggagggtggggggggtgggggagattctggcaagaagacaggtgtgatgcactctcgcgatgaccttgctgctgaaaaacacgtcatgccctccatgcctgaatatgcaatcgcggcagcaccgcctgnnnnnnnnnnagacaggtgtgatgcactctcgcgatgaccgtgctgctgaaaaacatgtcatgccctccatgtctgaatatgcaatcgcggcagcaccgcctgtgagcaccgacacccccctccgagagctcctcttcccatcccccaagcactgcacctggtaccaggcgggcgagtatccgagcgccgcattctccttgccgtgccccgcccctgcgtagccccccggcggcgtcttggcggccgacagcggcgtgcgtccgccggcgccctcgccctccatcgcctcggccagctggcgtgagagcgaggcgccgcgctcgttggggccgccgtcccagcggccccccggggtcgcggcggacaggggcgtgcgcgccagcgccagcgcgcgtcgcgccgcgctgtcacgaggcatgggccccggctgcggcgtgggcgcggcgctcagtgccgctgctgtactgcgcgctggtatcgggtcccagctccccggggctgggccggcgtgggctccgcgcacggggagcgggggcgtgggcgccgcctcccctgaacgccagccggcgcggatggcgccctccgggccttcctcgacccaggactgcagctcattctttgacggaggcccctcccgggcgccctgctggtcgccagcagtctcctcaacagcgggccgggccgccgcgatgccgcgccccggccaggcgcgcgccgcggaggccacgcccgcagcc

SEQ ID NO: 34531 - DNA, 67 bp, Chlorella protothecoides
accatcctactcgttcaattcatgtacagcagtccaccccgcccccacaacaatttggtttcggaaa

SEQ ID NO: 34532 - DNA, 63 bp, Chlorella protothecoides
ctgggctggagggcatgaggaagggtgtggcgcgggtgcaggcaggtgccctggggggttgtc

SEQ ID NO: 34533 - DNA, 80 bp, Chlorella protothecoides
gccgctggaccccgcccaccacttggacgatgcagcctcctggaatgtatccacgccctgcaccctgggcggtggtcttt

SEQ ID NO: 34534 - DNA, 241 bp, Chlorella protothecoides
ctggtgcgggatcgggatgggcgcatgcgtgagtgcatggctcaatcgcatccatgcgagcaaccgtgcatgcggtggatgttgagaagcgctgagagggtttgccagcgccagtcggcggatatgggcgagtgcacaggggacgggcacgacaccccggaacaccctgcaccctccatcccatgacagggaggccagcttcgggtggccggaggaggacgtgtgggccgagagcaactgg

SEQ ID NO: 34535 - DNA, 377 bp, Chlorella protothecoides
ggacgatttgatgatgtgggtgagggtgggcgggatagttctacggaaagagtaaggcaaaccaaaacgtgagaggggtacgtgctctgctccgctggttccccttgcacaggagggggtcctcagggtttcggcgcagggccacgcaaagaatgagcagggcgagcaggtgtgtgagctctgagggacgagccagctgctgtgggggcttggaagggtgctgtgtggagatggccggccagggcgcgcaatgtcagcgtgggctcgtgtccccggcgcagagtcttgaaaggggttgcgggtgtgcctggctggctggctggctggcgtgtgtgtgtggaaagggatctccacggccggccggcaactgggaagag

SEQ ID NO: 34536 - DNA, 78 bp, Chlorella protothecoides
aggccaacactgccctcgggcaggctccgatacactgccctcgggcatgggtggcaagcgggcgcacattggtccacg

SEQ ID NO: 34537 - DNA, 61 bp, Chlorella protothecoides
gggcgagggtatccgaccccgtgaacgcggtcctcatggccatgttcctcgtgcactacat

SEQ ID NO: 34538 - DNA, 357 bp, Chlorella protothecoides
  modified_base (92)..(296): a, c, t, g, unknown or other
acgtccgaaatccaattgtacacaaggatggccctcgcggaagctcaaggccctgcctgattttcatttcggcctcgaccggaggagagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcactgagttgttccaggctcgggtggatccggccaactccctccacccacctccccgt

SEQ ID NO: 34539 - DNA, 62 bp, Chlorella protothecoides
accgaagagcctgggatggcctgcatgtgtaataaagaggcaagcgtttattcagagcgtgg

SEQ ID NO: 34540 - DNA, 111 bp, Chlorella protothecoides
cgacaggcccaggaagccctccctgcattgtgccagcgagttcatgcggtgaggctggcatgtgacatcacaccaggtgcaggaccctgacacacggcctcatgcctggga

SEQ ID NO: 34541 - DNA, 63 bp, Chlorella protothecoides
gtgcacgatatcacaggaggaggagagcagcacaaggcacatgcaagacacgagaggtgcagt

SEQ ID NO: 34542 - DNA, 77 bp, Chlorella protothecoides
tggccttgttgacagcaggcttggccttctcaacagccttgtctgctgcaggcttggccttcttgatggccttgttg

SEQ ID NO: 34543 - DNA, 85 bp, Chlorella protothecoides
tctcatacacgtacctggagtttaggaggggggggaggggtttgtgtgtggatgtcaagcggatggtgagggtgtgaggattgtt

SEQ ID NO: 34544 - DNA, 138 bp, Chlorella protothecoides
gcatggcgtcttcaaaaagcccggcgaaagacggccgaggcatctgcccgagcagagcctgtgtaagatacgcatagaggaggtgggggcatctggaaatggctcgcccccccacaaaacaattcagcagtacagcag

SEQ ID NO: 34545 - DNA, 61 bp, Chlorella protothecoides
gcagcagcagcagcagctccagcagcagcaccagcagcagcagggcggcacgccgggcccc

SEQ ID NO: 34546 - DNA, 76 bp, Chlorella protothecoides
caagaggtcaccacccccacctgccaagagatcaccacccccacctgccaagaagcctccgccaccacccacccgg

SEQ ID NO: 34547 - DNA, 96 bp, Chlorella protothecoides
cgccacctgccggaccgagtcgatcaataagcgtatcaccattcatttgcaccttcacctgagcacactcccgcacactgacttcctgtgctcaat

SEQ ID NO: 34548 - DNA, 80 bp, Chlorella protothecoides
tggaacacaggcgatgcactcccacggccactgttccctactccccacagacctgatggatggtcaccatgacggtccgc

SEQ ID NO: 34549 - DNA, 68 bp, Chlorella protothecoides
ggacaaacttgataccgtcgcaaatgtgcagggagacgcgagggtcagagaagccgatggccatgccc

SEQ ID NO: 34550 - DNA, 138 bp, Chlorella protothecoides
gcagtgactcttgcatggaatcaaggggcatggaaaaacaagtgctgtaacaccgccgtgcaaagtgagtgcgaggcacatggcctcaggcacatccccaccaccactggcctccctcacatcttcacgggagaaggc

SEQ ID NO: 34551 - DNA, 80 bp, Chlorella protothecoides
gcagactttatcacacactccttttattgcgatactgtagctccgtcggagatattccagcccgttcatgccgtgcacca

SEQ ID NO: 34552 - DNA, 65 bp, Chlorella protothecoides
aaatgtttgttcttggcaccccggagccgttctctaccaagactcaccagcagctctgtggggat

SEQ ID NO: 34553 - DNA, 267 bp, Chlorella protothecoides
cctcgccaaactcttcaaacccagccgtccggagcgcttacaattgtaaatttctcatccgccattgcaccagttcctttacccgagatgtcagcgtcttggaggggggctccttcccgcgagtctaaaccgcatattttcagactgcgagtcagaggggagatttgtgtcatggctctgactgacagggccgagccaaaacctcactgcggagtatttttatacggactggcggtgcaagctcaatacaatacatatacataaata

SEQ ID NO: 34554 - DNA, 642 bp, Chlorella protothecoides
  modified_base (181)..(206): a, c, t, g, unknown or other
  modified_base (288)..(339): a, c, t, g, unknown or other
gcacgcacgccgcggtgcgcggccagcgtcgccgccagcgcggcgcacagcgcgtcgggggcgggcaggcgcgtcagcggcgccaggcaggcctctgcgccctggcgcagggcctccttcacgtccaccatcctggaggtgagatagtggagggggggggggggggggggggccgggcttnnnnnnnnnnnnnnnnnnnnnnnnnntgatagaagcatggctggaacgaggtgtctccgtcaaagcaacgggagggagcgccccccgcgggggggggggggggggggnnnnnnnnnnnnnnnnnnnnnnnnnnnnnnnnnnnnnnnnnnnnnnnnnnnntcgcacatcgacgcccatgtccctttcgagcactgcatccaccccaccctgcacctgaggaagatgcagggcacgaggcggtcgaggtgggcctccagcgccgcggcgaggcccggggaagccagcgcgcgggcgaggcagtccagcccggcggccgccacgcgggcgtgcggctcggcggtggcgtcgtgcaacacggccgccaggcggtcgccgaggtggcgcggcaggcgcaggcagggcgcctcgccgcccccgtcgtcgcgcgggcgcagctcccgggccaggcattcgaggcctgcg

SEQ ID NO: 34555 - DNA, 78 bp, Chlorella protothecoides
gcgcctgtgtgcgattttgtgggggagacgggggttggggaacgggtcaggctgggcgaggggcctcacgcgtcatca

SEQ ID NO: 34556 - DNA, 64 bp, Chlorella protothecoides
gtcgtttcgtacccccaactcacccctcccttctccccccgcacaacaaacccagatctacttc

SEQ ID NO: 34557 - DNA, 77 bp, Chlorella protothecoides
ctggtggatgcagctgggccccacctggagtctgtgcgtcctgaccctggcctacctccaccactccaccacgggct

SEQ ID NO: 34558 - DNA, 403 bp, Chlorella protothecoides
  modified_base (103)..(324): a, c, t, g, unknown or other
taaggagcctctggttgctggaggtgtgtgacgttgtatattatgagtctgtagacacactggtgcgtaaggctgctcatgttacttgcatgttgagtattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacccccaacagcctgtcggttttgtgatcgaggttcgacaggcgtgctttggggcggggcctgctgcgtactcactcg

SEQ ID NO: 34559 - DNA, 61 bp, Chlorella protothecoides
aggggcacggctggcgtgccgtgtggcctctggtccagtctcatgctggcgtggagggcaa

SEQ ID NO: 34560 - DNA, 61 bp, Chlorella protothecoides
gtgatgccggtccgcgatgaactcgttgtaaaccacggtggcctgcacccggctgaagggg

SEQ ID NO: 34561 - DNA, 61 bp, Chlorella protothecoides
gaggtccaacctcacaaaagccaccctgtcccccaatcctggcagccgcacctgtggtaca

SEQ ID NO: 34562 - DNA, 76 bp, Chlorella protothecoides
cattgcaacagtaccaataggtgtctcggcgtgcccggaaggtttcttatacccgtccggcggtgtatgcaccgat

SEQ ID NO: 34563 - DNA, 62 bp, Chlorella protothecoides
aagcctccggagagggggcccccacaacaggaccccatgtccctgcatcgtgcgtgatgtga

SEQ ID NO: 34564 - DNA, 78 bp, Chlorella protothecoides
agtcgacctcaggccccaaccctccccactcttcattctcacgcttcattctgcgtttgcatatcacagcagcacatg

SEQ ID NO: 34565 - DNA, 61 bp, Chlorella protothecoides
atatcgttactctcgatttctgtggcagacctccccctggaaactgattgtgctggcggct

SEQ ID NO: 34566 - DNA, 77 bp, Chlorella protothecoides
gcccatgttcgggttcgccacttgcgcaagccacaccccgcttttgccgacaaaacgggggttatggtcacccctcc

SEQ ID NO: 34567 - DNA, 72 bp, Chlorella protothecoides
cctctcaaacatgccatgccatactatatcgcccccccccagttcccttctttctttctctacacacctggc

SEQ ID NO: 34568 - DNA, 64 bp, Chlorella protothecoides
cgtctgcgaggcgcgctccgccgcctctgcccttgcctgcgccgctgtgtttgccgcggcctct

SEQ ID NO: 34569 - DNA, 67 bp, Chlorella protothecoides
ggcgtccaggaggtgcacgcgcacggcgcgagtgcccgcctccacctccacgcggaaggcgggctcg

SEQ ID NO: 34570 - DNA, 151 bp, Chlorella protothecoides
gcggccggcatcgcggatgccatggtctacttgcaccccaaagtggtgcaccgggacctcaagtcgcaggtgcgctggcggggccaggaggctggggagggacaggactgggatagtatgtggtcccactcagatggggtgagttgccagc

SEQ ID NO: 34571 - DNA, 74 bp, Chlorella protothecoides
acaatgatgaggagcctcccccccacccacttcccaccacatcacacacacaggctaccaaacctaccagcagg

SEQ ID NO: 34572 - DNA, 747 bp, Chlorella protothecoides
gcgcgcccgggggcacggcgtcggagccgtcgacgggcgcgaagccgttgaagagctcgcctagcgcgcgcgcggcgtcggccagcgactcgcgcgcgcccagcgcgtagtcgtccacgcgctcgctgtcctccggcagcgagtcccagagcgcgcggaagccggcgggcgcgggcgcgccggccacgaagcagcccaggcccagctccaggtcctccaggctgtactcgtcctcgtacccctcctcctccggctcccccagccccgggtcgatctccttgaccacgaagcgcagggtgcagcccaggcgcgtggcgggcagcgccgcgccgggcggccggcgcagcaccgcgtaagcggtgcccggcacgtcgtgcggcgcggaggccaggggcaggctggcctccagctgccagccctcctccaggcccaggtccacgctcacaccctccagcacctgctccgccacggtgttgaccacggtgaaggccagcaccacgcggtcggccagcacgtgggccaccgcatccaccttgtactccgtctcctcctccgtcagctggcgcgcggtggggtggtgggcagtgaagcggggggtcaggagagggggggtggggtgagggggtggtaacgcatgctcaggcattgtgagacaatgagtgccaccagcccagcgcgtggtgggcagggaccggcgcagcttccccactgcaagactcgctctcggccccgacctgccccgctcat

SEQ ID NO: 34573 - DNA, 142 bp, Chlorella protothecoides
gggcaatgcctgctgattgaacgccgcccgacccgtggtagtatccacgccgacggcccttccacccagggttccttggctccttcatacagacacacgcagccggtcctctacccacccacccaccaggcagacgtcgtcc

SEQ ID NO: 34574 - DNA, 263 bp, Chlorella protothecoides
gcaaagggcgatccagtgcaggtggggaggtggtgcatgggcgggcttcagcccctgcttgacaagggtgtgggtagatctgatcctactgagaaggttgacaagtccgagaggctgtcaggcgctttgaccagcctctaccccagctacttctacccccagctactcctgcgctgggtgtacagtctcgccctcacaaacacacttgtttcttctgcatccatctgcctcctgcactcctctccccatccacccacaagcac

SEQ ID NO: 34575 - DNA, 61 bp, Chlorella protothecoides
gcccagcctgagatctggcgccctgagatgtggcccaatgccgaccccgcgatgcgaccca

SEQ ID NO: 34576 - DNA, 61 bp, Chlorella protothecoides
gaacccttgcaacggggacactcagctccagcgagcacctataatcgtgacgaaatcacca

SEQ ID NO: 34577 - DNA, 82 bp, Chlorella protothecoides
tccgcgcagacctgggtgggtaggatgctcgtttcacgtgtggttgttggtcgaggggcacaggggatgtgatgccctgcag

SEQ ID NO: 34578 - DNA, 79 bp, Chlorella protothecoides
cacctgcgttggtctctgagcccacgacgaagcggccgtcgggccgcgcgtctaggcccacaaaaccccgctggttggc

SEQ ID NO: 34579 - DNA, 61 bp, Chlorella protothecoides
tgccagggctcgaactgggtgctgaaagggtccaagcctaccggccggacacctgtcccgg

SEQ ID NO: 34580 - DNA, 64 bp, Chlorella protothecoides
gcagacggcatgcttgccagtgctcgctacaagcccagggccccaggcgcgagagggctgatcg

SEQ ID NO: 34581 - DNA, 61 bp, Chlorella protothecoides
atctgggggattggacaggtgtcccatgggacccgccgagaagctgacatcagctcgcatt

SEQ ID NO: 34582 - DNA, 61 bp, Chlorella protothecoides
tggccccgaggagctgcagcagctccttgcaccggtagcaacccagctggaagccgcaggg

SEQ ID NO: 34583 - DNA, 61 bp, Chlorella protothecoides
cagcgcgctgtcgtacgcgcgcgcggcctcctcctcgctgtcgaacagctcgcggtaggcc

SEQ ID NO: 34584 - DNA, 69 bp, Chlorella protothecoides
ctgcgtcgaaggaggggcccagggtgagggggtgaggggggggtccagatgccgagatttgcggtggaa

SEQ ID NO: 34585 - DNA, 61 bp, Chlorella protothecoides
ccccagctcctccgtagcctgtcgagcgctgtcggtggtggagtgtctacccaccggaatc

SEQ ID NO: 34586 - DNA, 272 bp, Chlorella protothecoides
ggaggggtcggtccatgccgcaggctccggggcggggggcgaggctcgccggtccgggttgatcccatcctcaaaggaaacctgcgctttgaagggtggggagggtgggtcctcggtgccgtatccagaggcgggtgtatatgtgagcagctccccgtgggttcgctgctcctagagtaactctactggccccactggctgctaggccgcgctcgagcaccccacagcaggacattgggctcgcccacatgtagagcaatctcgaggcagaa

SEQ ID NO: 34587 - DNA, 115 bp, Chlorella protothecoides
gcagccactgggcaggctgacgggcaggcctgccagatgctgtgggaagtgcctccgtaccgtgccacatctgagtccggtcgcaccccctgccgtgtcctctcacgccttctct

SEQ ID NO: 34588 - DNA, 74 bp, Chlorella protothecoides
gggcatgcgcgaggcatgcgtgttcccatggagagggtcacacaggcatgttgggagtgtttgtgtggctgctg

SEQ ID NO: 34589 - DNA, 77 bp, Chlorella protothecoides
tgcgccagcctgatcttcggaagtagctgtttgcaaccggcgcgagcccggcaggggtgtggtgaggagattcggcg

SEQ ID NO: 34590 - DNA, 91 bp, Chlorella protothecoides
gggggtgaccgggagggagtctgggatgggttccatgcagacacatgatgatggtcatgcggcgatggaatgacacattggcacaaggaca

SEQ ID NO: 34591 - DNA, 65 bp, Chlorella protothecoides
cagacctcctccgcccgggccgtggcggaccgggaccgcaccgcctacgaggcggagggtctgcg

SEQ ID NO: 34592 - DNA, 64 bp, Chlorella protothecoides
caggaaatgtaaagacaccctgaagaaagtctcctgaaatgacgggaatagtgtcctggggtgt

SEQ ID NO: 34593 - DNA, 73 bp, Chlorella protothecoides
aaagggggaatagaggagggacaggagggtaaatacagtattgacgcaggacaacaggtggaggggcaaggga

SEQ ID NO: 34594 - DNA, 93 bp, Chlorella protothecoides
ccgtacccgctgcattggctgctggacatagtactcacttgaatagcagcgcaacttaaagaacaaactcagacctgaccggctccagggccg

SEQ ID NO: 34595 - DNA, 80 bp, Chlorella protothecoides
cttccacaagaccccttctctcacctccacataacatgtaaaggcgttaaatccagccacaatgtcccactggccacatc

SEQ ID NO: 34596 - DNA, 76 bp, Chlorella protothecoides
tcctccgacggtactcggtcagctcctgtgagtgtgggcccatattgggggggccaggttgggggtgtgaaggctg

SEQ ID NO: 34597 - DNA, 61 bp, Chlorella protothecoides
ctctcgttacctccccagtttgctggcagatttggcctaccccaccttcgcctccctgcga

SEQ ID NO: 34598 - DNA, 62 bp, Chlorella protothecoides
gtaggttggtttgctgagtgtcgcctcaatacccccctcccctccctgcctcaccccagcag

SEQ ID NO: 34599 - DNA, 67 bp, Chlorella protothecoides
cgatacctggaccgtgcaggctgagattgcatggggagagcaggcaccacatgcctgccagccgtgg

SEQ ID NO: 34600 - DNA, 61 bp, Chlorella protothecoides
gggtggcgggacactcctcgtgactggagcacccgacgtcatcatcctttacaagtataca

SEQ ID NO: 34601 - DNA, 77 bp, Chlorella protothecoides
cctggcagctctggcgctgccaggacgcctcctcagcaagctatggacgtgccagcgagcgcctcgcatgatcggac

SEQ ID NO: 34602 - DNA, 61 bp, Chlorella protothecoides
ccagcacccggccgttggcgatgctgctgacctcgatgccggagcggttgccggcaagcac

SEQ ID NO: 34603 - DNA, 76 bp, Chlorella protothecoides
cgctttccagcgcctggtgctgcaggcggccgcgagtcgcgactccccgccctaaaactgcttgcccatctccagc

SEQ ID NO: 34604 - DNA, 78 bp, Chlorella protothecoides
gcagcagacgcaggtgcgcctcagcgaggctccaaacaaccagcgtccggccactacgcacaccctgatccagatgaa

SEQ ID NO: 34605 - DNA, 117 bp, Chlorella protothecoides
gcaacggtgtcgctcctgacgcggcctgggtctcccatctcccttcttcgtgactctgctggcatgcaactccctggcctctgcaccaacccccacccccggtcacccttgacaaca

SEQ ID NO: 34606 - DNA, 79 bp, Chlorella protothecoides
aggacgccaccggcgagcccgggatcatggaggggggacaggggggtggcaaccacgccaagctggtgggaggcctgct

SEQ ID NO: 34607 - DNA, 102 bp, Chlorella protothecoides
cccccccgggggggggggggggggggggggccggatgagcggtgcaagaggtgagtacatgccatggtctgaggcatccacaacctgcggcgcaggttggca

SEQ ID NO: 34608 - DNA, 144 bp, Chlorella protothecoides
ccagccggtgcgtcctcggtgtctttgtgggggtcaggggtcctgaatctcttgtgcagggagcggtgacccagcccggcagctggtggactgtcaccaacacacatcgcacctacctccctgcaaaccctccacacagccagg

SEQ ID NO: 34609 - DNA, 118 bp, Chlorella protothecoides
tgaagtagaaagatatctggtgggcccgacatcaggaaacagcatttgaggcaggccctggcccgtacatgtgaagacaggtgtcattctgatccataatactgcaggatgagctggc

SEQ ID NO: 34610 - DNA, 61 bp, Chlorella protothecoides
agtcgaaggtggtgggcagcgagatggatcgaagacctgtcctgcctgcatttgttggagt

SEQ ID NO: 34611 - DNA, 61 bp, Chlorella protothecoides
ggctgcctcgggtgccaggttcccagctcgcagagtcgatggagggaccacgtcctcctcg

SEQ ID NO: 34612 - DNA, 10472 bp, Chlorella protothecoides
  modified_base (626)..(635): a, c, t, g, unknown or other
  modified_base (797)..(806): a, c, t, g, unknown or other
  modified_base (1626)..(1635): a, c, t, g, unknown or other
  modified_base (2076)..(2085): a, c, t, g, unknown or other
  modified_base (2579)..(2588): a, c, t, g, unknown or other
  modified_base (2926)..(3175): a, c, t, g, unknown or other
  modified_base (4440)..(4449): a, c, t, g, unknown or other
  modified_base (5513)..(5522): a, c, t, g, unknown or other
  modified_base (6183)..(6192): a, c, t, g, unknown or other
  modified_base (7172)..(7181): a, c, t, g, unknown or other
  modified_base (8655)..(8664): a, c, t, g, unknown or other
  modified_base (10235)..(10244): a, c, t, g, unknown or other
gtggggaggggggagagggcggaggcggggaggggaaaggagatgggggtgaaggagatggaggaggtggagagggggacgtaggagagggctgaggagaggggggctgtattggaggtggtgatctctttcctggtggagtgggaggcatcttactgggtggaggggggaaggtcttcccaggcggagggggggggatctttctgggtggagggggaggcagcttcttgggtgaagggggaggcagcttcttgggtgatgggggaggcagcttcttgggtaggggcggcggaggattgtagttcacacgcacagaaatgcggagttgcttgaggtcacatgtgttgacgacctttcgagttcccgttgcattattgcaccggagattagtgcccttgttgttgtctccccagttgctgttgcccttgttgtagctccctgtgcagttgggagcaggcacaacgtatggatggatggaatctgtcgtcactaacaccactcctacaacccaagcttgagtagcccaattgacccagtgcccacagtctgtctccccaattcttgctcaccaatgttgctgtcgccgtcattgtagtcaccaaagttgttattcccatggttcccannnnnnnnnnaaagctggagtagcccatttgacccagtgccaacagtctgtctccccaatccttgctcaccaatgttgctgtcgccatcattgtagtcaccaaagttgttcttcccttggttcccggttcctatgttgccgttcttgtcagccgtgcacgccttctgtcccnnnnnnnnnngttccaatgttgccgttcttgtcagcagtgcatgccttctgtcccgtcctgaggcattcaacgctgacaataacctcggtagaccgcgcctccaagaccctgaaaggactcatcctaatggcgctgacagaaatccccaaggcatggagggtggatttcctgacggaccctgccttgctgtacccttgcgatctggaataggtgatgcttggggatcaatacagtgacaggaggaagctccatcacaaacacatccaacatcgtccaaacaaactcattcgagcaacagatatgcaaggaccctgctcatacctgcagagatcatctgcactgttgagctccagcacataaacatgcggtccatacctatgagagagtggcgaggatgaggagtgaaggggtcggttgtcagagtccggacggtgcgacatccgctcattccccaaaacgcccgcagactcggatggggcaggccgggacgacaatacactgatcccgtcagccagaactcacgtggctcccgggagtgagaaaaacttcgtcgtgcatgcgccctgaaggagtgggaggggccgtgctttgctcttccaaggtggatggccgtacggaccatcccctgcaatacgagtgctccgcatcgccagcatccttcgacattaccttcgcgagcacaccaaggctcagtacgagaagcgtcaggcccataagaggaatgcggccctgcgaagccatcgtgccgcacgactcctaataggacttctaggttcgccagatgggtcctcctccagtatattctaggagcttgagaacttatgggaannnnnnnnnnctccgccgatatgtgtgaggagatttgagacatttgggggattggatcaggaatacgaacatatgtgttgcttgctctctctaatcctcccacctcttctttccggatgtgatgcacctcccggaaaggacacgactgcacaccagcttctttcctgccgtcacaagccaaagctcggcgatggtagaacccgcgctggcttccctctcgggctcactctgatccaagaaactcgcaagagcttacataacaatctgcatgtaggccattgtccctgcactgctgttgttgcagagtgtcggcactcgtcctttccgtctggacttacgacctttcaggttttcaactcaaaacgtgctgccccttctcaggtcttcctgcagtaggaaacaagatacaaggcaaaagttttgaggcatgccgcgacatgtgcagtaagtnnnnnnnnnngtgacacgacgactccagcttgttcccgccgtcacaggctatgcgataggaggacgcgcgttgacgttccaatcaactcattggactgaaaccaatgtaagatgttcgaagatggctccctgtgctctgcatatcgtccagccattgtcccggcagcaatgctgatgcagaatttcggcctccgtgcaggcgaacgacctatccgtcttgatggggtaaactgtgccaccacttcctaagccttgctgcatgaggaagcagtaacaaagcaaaaacgttgaggcatgccacaacgtgaagtgaggggcgcaaaaatcacttcctagacatgggacgggatatacatgtgcattctcacaatttgacagggctattccaacgaacaggataagatggtgtctgatggaggatggaggtatggaacaccccaatggaatgctgattccagggcgttctcaggccacaagctcataggcacggcatgcaatacccannnnnnnnnnagtgtagaaggcttgtcaggggatgttgacgccagggctttgtaaaggcctcaagctcataggcacggcatgcaatacccaagtctcaggcatgacgaggttgtgcacattgaagaagggagagtgcactgtccctgatgatctgacatgggttgaacatggacttccgcatccctgcatgtgtggtggcgagttttgggagggcatcaacgttgccaacagcatggaccccagtatcccaaacctcacctgcagaggtctcctgtactcagtttgctcctgcccagctgtacttgcatcctccacagtggtgctacagatgcactccagtacaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccaaaactaattgcgcaggggctggaatctgcagaagccaccatgcagctggcgtaagcccagcacgggttcttgtggcatttggcagtgcatatctttggaggtgcgatactgattgccgccccaccaccagcatgtgcaacggccgcagtaaacaagatgccaatgggccgccacaatcggggacataatgccgctgggcaacttcatcgtcaaccagggctgcatgagcggggagtgggcggccgcatgagggtgctggggcccgacgctgctggtctcgaggggtccagcaactcaagggtgggtgtggcgcatccatcatctcgcctcaactccgggccgatgtcagcatgcattttcttgggctcatgcccctctcacagcttcaggacgaacttgaaggcagccgactgggcgcccacgtcgctcagtgccgcaggctcgtcgcatccctcggcagcgccgccagactttggcaaaggtgcagcctcgctgggcggggctgcattggcctggccgagcacaggctgatcgtccccggagatcgtgggaagagcagagggcaggcgcagcgtgatgcgttgtggcgcagagacatcatcttcggcaggtgcgggccctgtagggtgcagggagggatgtgaccctgcgcaggccgtacatctggtggactgcatcaatccttgcacgcacgacgcatcctggcccagcagtcggtcaccatcgatgatgccccacattcactggttgtccaaccacccattccctcaccgtcttcctcagcatcctcgacggccagcgagccacccagcagcatccgcatcagcgcgtgcagtgcatggcgcagctcgggatctactgtggcgcttgctgtggcctccagctccaagaggcacacggattgcaaagtcccctcaccgccatccagacgtggagacaagagcgcccccagtgtcggcccggcgcacagcagcgctcggaccacagaggccttggcatatgagcccctggctacccgcagagcgcgcagcgcacccgccacggcagcctcaggcccccgcgcagcaagctcgaggcggaggcgggcggcggtggccgcggtggccagctccggcaacacgtcgccatctgcgatgatggacgccagcgtggcgcgcacgcgccgccaaatctcatcgtcaggagatgcgcccgggccggaccccagcgtggccagtgcgcccaccaccgcctggcccacgacgccgctgggtgaggggnnnnnnnnnntgggccggaccccagcgtggccagcgcgcccactactgcctggcccacgacgccgctgggtgaggggcagaccaactcgcgatgtagggatcgctccaacagcaccagggcagcgtctgtgaactgcatgaggagtaatctgtgcatcagaggggacgcttgcagaggcagagctggttgggtgctggtcggcaccaggcggaggctgggtgcatgctcagagccatctgaataccgagcatcaagagcaagggatgcctatacagaggtagccatcaggtcaagaacacgatggccgaggtaatgcttgacagcagtgcaggcgcatagattgaggggcaccatgcggccctttccaccctcgcgcccctccttccttgtcagccagtacaaatccagtcctcacccagtcctcaccaagtcgtgccggatgttgccgactgcactgcacagggccgccagcatgtcactggtttcgtgtgcattgagatcacttgggaactgctccagagccgtggacaggaagagcagcacgtcgatgggtgtagtgccgtcgtcatcgcgtgagaggcccactgcgacaagtatgagttaatggggtcatgctggcatcatgttctggagtcaagccacaccacgtgaacaatcctacacagctcatgacaaagtggcgccgacagctgcagaacacatttaacacagcacaagaagaactgacgcagcatcaagcccctcgcacagggatcccaagacgggagacacatcactcacatgcgcggatgatggcctgtcccacaagcttctcactcagactgtgttgcgcgcaagacacaggcgcatccagtgttgcatcccagaagtgctttttgtagaatgccagcagtgcagcgatgcctgtgggggaatgtgttgcaggactggcagggcatctcagggtgctatcagcagcacacccacgacaacatgtcatgagtcagcgtcctttcgccagcacactataaggattgctcaccttctgggacccctgcccctcccgtccggcgccccagtgctactgcggcgtnnnnnnnnnncgcaatcagcagcacacccatgacaacatgtcatgagtcagcgccctttcgccagcacattataagcatcgctcaccttctgggacccctgccccttccgtccggcgccccagtgctactgcggcgtcagcgcggacacgatggtacacaccctcgtctgtgaagcagcgtaccaaggctgcgactgccgccagagacggatgctgtgccagtgccgccactgcttctgcctgtacaggtgacatagagtatggatgcaacgataagatgcggagtcacacctgttcagaggttcctgcgggtctcagagtcccgcatgcaagcccatgctcacctgggccacgacatcccggctgtgcgccagctgcgcgacccagcaccggagcggctgctccagccacaccgagcacagccattccccgcctgggtcgatgcgcacccactgcaccggctgcaaaggattctccactgcagcatgcatgggcacagccaagggttgaggtgagggcagaaaattcttcgggcagagctgccaggcaatcatatcgtgcgcaccgtctgcagcctctggcaacctcagtgactctgccaaacgcaaggtccacacccagatatgaaacacaatgtatatggactgtcaagggttggatgcgtaatcctnnnnnnnnnngctgccaaatgcaaggtccacacccagatatgaaacacgacgtatgtggactgtcaagggttggatgcgtaatcctatcgaaagccacaacacccacctccttccaaggtagacaagagagccgcgctctcatcctgcgcttcctcttgcaccttgcgtcgcttggctcctcgccgaccgggcaccttcttcacatccgggttcaccttgagttccgcaagtttccatggctcggcgcccaggtgcacagggtgctcaaccgcgacctctgcctcctgcacgcttacacgcagtattcccacgcccgctcctgctgagtcagagacacgagtcgctgcggcagcggccgctgctgcagcgcgcgtcccgccctcctgccgcaaggccagctcgaggacgctgcgtcgctgcgggcccgcgtggtagacaaagccggcggtgatacgcggggtgccagagcccaagacccagcgtgcgaagaaggcagggacgtccttacgaaagccggccagccttcccagctccgtcacaaactgtgtggcgtccagtgttcgtgagggcggagtagcagaagtctgagagggtgcaccggcgccagtctccgctgcttgcgtggatgcttcggagagagctgcagccactgaggtttggacatgcttgcggaatagatcctcgcccgcccgccgctccaacaggcgcactaccgcggcagccttcaaggtagagaggacgagagcatctttgcctgtggcatcttgcggtttctggggcaggcgcaaagggcagatcttgcagtctgcctgtatgtccttcgtatgcatgctgcctccaacaagtcagacccttggccacaccgccgacgaccccaccacaagagaagaagccgtcgtcacttccagagcgccgaatctgagagctgcacgagtctcccctcaacccctttcccccgtgcatccaagcataccttgagttccatgacnnnnnnnnnntttccagagccccaaatctgagagctgcacgggtctcccctcatcccttttccccttgcatccaagcataccttgagttccatgacctctgaaagggggaatgcgcccgccagcagctgagcagccgtcgcggcaccaccaggcaactgggacgccaggggtggaagactgccgtcatcagcggtgcacactgcagctgaagctttccatttccgatactgcagctcattgcgccccaggtactcgcggatgaactggtccaccagccaggctgccagccccgtcaccagccaggcatcagctgggctagctgggcgcagggccagcccaaacacctgctttgcgaatgcagcggcaagctccaagcgcgtgccggtggccccctcatcgcagcccctggtgaccaggcaggttgtagggtgcacagcccagccaggggtgatgtgcggtcgggtgagcacacccgggggcacaaacaccttgtgtgaggtcagggggtggggaggggatgagaccagatgagcaacagcatgcacctgatgcacacgcccctgaagaagccgcgcggcacagactgttgaggccgacgcacagcccccagggaaagcgcagccggagcaacacccccacctgggtgtactcctccagtggcagtggcaccaagagcttgtcagaatagcaatcgtttagcagccccaggaatgccgcggtggcttcgaggcactccacagccgactgtggagcatgcagcacgatgcaggggtcgcctggcttggcaggcgcccgatgccagcggccatggagtgcgcccgcggctatgctcggcgtggcaggctgcgccacgaggtactcgtacctccgctgactgctgccatgcgctcgacactccagcatcttgccggaggctacggccacatggccttccggcaccaccaggaataagcggagcggtgtctgggccacaatcacatcccgcccgtcgctgagcagttctggaaacagaggccgcggccagggaccctgcacgaggtggactcatgagctgatcaaagaggtgggtgaagcttgacggaaagagggagcatgggcgacgacgaagccaccatcaaagcaagcttgcagacatcaacatggcgggaccagagacgccaggttgcctcaaggcgcacctgtgcagggcctgcgccagcgccgccatggcagagcatggtgccatagtcattccgtagactgaagcggaacgccacggtcacgtgtgcatgctgcagaggggcgtccagtacactgggcatgggaacagacgccacatgaccagaaaggtcgtctttgaagtggcggatgtgtgcagcagtgacagtctccagtgagggagcctccaaaggcaaaggtgagtcggcgcctgctttactgggactgagttggacctccacgccgttcaccaaaacgcaggtcaccgccagtccagctgtctgannnnnnnnnnggcctccgaaggcaaaggtgagtcggcgcctgctctactgggactgagttgaacctccacgccgttcaccaacacgcaggtcaccgccagtccagctgtctgaaagagcagggcagctgtgctgatgggaacctccaggccgatctccgaccacctgcacagggcagtggcaagctgtgaaacatggttccttctccggatgctagaatgagagcacattcctcctgcgccgcacccggagcaggcctgcttgactgtcgacacatttaagaacacagtctggctcagtatttttacgccagatgggtcctgatccccaggtggggccattttcgatcagtgcccagctcctgtcaagtcgtcccaggcggtacaccgccgcacgctccatgtgcgaagccatccatactattaaagtcaacagcaatccatcgctgcccaaagatcaagccatgggcagcgagattggttgtgtccaaatcaggcagcgccattcgtcgaacaaggcgccaaccacatctagctggagatagcaaggacttcgggaactcagctgttgggtaaatccagctgcagatcaatcgcgacaactccctgctcctcaagaccaggactgatttctgagtgtattgtagaggatccctggtgtgctttgcaggcatcatcacttgttccagtctgcatcggctcggcaaagcccaggaatagtccagtattcgattgcaagaagtgtggtcggggacatttgtgagcagcctggcgcaatcgagtggtgggcatgggcggcatgtacacaagatggaggacaagccagtgcagtactcctgtgaacgctccatggcacccctgtcatagggcacggctgcaggatcttgtgacacctggaaggccacatgttggaagagggctccttccactgctgtcaagactcctgcggcagacaaagaccctgcagagcgggacactgcgtcgcctctgccgccatcctcttgtccagggagtggagggcctgctccccatggtggggacaccatgccaggtaccccctggctacctgcaagcgcatgggaccccgctcagtggtcgtgcctacgccctgaagatgtgcccgcgccatcccactggcaggagtgcacctgccaggcacactgttctttgcagggagaaccagcaagtgccatacagaacgacgcgcagagccgggcctccaggctcgcctcccctcccagatgtacacccccctccaccgcaccgagcgtgtcggttcgtggctggccagcgcgctgacgaagttcagcttgtagaactctggctgggtgcacccgtactccgccagcaggtcactttccagctgcctccctggggcgcgggggagggagaattcgggtgaagcacagaggcgggaagggtttggaagggtcaggcagcatgcggcggcttcgagcccagggctctgccgggccagggcagtgactcatgaagcatgcctcgaggcgctccagccacccagcgccccccgcggagcgcccaggtgcccccagcgcccaggtacccctcacccgcggggtgcnnnnnnnnnngctcgtgaagcatgcctcgatgcgctccagccaccccccgcccccagcggagcgcccaggtgcccccggcgcccaggtacccctcacccgcggggtgctgcgccacgacgagggcggcgtgcgcagagagccaggcagaggcgccatgagagcaggcctgcagggccgcctgcgcatccagccccgcgcaggccgtcaggagggccagcacgcgggccgacagagcgg

SEQ ID NO: 34613 - DNA, 160 bp, Chlorella protothecoides
cttgctcctgacacggtcaagggggcagtgcctttgttagaaccaggcgtgtttttccttacagtatgacttcgcgatacgctctcgaaggacatagaggaatggtgcatcccgggttctgggttctatgttgcctcgagcccacaatcgaccgcatttt

SEQ ID NO: 34614 - DNA, 80 bp, Chlorella protothecoides
gcacctagcttgcatcctggcagtaccctcccaacctgccactgatgccctaggtagtggaacctcatgtcaagaccttc

SEQ ID NO: 34615 - DNA, 64 bp, Chlorella protothecoides
tttgctcccgcaggactggcaatggcagggtcgcccaccacacatgccgcccacgcaccctgca

SEQ ID NO: 34616 - DNA, 68 bp, Chlorella protothecoides
gtgcgaacgcgccgcgcgatgcagattgttgtgttgaattgtcagtgcactggtagattatcgagtac

SEQ ID NO: 34617 - DNA, 100 bp, Chlorella protothecoides
tcacacatgcatcatgtagataacagtgacattgcaatgcacttccatgtcattaaatcgtatttccttgggcctcagtgtgtaagcacaacggctaccg

SEQ ID NO: 34618 - DNA, 63 bp, Chlorella protothecoides
ctcccttgccacgctgagcgcacctcccctctgcccttgtcacccgacgccgcccgcctgccc

SEQ ID NO: 34619 - DNA, 77 bp, Chlorella protothecoides
ggccctttccccactttccatctgttcccgttccgcaccgagtccatgcctctctgcgacgcctatgaaacccgacc

SEQ ID NO: 34620 - DNA, 61 bp, Chlorella protothecoides
ccggcgacctcaggatcaagcagtggatggtggaggtgagggagtgatcgtggtgagggaa

SEQ ID NO: 34621 - DNA, 129 bp, Chlorella protothecoides
gctagcgccaggtcgcaccctgccccgacacttctctgggccggtcaccctgtgagtagagtcagtgccccattgcctacaagcccacaacaacacgccaccccccttctcactcaccacgcacaggtg

SEQ ID NO: 34622 - DNA, 66 bp, Chlorella protothecoides
gccaggctgcccagggcaccccggcagggtctttgccctgcacaaaggccgctgcagcgctgccca

SEQ ID NO: 34623 - DNA, 69 bp, Chlorella protothecoides
tgattggggtttggggctgagggcgtccagcggggtgagtggtctactcaagatattgtggcacgcatc

SEQ ID NO: 34624 - DNA, 103 bp, Chlorella protothecoides
cgacggtgcccgcgtgtccatggtctgcatctccgacggactgcgtcgcgacgaggcgtcaacagacgacgaagcggcggccggcggcgacccactgggtccc

SEQ ID NO: 34625 - DNA, 61 bp, Chlorella protothecoides
ttgcatggcattccactcaccgcttaccatcccgcagattgaggacacccggaggtcgatg

SEQ ID NO: 34626 - DNA, 61 bp, Chlorella protothecoides
gcggctggtcctcggatagccttccacacatcctcccccgccgcactctctgctccccacg

SEQ ID NO: 34627 - DNA, 87 bp, Chlorella protothecoides
tcggggaagggaccacaattggcgcaacatggtgctaggaatttcacgatttcattttacagtatcatgtttacattgcatcggaac

SEQ ID NO: 34628 - DNA, 61 bp, Chlorella protothecoides
gacgaccccctggtccttggcaagctcctgtaaagtatggggaattccatgggggttggta

SEQ ID NO: 34629 - DNA, 76 bp, Chlorella protothecoides
ttctgacagactgttggatgtggttggaagcttgctcgaaatttcgaccacctccgcgtcagaccgatgggattcg

SEQ ID NO: 34630 - DNA, 106 bp, Chlorella protothecoides
gtttggagagagatgttgctgctcggaatcatgctgggatattctggccccccaagcaggcaggatgtggggctgttctgcgcgattgcacccccgacaatggccc

SEQ ID NO: 34631 - DNA, 84 bp, Chlorella protothecoides
cttccgcaccaggataccctgcccaagcaaaccttttcccccccacccccccaccccaggccctgggttcggctcaggacatcg

SEQ ID NO: 34632 - DNA, 71 bp, Chlorella protothecoides
tgcgggtgaggtgctgtgctcaaacccagagttgtcaagtgctaccctccgacttggtgctgctgctttcc

SEQ ID NO: 34633 - DNA, 73 bp, Chlorella protothecoides
agaacgcatcacccaggaaggtccccttccccccacaactactcacccctgcgccgccgctccagcgacttct

SEQ ID NO: 34634 - DNA, 73 bp, Chlorella protothecoides
ccctcccttattcccttctcaccaccatcctttccattacacctcttcaggaaagtggaggagcgtctgggct

SEQ ID NO: 34635 - DNA, 65 bp, Chlorella protothecoides
ccccacgcgcctgacactgcaccctcccaccactcagtctggggagctgtgtgctgcggctgtca

SEQ ID NO: 34636 - DNA, 11361 bp, Chlorella protothecoides
  modified_base (406)..(433): a, c, t, g, unknown or other
ccccccaacaccggaccccacctccgcccccccccctccttctccttccacatgcagccgaccacagcgtcaaggtgtgggacgtggcggccgcctcctgcacccacaccctggcccaccacagcagcaaggcgcaggcggtggtgtggaaccctgccgaggcccccatcctgctctccggcggcttcgaccgccgggcggccctggtggacctgcgggtcgccgacgccgcgcccgccagctgggcggtccccgccgacgtcgaggcgctggcctgggatccgcacagtcccaccgccttcgtggtggccgccgaggatggcagcgtcagctgcttcgacgcgcgcaaggttggattgagggaggggggagggggggggggggccggggcaccggggacaggggnnnnnnnnnnnnnnnnnnnnnnnnnnnnagcaccggtgacagaggggaaggcccagacgcagcgggggtcgggggcacaccggcgcgctggcctgcgcagatcaacgccctcaccatcgcctccgcgccccgacgcgccgcaggggcccggctccgaggcgatgtactacctggccgcgcacaagaaggcgacgtgtgcgctttccttctgcccggccgtcgccggcctcttcctcacggccagcacagacaagaaggtgggctcgctggctcttttatgggttccagaaataccgtgcacggggcccgggtggcagtgagtgcctgggaggaagccagcgggcctgtggccctgctcccgaggattcgcaatcgcatcgccagggtcatcgcccccaatcacaaaacctgcaccaggtcaagctgtgggacacccggggcggcggcgagccggccctgctggccacccaggacctcaaggtcggggccgtgttctccgccggcttctgcgccgacgcgccgatgctggtggccgcgggcggggcggcggggacggtggcggtgtgggacaccatgacttgcgaggctgtggcggcctttgcgggcgtggagagtgcgtgactgcatatgcgggggcctggaggaagcacctcctggattgggcggagccctctctggtgcatgcacaccagaccatggcatgctctgctccatcaaatgcaagggcaacatggagcggactctttggtacagagaggggtcaggaacagcaagagcagcgaagagcgcccgaggtggtcgttctgagcagccgagccacccagcgtgctctggcctgtgcctgacgactatgtacgaaagttgcagagggtcacgcagcgtgcagggccactggccaggcatgggagccagcatggcacgcacactcgtggcagcaagggtcccccatcgcagggccgcaagccgctcgactccagccaggcccctgctccatgacgtgaagcccgtcctcagtgcctgcgctcccctgagccgacaaaggtctgccactgctgcttcgcataggtcaccatatagtcagcgttcttgcccatgcgcgtgagcagctttctgacttgctcgtcatacctggcgagaggtaggtgagcaatggaatgagtcttcaagggtgtaaaggcgacgagacatggtggtcccagaaaccaagactcaagcacacccagcccttaaaggaaaaattcccccagagatctaatgtgcctccaacccacctcttggcaaactgggcatagtcgaagccatcttgggacggtactcctggaactgggaaggataggggtgatatacaggttggaagggtaattggagctcttagatgtcagagcagggggctaccacttaagattcgttgggacttgctggaagcagtagctgaccttgtaagttccatgtttccaccccagccacaatctcaacccaccacccggagtctcctcctcaccataacttattccaggtcgcggcttggcaggccgaccctccgcttctcgggtggctgccaggggaggcaggtctgcctgtggaccctccggcatgagtctagggttgtgctgcccatgtgcggcagctactacctgtcaggcagagaggccagattctgtgaggagcaggcctgagatgtccccaggttatcagagcgatgagaaaaggcacccagaatggattcccaattatggaaatttgcaacagaatcgacatcgaatgattcaagggactgtcattaacagccacacctcgattccctcgcaggctggcatggtgatgggctccccaggtttactatttcggcccgcgtccctgagagctgcctcgtcgtatgcactgtaccctacacacatgaacctgtatttttaaggacgacatgtaatcagcatgctgtaaatggatgtcttctcaagcatcccagatgcctcatggttgcgcaaagcgacagattgccttgatgttttggggtccctcataacccagactcacttgaagtcgccactcgggagggcatctggcgacccatttagaacagcgcctgcttcctttcggcgtttaatgccagcacatgcctggaagatgcgcagggaaagcactctccctttacttgtgtggtgtcgaggtaggacataggaagtctctgcacctgtccccattagatcgagccatctccgcagctggccacatgatccttaccggtggtctcccgaggtcatgacgtagctggttgtagaagagtacgcccaagcatgaacgtggctcgggtttggcagaattcacccccgggcgaggtggtgctgtcgccataccccccaggaaatgcacacagcaagaaatgcaatatgagagtcgggatgtggaggatatttaatgaaacattacgcacaaggtagaggcctaccgcgagaggcgcgatgggtgacctggggcgacgagatccacgtggtgctccgatggtgcacagactggcaggtaggttttgaatgccgtggtcactgcacttcatgggagcgataacatttatgccaacctcagtactggccaagctctcaactgtctgatcaaggtctgagagctgcagaaatcctcatgcaggggacggtgcatggcgaggggctgccggagcacatgatgattgtgctggggaccaaacatcatcattccagactgcagacgtcaattttgcaaccagacgtatgagctcagggcggaggagtgataggagagcacacgtgtcctctccaggccatactgagcattgcatgggcaatggttgtgcaagtggctacaatcctggataaaggtagtctccatacctggatgcagtttgcgctaccgattggaccacccacccactgtcaaggtccttgctgcgttccctcgagacccttggatcaggaaacggtctcaattcatgaccttgacttaattcacaatatttcactcaaatagcagtttcggaccagacccgggttcgattcccggattgcgcagtcaatcccatgactaccctcccaaccagcgcagttggtttagtggtagaataggtccctgccataaatttttgggcaggctggtatgtgcatggattccgtccagccgcccaacccatttttgcccccgcccacatggcacagcccgaagatctccctgattctcctcgcgctccccgaccgatcctagggcctaggccacgcccacctctgcaccctccctggggtattcttccctgatattatttgggcactcgacggttccaccgccatgcccatgatgatcgggtcagccaccatcccttgcaccggatcatgggaagcccgcactggcatatcatggcatcccaggaggcgacagagggaccgtctgggagtttctcgccctctatgtcgactgcagcgccgcgaacaggtagcgcttgggctcggcatggctgggcatggggcgccgaagtcttggatcatttgagctctcatgcgcggagcacgccatgcccccactccccccccgcccgttttcattacacctccaggtgtcggtcggcatccccgcagccacgacccttcctgggcattcgactgcaccggccttccggctggtcccctcctgggcactgggatccggggtggtgttgctggtgctggcctttgaccagctgcggcggcagtggtggaggctggcgcagccccaagggggggtggcggtctcagcacaggctccgcctgctcaagaggtgccgatctccatcgctcaggggccgccgctggcgactgttcaggacgcgccggcttttgccgctcaggagtcgccgcaaaccattgctcgggaggcgctcctgcccgatgccctgggccaggccactgaccgggtgcagccagcccctcccacacccttctcccctgtcgagctggcagcgctccacgactcggcgcaggacagggcctgggcattggagtcggagctggggtccctctatgtcaggctgtgcaggggcctgccccggcacgctaccagcgaactcgaggcgctgggggcgcgaatctcccgcctggaggccgaagcagatcgcgacgtgaggcggcctgggtgtgctgtgttggagtcctggacacgtttgatttgcaatccatgccacctgcatgtcgcacgccatcggcaggcgtgcatcgtgtcatcccaacacctctctcatgtccaccaatcacaacagggcgaggcgcccgaccatctgcaacgctgcgcccagctgtccagggcacagctggatgtcctagaggcggcaggcgcggatgtctccgcgtatgcccccctcctggcctcctactttgatcagcgggccctcgtgagcaaggtggagggcatggtgcgctccctggcagggccacgcgcggctggccaggccggcacggcgaggacacccgaggtagatggcacgtccacatttgagacccaggaaagtgactttcagagcgggagttccctgggtggggctgtccaggaaccccgacaggcagaggaagacgacggcgcgacagtccagccctcccgaggagatgcccagctcgtgggcggcaacgtgcgggagggaatccttgctcctgggatcacaggaccagctcctcttgggccgcaacctgaggcggtcctggttgacgtggcagagaatggaggaacggagggcccaggtcggtctggcgtgcaagggagcgagcaacagcccgccaccagccagtcggcaccgcctgcggtgattccagagccggcgccctggccacaatccgcggtacccgaaggcgcgccggcatcggtccgtgatccacccgaagctggtccgtctgccggacccgaccctgccgggccggccgcccctcccgctccctcagcaccccggcttacggtggtcgggggagctgccatgtttccccaccccgccaagcagaagatgggcggcgaggacgctttcttcctgggcagaagcgcctttggcgtggccgacggggtgagcggctgggccgactacggcatcgacccctccctctacccccgggccctcatggcctcctgcgcccagctggcggacagcggcgacggcgccccgctctccacggcggcgctgctggagagcgggcacgaggccgcgcaggagcccggcagcgccaccgtggtgctcgcgcagctcgaccccgcccgatccacgctggacatggtctgcctgggcgactgcagggcctgggtggtgagggacgggcaggtggtgctcgagacggaggtgagcggggacgaccctgagggcacgggagttgacgacagggtgggggcctgttcaaggcacctgcaagggaggatgtaagaggtgccgtgagcgtccgacccgcatcatttcgcctgcaccctgcacgaagcaagtgcggcgtcgctgtcccatcacgcacctgcgcagatccaggagcacgagttcaaccagcccttccaactgggccatggggagtatgggggcaactggccgcaggatgccacccagtatagcgccgacctcctgccgggggacctcctggtcctgggctccgatggtctctttgacaacctgtggcaagaggacatcctggaggtcatccgcacatgcatggaggaaggcgccggcctgctgtcgcagggggaagacggggtgagtggctgattgggtggagcgactcagcgcgtggatggttgggtggagcgactcggcgcgtggatgattgggtggagcgactcggcgagtggctggttttgatggtaggtcttgaagctcccgcgtgccatgccatggcgcgggagcaggggccatagatgcctttctcagatcagatggtgaaaaaccaaacctcctgctgctatcaagccgcatcgcgccggctcccattcatgagccccccctttctgcaccctgaatcaaattacagcggcggcaggtggtccaggccattgccgaccggctcacgagcctggcagcacgacgctccaccaaccctagggcctcaaccccttgggccattgagaggcaccagaggacggggaatcccctgaccaagctctggtccaaacccctgggcgggaagaccgacgacatcaccaccgtcgtcgtcggcgtgtcctgatggctggctggttcccctgttcccagcttggatgctctccttgtcgtgaggtttcgaagagcagcgcaacacatctgcctgtgccttgggtgtgattttcggggtcgaggtgcggaggggccctgaccctctatccctgcagctcaggagcaccgtttcacaggggtttgccacgtgtgcacgagacagtgcgctgcagggggatcacatcatgagcagggctgcgggcgaccagggattctgctgccccgacttctcctgggtggggttgcggggcggagggcgaggtgtggcacccaccccttcctctgccacctgcagcggcggcatgtggagcgagcgattgagaatcaacgtcacagcctccacattcagagtcatgcgacggagcacaccctgcttatggtccgggatcaaggcctcaatatgcaagcacgggccgcacacctcccagaaaccctggcatcaaccctctgccagccacgacgccccacagagcgtggcagtgcctgcccgggggccctagcgccactcaatttcaacacccccccctgccacacagacacgcacacctgctcctgggccagcgactcaggcgtttgttgccactgggggaggcgcaggtcccacctccccatctgcgatgggagggagcttcatgcatgggcaacagccagagaaagcacctcctcctccgaggttctcagggaggcacccctgccagtccagcaaccgtggccactccagcatgctcgcacaccgccccagtgcccacctgcggcccggcatctggagcgctgaggaggggcgggggcagcgggtgtgttccccccagcggcagactctgcctccgcgctggtccaagcggcggcagctcggcctgcgggccctccctccccgccgccaacgcatccagccccgggtcggagtcgtccacccgcagccgctggggctcggagactgcgcggggtgtttcgtggattgtgacgtgtcgggaggggtgctacagaccctcgactggacggcccccttttagttccccccagcgatgccatacaaccccacgggcacccaccccgccgccgcggactggtgcgcttgcgtcggacgacgttggacatccccggctgctcgtcctccgctgcatccccgcgctgcgccgcgccgcgctgcgcctggcccagctccaccagggcctcgatggccagcccgctgccccccggcagccccaggtccatgtccaggctgcgggcagccgatgccagcccgggtccgcacccgggtcgtgggggggggaggctcgcgggggcggccaggggctgcagcttgcccagcatgccatccctcgctgggcctcccaccatcttagggggggaggtggggattctcaagcggtgagtgaggagcaggcgagagaaggttgcggggagcgacacatgcggcaccgaggtcttgaacctgcacaggcctgggcacacagcttggcggccgcagcggccactctgacacgtggcttccccaccgactggcctgccgtgatgcactgcgcccatcaccacgccctcctcccgccccacacctggtgaaggagggcagtgagggaggcggcggtctgggaggccccgttctggtgcacggccgcctccagaatgtcgtgcagctgccgctccgtctgccggggccggtccggtgttgtgcccagcgaggcagggctggcggccagccgcgcagactcctgcacattgggggggctcggggcatacgcgactcggcaggcgcggcggggaggcggcgactcggagacgggcagggcagacggctggaccacgctccgcctgcagtgcattgtcctgcaatggcgcggtctggtgtcgatctcacccccagacacacctctcgcagcggggagaagaaggaggcgagcatcgcctcccgcgacgcatacctcgcgccaagcgggtcaaagttgtcgggcgggcttgggacgagtcccgggaggccgtcggccgacctctcttcacctgcgcggcagcagtgtggcaggttggagggggcaggcgcaatctcaagagacttcttcgctttcgccaatggattgctccgccggcacacgtcggccgtgccggtcaggcaggccccacccgatccggccccctccactccaccccgcgtaccgacgcccgggatggcttgaccaaagggcgtgctcagctccaggggcagggccgcgcgccgcgcgatcggcgtggcgactttggtgcgtggcgccgagccgccggcggcctccgccttgacctctccctggccgcttccatgtgcaggcggggcgtggctgccagaggctgtgcgaggggggacgcggtgtgggtgctggggcggggtcatgaagtcagggtctgcgagcgacggctcgtccaggggaatgccctgcatgggggaggacggggagcgggacgtttgaagtagtgctgggctcgcacgggaggcgaggaacttgcacctgtgcccaagcacagggacatatgcatggcttcatggatggtgtcgatctctggtcatgctggagacctgcccaccacccgctgctcacacgggacgagagcttggccttcaggcaggcgttctcctgctctagggcacgaatgcggtcctccagcagcaactcccgctcctgcctcctcgccctgtcgcggaggactgacgcagtggtcgccaagcctggagcgagatcagcatctccaaccaaaattcaggccaattccgccgggcgacttgccgggaaccctgcccagtgcatgcaacccccgcgcaccccgactcctcggcagtacgatgcggggttgcccaacagcttgaattcccagcccaggcaggacccagtagtgcacgcatatactcattacctggaggctgcagccgtctcgcggttcttcatgagacggcgttgccgcttccgctcctccggatcctcaacacgagccaggtcgacggggggtaccttcttcctgcccttgcggcgtgcatggggaccctgcatggcatctgacccaatttgtgatgtatcgccgaccacttcccgctccgtactgtagggcggacctgacggccagcaggtctccgcccccttctcgtcgggagtgcgcatgtcctcgacccccgccgaagaagccatgcagaggacgctgcaccgccctatattcctgtaatgggatgtgcagcagatttgcggttggacctgggaaccagcatgcgcgcaggtacggttttgggcatgcgaggacacctatgttttctggtgggggggtgcgggcgcatggcgggaaaaaacttacaacctcttgaccatcgagggtaaattgctggcttggctagacccagcattccggaagccctgacgtatttcatctcatccctgcctcttggaatttgaacagggatggggagcgtgctatgccatgtgggcacggagtggcgggcgcaaacaatgtaaagacagtttgtgcgagagcttgaaatgtgtgacgggagtgagcatcgaggtagcccactcgcgctctggacgctgcccgtcctcgcccctggtcccatggcctcacatgccggccgcagccacacgggtccgcttctgggcacccttcctcctttgtggagaagggtttggggatttaagtttccccattgcagactccatccagcctaccgtatgccggccggcgagctcggcccccggcaacagacacaaggccctccctgccccggaacggcacgcaccgggaaagcgcggcgccagaggcttcgagcgctctgctgggcccagggcgattgtgacagggtgtgtccacatggccctgccaacagtgaaggagccaagttgagggaggtcttggcaccggcccgcacatgtttgctggggagcagcaggtttacaggccgacggcctgcagacccttgcacaccaagaattcaagacgcagcgccaccagcccaggccgcccacgcacctggggaggtggattgagacgaggcaggctgccgcggctacatgacggagtacctccccgccgccggggcctcgcgccgcatcgcccgctccgtctcctcctcgatgatgcgcttgatctcgcccttggcgcgccgcacgatctgctccgtcggtcctgcacagccgacgtgaagggggggggtggagacctggggtgaagagctgtgggaggccagggaatggcctttgctccggtcagcggcagggtgggcttggatgaagctggacgagtagccccgtgctggcggcccctggcgaagcgccccctcttcccctcccttcccccaagaaaggggagactctggcccacccaccctcgatgtggaggtagatcttgcggtcgccctcggccaccttggcgccgggcgggtagaaggtgcccttgatgaccaccgccgcgcccagctcccccatgtcgttgatggtgtcgcggtgcgtgacctgtgtgtgtgggtgaaatggtgtgtgggtgagattggggcttgcaccatgcaatggaattgcccgcgtcaacgctcaagaccccgcacacacaaacctgcgcacagcacctcacaaacacagcatgccacccccatcctgacccaccccccctcctacgaaaggccacccgcccctccagtcagtccccaccttccaccgcgcgcgctgggggaagtcgttgatctccagctccgtctcgaagtggcgcgtgggtcccgccggcctgcccgccgcggcggccgcgacggccggcgg

SEQ ID NO: 34637 - DNA, 61 bp, Chlorella protothecoides
gctggagcttgcgaggatgtgtgcatgtgcatgataacctccaacgcccctgccatgaagg

SEQ ID NO: 34638 - DNA, 538 bp, Chlorella protothecoides
  modified_base (277)..(371): a, c, t, g, unknown or other
atggtgttcaccggcctcccttgtctgggccagaggagggaaggtcgcctggggtttagggagtgcagcgtggcagcgctgcagattcagctgtcttcatccctgagcgcggcctgaggcgtgtcggaagctgggggtcaggccttcatgcatcatgcttggcagatcctgcagccgtgtgctcgacaagacgctcatacgccaatgtccctctccctccatcctgtgccagtcgtgtcggatggggaggagagggaggaggaacgcgtcagccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacggtcaggctgcctgctggggtatgggcctgtcttgtgtgtcgatgtgtggaggaggagatccacaggtgctccctgtcgtggatcgcgcgagtggaatttccagggtcatcgggatgggaagtaggacctcccacgccgcagtggggcagaggaccctggcgca

SEQ ID NO: 34639 - DNA, 388 bp, Chlorella protothecoides
  modified_base (145)..(311): a, c, t, g, unknown or other
ccggagccactccctgtcgaggatggtggagaggggaattaagagtgggtgtgtgccttgggggtccactgtatttggcatgcctggagcccgaaattagggtctgcccacaatcccccttgcctgacgagcttgaaagagtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctccggctccagcacgggggtgggcagcggcgcgccctcccccctcgcacacctggtggttttgggaacggcgg

SEQ ID NO: 34640 - DNA, 70 bp, Chlorella protothecoides
actcggtaaatgatctcacctcgggcgatgtacgggtgatgttcgacgtcacgccagactatcacccaca

SEQ ID NO: 34641 - DNA, 12605 bp, Chlorella protothecoides
  modified_base (877)..(886): a, c, t, g, unknown or other
  modified_base (3222)..(3231): a, c, t, g, unknown or other
  modified_base (4130)..(4285): a, c, t, g, unknown or other
  modified_base (4473)..(4482): a, c, t, g, unknown or other
  modified_base (5033)..(5042): a, c, t, g, unknown or other
  modified_base (5370)..(5379): a, c, t, g, unknown or other
  modified_base (5985)..(5994): a, c, t, g, unknown or other
  modified_base (6112)..(6145): a, c, t, g, unknown or other
  modified_base (6245)..(6333): a, c, t, g, unknown or other
  modified_base (6677)..(6686): a, c, t, g, unknown or other
  modified_base (6858)..(6867): a, c, t, g, unknown or other
  modified_base (7210)..(7355): a, c, t, g, unknown or other
  modified_base (7555)..(7564): a, c, t, g, unknown or other
  modified_base (8124)..(8133): a, c, t, g, unknown or other
  modified_base (8362)..(8371): a, c, t, g, unknown or other
  modified_base (9096)..(9105): a, c, t, g, unknown or other
  modified_base (11996)..(12005): a, c, t, g, unknown or other
acccccaacccccctccccagattcgtcggccagatcccgacggaccgccaggagccggacctgctccccgtcttcgccccctacggcgccatcgagaagctgactttggtgcgcgggcccgagggcaagtcgcgcggctgcgccatggtgcagtacaagcgctgggcggacgcggagcgcgccgcggcgggcgtcaacggcacgagcccgctggagggcgggcgcggccgcccgctggtcgtgcactttgccaacccacggcggctggtggggtcggcggccgcagagccggccatcacgccgcgcaagctcttcgtgggccagatccccaagaccgccagcgaggcggaggtggccgcagtgttcgcgccctacggcgaggtgcagggcgtcagcatcctcaagtccaagggcatccacgcggggtgcgccttcgtgcagctcaccacctgggctgcctgcgaggccgccatcgagggcctgcacgagcagcgcgtcatgcccggctgcgagcatgcgctggtggtcaagtttgccgacgccaagcgcctggacggcctggcgggcaaggcccgggcccagggcctgaacctgctgggcatgctgggccacccgggcatgctggccaaccactcatacatcaccggcgcggagctgggcatgggcccgcccctgccgccgcagctgggggggatgcagggtgagcccgggtgggggagggaggtgtgggccgatgggggactggggacaggcgactgcagcgtccctcctgtgggcctgtgggaggttgtgcgtcggggacgctgcggggccagggtgatcagccgcatgtggggcttcgagctcagtcaggaggaccggcctccgggtgccacnnnnnnnnnntggtgatcagccgcgtgtggggctgggagcccagtcaggaggaccggcctccgggtgccacccgacgcccaccccccgactcatgcacccccccccccaaggtttcccgggcctgggcggcatgccggggctcttccaggtgggcggtggcgtcaacctgggccacctgcacaccgcccccgggcccaagctcggcgccctggacggctcctcctccgagtcgctgctggaggcgggggactccgcgggcctacccccgcttgaccacggcgtggggcgcgggcacctgggcctgcacccgccgcacgccgcgcagcatcagcaggtgccccccgcccccggcagcatgcacagcatgcactcctccagctccctcatcagcctccaggccatgcagtcggggctcggcctgtcgggtgcgggcaacgtggggggcggaatcaggggatgaaggggggcaaccgagggggcatgcacctgtgttgggtggcctctgcctgtactacatgggggaacactctggcagacggccttggctcagtgtcctgccatgcctgctgccgcgagccctttcctgggccaggtctcccaggcgcccatgccctcgcaccgagccgcctcgccacctgggccccaaccccctgcaggcatgggcgtccttggcgggtacgaccacctggcactgcagcaattcagcggcatgatggtgggcggcccacccccgcagctgcgccccatcaagctgggccgcggcgtcgccgacccggcggcctatgcacacaagctgttcatcggccagatcccgtttgaggtggggcggggtgcatgcgcgctgcaagccggatcatgcgcatggggaagtttgtgcgggctgcggtacgctaccaggcacactcatcgtgacttagaggtcgtgcatgatgcccccaccctcgcgtagcgtttgtaccggcctgtggcatggatgtgcagtgatactgcatagcccctcgatgcattgcctggacactgctcctccctcagccctcaggaccatgcatggctgtcatgtgactcccctgttctcatgtacccctccctttcaccaaccatgcccaggccacggagcaggacctatgggccatcttctcacccgtgggcgacatcctggagctggccattctgcgctcccagggccgatccaagggctgcgccttcctgacctacgcctcccaggctcaggccgccaccgccgtgtcggccttcaacggccggccggtgggcgccaacaagaagctcgtcgtcaagtttgccgaccagaaggcctgatgccggccgctgcgctgggagccgcctccccccttcccgctcgctcgctgcccctccccctcacctcgctcacagcctcggtcccacgcggacccgatcgccccacgctaaacttgatgtactgacgccaaagtgtacttgagtccttttgcatccaccgcatcccccttccctggctcgatgccgccgcctggacgccgcttgcagcttgcagggtgtggacttgcgcgggagccgctcccagggaagtacagcctgggtggcgccacaccaccgcctagtattcgtttcagatgggtgtagatggggcccaagcgtgcgcctgctgctggtggaaagagcaggcggcgctcggcgatgggaccctcccccctccttggctcatcgacccttgtcgctttgccccaccgccgtcacaccgtctgccttgccatttgctttaggtcatattgtacggtgtagcagcattgaataccacacccttgcgtgtgagaggagaggttgggtttgtcagaggaggggcacagtgtgggcgacaagtgcacgagaggtaggcccagacaaggcagaggtgtcgtctggctctttaaaaagggcagtaggtttgttgaaggtggccctgcaagtcatagtcagtactcgttcacatgtccaatggtcacgaggacgcagctagccctccttggtcttagccgtgggtggactagcatcatccctggcttccagccacgacgccactgtctggagtgcccctgcatccaggtacggctccaggcccagaatggaggcctgggcgctcagggtggctgggtcgctctccaggctcaccgtcgcctggattcgcatctggggggcaattgggcgacgatgaaggtcatgtggggttgtgacaggaatggaaccagcagctttgttcttccaaaaggtgcagacaggaataacgttcagcagcaagagcctctgcgcagagacacaaatgaataccgggcagcctctcaccaccagctccgtctcccgactgcagcggnnnnnnnnnngttgggcgatgatgaaggtcatgtggggttgtggcaggaatagaaccagcagctttattcttccaaaggtgcagacaggaataacgttcagcagcaagaggctctgcgtagagacacaactgaataccgggcagcctcttaccaccagctccgtctcccgactgcagcggtccagcatctcggtcatgagcagggcgtcctgctgcaacagggctggcactgaactctccaggccgttgtcctcggacatgggttcagaaaccagcctgcgcatgacctcggcatcatcccaccaagcctgcagaaggagtggagagaaggaggcatgcagtttgctgtgtgcacagtgtcaatgccagtgtggggcatgaggcattgatgatcagggctacacccacacaggctgtttgacctggcattggccgtccagggctccgaaacgattggctatttgggattgcaaatcctcgaggacatgcagctcgtcctcgatcctgtcagccaggtgcggcaggggttgggggcctctcacttctttgccctggataaaggtctcgagctcgtgggagggcccctgccaaggatgggagggaggagtagcatgctcctggtgagggcttgatcttttcagaatcctgaattgtgcagggtcgtaccgtctcagcacgcgccttggccaggactcggtgcagggccttgctggaagtcctcttggcaggtgcagccggctcaatctgctgcagggaccgtgcgaggtcctccaggacttgcacatacgcccgatgcaactccaggtagtcctgtacgatgtgatggggttgagtgcatcaagttcattgaaggatgcagtgacagcaaggcgattggtgggccgacactgtgacccacctcgagacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgctgggctgagattattgtaatggcgaaagcatgcctacatgttcgacaagggccaccgtttccattcgaaatgaagttacgaaatccccgaagagatcctcacaacaactggcgacagcctctttgcatcaaactcttaccatttttcgctcgcggtcgatgccgaacgtgctcgagacaaccnnnnnnnnnnatcctgtacggtgtcatggggttgagtgcatcaagttcattcaaggatgcagtgacagcaaggcgattggcgggccgacactgtgacccacctcgagcccttccgcgaactgacgctgctgatctaaacttgacatcaggaactaggcatgatgagtacaggcaacgtcagtttttgcataggcggcacaggaaacttctgctaggcaaggtgctggggtgatattattgtaatggcgaaagcatgtctacatattcgacaagggccaccgtttccattcgaaatgaagttacgaaatccccgaagagatcctcacaacaaccggcgacagcctctttgcatcaaatttttaccatttttagctcacggtcgatgccgaacgtgctcgagacaaccggaccccacagggcgtgttcgcctctgccaagttggtggccgtggggggctccaaagcaggatacctaccatgcagccccaacacctccagtcgcattccccacggagcgcgtggaggacttcctgcgaggccaggggcgcagcttcaggacatnnnnnnnnnnacccctacagggcgtgttcgccactgtcaagttggtggccgtggggggctacaaagcaggatgcctaccatgcagccccaactcctcaagtcgcaatccccacggagtgcgtggagaacttcctgcgaggcgaggggcgcagattcaggacatcattcaaccacaccacccgtcctgtcaccaaggtccttacttgaaatgtcatccaacggatgcccattgtgagacctctccaagtcggctactcctcctcgcaatcactcgagctcgttgacacacacaggactgggtttccattaagaaatacacgtgcgcccgaggtccggannnnnnnnnnaagacacacaggactggatttccaataagaaatacacgtgcgcccgaggtccggagaaacctgagtgggtggagaaggacggcgccagccagcgcaaggggaagggcagctgaactcgccgcagctctcacaagaccagctgcgagcattacttcttcaagcagctgaagtgggagccagggaagtccctcatcttccaccacaccattccgtactccagccacgacaatgacaccctgcagtgtcctcatttgtcgtgctgggcgagtgctcttgtggagaggctgctggagaccaacgccgccttctccaacaccgacatttgtggagcagtccaaacggctgcgatgcgtcaagccgggatagactcggtgctgtacaccaccttgttggacgacaggaccttcctcaaggagttcccggatttctttcgggacttcatgatctccacgcaagacgtcgcgtacgttgctcattgcagttactcagggccaacaatctgcacttccacacttgcagatggtcccgtcctctgtgccgcctgttgcaggaacattcgccggcccaagaagtcgaacctgtggatgctgcaccaaaatgcagccnnnnnnnnnntcctgttgcaggaacattcgccgggccaagaggtcgaacctgtagatgctgcaccaaagtgcagccaggagcctgatgacaatggtccaggcttggccttcagactttcccatcttgnnnnnnnnnnnnnnnnnnnnnnnnnnnnnnnnnnaatgcgcatggccgccctgtttggatcgacagcaggcgtggctaccaatcccactggtttctcacgttcaggtcgttggtgccatgcgtgctgtcgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcttcgagctcgataagatcaatcagtccctcattgacattcccgacgacggcaaagtctgaacgccgagccaggaccgacttcatcaggcttgcggctgcgtctgggtccagcatccatggattggacttcttagaccggcgaatgttcctgcaatggagagcgcatacatgtgggactacagtggggcaccaaggtgcaggtgattggtaccaaggtgcaggtgattggcaccaaggtgcaggtgattggcaccgagcgaccctgccttgcagcccacgcaatctccttgttggtgatcgagtaatttctgtgaagatctgggtggttttgctggaagnnnnnnnnnnaagaacgctgacaagggggtgacacaactcgtcgagttcaacgataatcaccagcgtgtcctgcgcaacaatgcgcatggctgccctgtttggatcgacagcacgcggggctaccaatcccaccactttctctcgttgaggtcattggtgccatgcgtgctgccgatccacnnnnnnnnnntccctcattgacatgctcgacgacggcaaagtctgaatgccgagcctggaccgacttcatcaggcttgtggttgcgtctgggtccagcatccatggattggacttcttggaccggtgaatgtcctgcgatggagagcgcatacaaattgcatcactgtggttcatggaagtgcaggtgattggcatcgagtacccccgctctgcaacccacgcgatctccttgttggtgattgagtagtccctgtgaaaatccgggtggtgttgctggacggccaagtggttggccacactgatgtagacggccgaacttacccctgccttgcgcagcgcagcttctcgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataggaccacgggcgcacctgtagtactcgaccaacaaccagtcctgtgcgtgtgttgaagagctggtactgagtgcagcggaaggggatcggctgcatgctcatcacatgaggccacccgatggaggtgatttcggaagctggatagcagcgtgggctttccgatggaaggacgtcctgaaaatgcggccctcgccgnnnnnnnnnnagtcttctcagagtggcggcgcgtcaggctcgtccgcccctcgcgctggctggcgacgcccttctcgtcagccacttgggctttatgggaccacaggcgcacctgcagtactcgactgacaaccagtcctgtgcgtgtgttgaagagctggtactgagtgcagcggaaggggatcggctgcatgctcatcacatgaggccacccgatggaggggatttcggaagccggatagcggcgtgggctttcagatgaaaggacgtcctgaaaatgcggccctcgccgcgcagaaagtcatccacgcgctccgtgggaatggttgcctgcgtcacgggccttttatagagggtacttatgactgtggccttggcagccactatgtcggccatggtgtaggcgccgtcagggtgttcgaacagcgggggtacaccacgcattgtttgcaactgctttgagatttttagatgtgaatcaacagtctggggggtttcggcgatttgtcgtgggggatttactgctttgaatcccgcacgactcctggagcgaaaaatcggggtgtcaannnnnnnnnnactttagatgtggataaaaagtctgggggttttcggcgatctgtcgtgggggatttactactttgaatcccgcgcgatctgggactcctggagcgaaaaatcggggtgtcaagcccacgtggtgtcttgcaagaaacgtgaaggtcgtagttcccccaccccatctctggaccccaacgccccccttttcacacactttgttcggacattaatatggtagccatgcgannnnnnnnnnggtcttgcaagaaacgtgaaggtcgtcgttcccccaccccatctctagaccccaacacctcccttttcacacactctgttcggacattaatatggtagccatgcgaggcgcaggcgtgggagcccgcacggcgcccttccggtgcccggctgccacctcccgggcggtatctcgcacgcctcggggccccctgcgccctcgggccattgccgccccctcggcggtaccctttctgcccagtgcggaccacctccaggaatggggacctcagagctggaagcagcgcgaggcgctgcaacagccgaactaccccaaccaggtgcgacgactcccgggcaatgccagggcgctcgaccatgcgcaaatccggtccatcatgctgcgtcgggatttatgtgaggcgcacagatcgtcgtcgcacctgcgcccctgtttgggcctccccacagctcgtcatgtctatccccagcatggctcttttcgcccccagtgcatctcaccccatgatggggcacgagtaagcgcttccagcatgccaatccattgcggcatgcatctttccggcgcggcatgtcccgtgtctgtgcagattggtcgatcctgcatgccaccccccaaaaccccccaaagcccctggaggcctctggctagggcactccctcctttcagttcgtgcctccccccctcactcttcacacctcgcaccctctcttcttcttgccccnnnnnnnnnnacccctggaggcctctggctcgggcactccctcctttcagttcatgcctcccccctcactctttacacctcgcaccctctcttcttcttgccccaggctgagctggacgaggctgtggcccagatcgcggccttccctcccctggtcttcgccggcgagtgccgcacgctgcagtcgcgcgtggccgcggcggcggcgggcgaggccttcctggtgcagggcggggactgcgcggaggccttctcccagttcaacgccaaccgcatccgcgacctgttccgcctcctgctccagatgtcggtggtgctcatgtacggcggcggcgtgcccgtggtcaagatcgggcggctggcggggcagtttgccaagccccgctccgccgacctggagacggtggacgggcagtcgctgcccagctaccgcggcgacatcatcaacgggcccgagttcacccccgaggcgcgcgttcccgacccggcccgcctcgtgcgcgggtacaaccagtcggcggcgacgctgaacctgctgcgcggctttgccacgggcggctacgcggcgctggaccgcgtgatgcagtggaatctggacttcacgcgcgggagcgaggaggggcgcgcctaccgcgacctggcgtcgcgcatcgaggagtccatcaccttcatgcgcgcctgcggcctggacatgcactccgccatcatgcgcgagaccgacttctacgtctcgcacgaggcgctgctgctggactacgaggccgcgctgacgcgcgaggactccaccacgggcctctggtacggctgctcaggacacttcctgtggtgcggcgagcgcacgcgccagctggacggcgcgcacgtggagtacctgcggggcgtgggcaacccgctgggcgtcaaggtgagtgacaaggccgaccccgcagacctcgtggccctcatcgccgcgctgaaccctgaaaacacgccggggcggctggcggtgattgtgcgcatgggcgcggctaagctgcgcgagcgcctgcccgcgctgctcgccgcggtgggtgccgcggggcaggtggtcacctggatctgcgaccccatgcacggcaacaccgaggcggtccaggggtacaagacgcggcgcttcgaaaatgtgcgcgcggagctggaggccttcttcgatgtgcacgaggccgcagggacggtgcccggcggcatgcacctggagatgacgggcgacgacgtcaccgagtgcatcggcggcggtgccgcggtgaccgagctggacctcagctcgcgctaccacacccactgcgacccacgtctgaacgcggagcaggcgctggagctggccttctacgttgccagcaggttgcggcggcggcgcgccgcgcgcgacgcagagcagcaacgcgccgacggcgcgccggccgcggccgcacgcaacggcctgctgtgagtgtttcgggcggacgaggaagtggtcgctcaccaccgcgctcggcgtgaagatcagcaaagtgccccccggaaccaccatatgtgtgatgtagaagccccgtggatggagctgtgccgtcgcacagcccaaaatcccttggtcgccatctgtttgccttggtgacctggccgctgcgcaatgccgctactggccaaacatgtctatcgcttctcctggcaaggaatgtgtgtgtacaggtgcaggaagtaggagcaggaaggcaagacacgatgggaaaagggatttacggaggtgtgattggcctggactggcaggtgcctgaacgctgcggtgcctggcgatgagtggtgcgaactcaggggctggcccagggatgggtggagggtgaccctggagtttcaggcgatagacaggatcgtcgaccaccgtcccgccctaccagaggctcttgacggggaccctgaactcgacgcccgcacccgggccccagtgcttgtaagaggcaatgagcttctgcagcgcgccctcgctgtgctgcatggggttcagcttcaggtccatcatcatggcgcgggtgtcgtcgccatgcgctgccaccagccgcgccacgatgtcgcgctggtgcttggtcaggcgcttgggcgcggccgggcccgtgctgcgaaccttgcccaacacagcccgcaggtctggaggttgagggcggcggggcgaggctaatgggtttgaggtcaaggtgaatcttggtgcgcgggggtatggagtgcccacactgcaatgcagcgagcgttggacaatgctattctacaatgcttccgtcccagggcaccagcagcaaggcctggagcaaatacatacccgatctcgaccgcacatctcaccgtcatcgtcgaccgcctcctcagcatcgctcccgggggcgtgggagctgggctcgggggcgcacaccggcacagcattcctgccaaatagccggttggggttgcccacgaagcccaggcgcccgtagttggccacgacggtggactcgtgcgcccaatcgggcctgcaaatggttgtggaggtgggttgagcgtcgggcatcccgagctcctagcctcagccccttcgcaacaggcctggcaccccgcccggcccactcactgggcacccagcttggcctccatgcccggccgcagcgccgtcagctcctcgggctccttgctcttggtgtccagcttcttgttcacgctcttcttcttcctcttgataattttgggccgggaggccttgtgtcgtcgcagcgagcgacccattgcggccggcgagtacttgggagaacagcagaggggagctggtgtcgatatgtgacagggcttcaaagcggtaggcgtggggtttggtcattctctgtcgtcctaggaggatgtttgcgagagccatacgccatggacccccccccccccctccannnnnnnnnnaggagaacagcagaggggagctggtgtcgatgtgtgacaggacgtcaaagcggtaggcgtgggtttgggtcattctctgtcgtcctaggaggatgcttgcgagagccacacgccatggaccccccccatgcagcgcgcgggaatacgcgctctcacgtcggacccttggtcccactggcagtatcccccgcctctggatccgctgtgtgccagtgacccagcttacatcacgggacgactcaccgcagcgcttcgacatgcactgctcgagatccacgccacgctggggccctcacggccgcacctccagcttgccgaagaagaagcacttgcccggggcgccggcgcgctcctcagtccgctccagccccacgaggaggcgggtgccggacagtgtgccccccggcggcccggtgaaggtgagactggcagcgggcggggccagggcctccgcagaccccggcgcgagctccagcgccaggctgagcacgcccgcctcgcccggggcgaggacgggcagcgccagcctcgcctcgccggcgtcggggcgcacgaggacgtggcgcgaggcgcgggccacgcgcgcgccgcgcggcagcg

SEQ ID NO: 34642 - DNA, 71 bp, Chlorella protothecoides
tgaacaggtgggtcaaagggggcgcttgagcgtgggaacgctgcgcagggagtgctccgtctcagtgggcg

SEQ ID NO: 34643 - DNA, 134 bp, Chlorella protothecoides
cctcgtcccaacacagcgttgaatcccgcccacgacgaccagcctagccaggagccccagcggtggctcccgacaaccccgtccccgaccatgcccagtgtcctgcgaccgcccaccccaccttggcgatggag

SEQ ID NO: 34644 - DNA, 5568 bp, Chlorella protothecoides
  modified_base (3432)..(3565): a, c, t, g, unknown or other
  modified_base (4835)..(5075): a, c, t, g, unknown or other
gggggggggaagtgagggaggcatgggaacttagcaggcaactgccgggcagcttcttgcaggcctcgctgggcattcagggcgggccctggggtctcagggctccccagcgttcaatagtatcaccatacaaggctcacccggatgcaaagtggagggccgccgggtcgttggggggcggggcacacccgccgcggtagaagagcagtgtgtcgcgggtggtggcgaggggatcaaacccctcctggtgggtgtctgcgggtggagcgggggcgtgtgtgtgtgtgtgtgtgccaacacgcacaagctactgggatggtgcggcaacaatgccagaaccaagaagcctgcaggccaggggaggctcgcatgcacatgtcgtcgcagagtgtggggtccctcatcacaaacacccaaggaccggagcctgctcgggaccaaacctgcgcacctgtcacgtatggcaggatcagtccctgtcgggcatgcgcatcgagcgactgctcgcagaacatggtgtgctcggaggtgatgatgaagggggaggcactgtgcgggatcaagagatggggacttggaaaatccaatgaggttggagggtacattgtgtgtatgatttctgcatcacagtgatgcgctggatagactcctgtgtgcaaagaaccatacgaaggcaagccaaggggggccatgggtagggtgggaggcggtgagcaaggcatgggaggcctgatcctgtgttcctcttgatcatgctccccctgaaccaagaactctcggtcccaacgtcagaccaggacgctcacgctgcccaaacagtctggcgcgcaggagatttccatgagaaagtgggttcgcccaatgggaccgaccgaaccccaggcacataagtgagcaagcccgtgcacctctcgcacctgcatggtctctgcgcatccagggtttcggtgggtatcgccgggaagtagggtgctatgacaaacctggagccattgctgtgcctccactgaggccaggacctgaggtggttcatcgtctgctgcatgtagagctccggatcggcaccgtccagaactttctccctgaagacctgccaccacttccccgccctccaggtctcgtagcaatgcatgttgacgtatatctggggacaagggggcggggcaaggggtgaaggtgcagggaggacctctcctcacgtccaggccctttgttccgaggaaacatgctcctgctggcaaggagacgaaagtgataccaacagcacacaacctattccgacatgccctgcatgcaccttggcaaccctctgcctgatcccagtccatcctcccctcccaccagatctgcactggccagcctgtccgcgcgtgccccgttgtcaacgatggcctgttccagccagaactggaccgcttgctggtactcccagtgttggaggggctcggtaccacccaggaggccagtcaccttgagggcgtggggccagacagcggggtccgcgtaattgcaggcgggcatccccagatcccgggcgggatccaggacgtagatggagcaggaagcctgctccaccgattgaacagggcctatgagcacggagccggaggtcagcttgaatagacgcttagaccagatcccttggcctgccaagccgacgagagagaagaacaggaaccctgcgcggtggagggggagggccggatcgagacaccgcaacgcgttagagcagaaactcggcccccgcttcgatacccatcaagagaattaacattttacctgttgtgagaggcaggatctggagaatgtgcggcatttgaccaccttccgtgtgaacttcactcgagcgggcgtgcggcccataggggaataacacagccagtcagcatcgagagttggcagggcttcgtctaacagatccaactcctgacaattttagacgctgcgagatcttccttgcctgggcatgctgccacatccttcattttgcgtgacggaaccgtccggggcgggaacgtcacgtgaactcttcccacccgaccttacccctgcagcagcaggcatagtaatgagccatgcggcttgtgtggcaccatctcatgctccgaaacgattactctccctctctgtgacacatggatcgagcacttagttgtacacagattgacctgagatgtaagtggacattagcttaagtcagctccccatggggccaatcatacagagccaggaaagctgatgggagagggaattgtcacatagagatggccgagtcgaagcgtgggaacaggtacctggaaaagcaatttctgctgcccggccctccatgtgcctcacagggcttcatgcagcagggaggggtgggcacctgtctggctccatgtcccctgtccatcgctggcattttatttgacctgcggagtcctcacccctctggcctgcccagagcagagtagatcctaggagattgcttgctgggattacccatgccctttggaggccgcgccattgacgcccagggtcaccatctcccaccgtccagccggtggcgcacggagtgtggggcggcatggcctgatgagcggcggcggtgtgcggctctccgcggcctcctgagtaccagccccggcgctgcagcactctccatgcggtgataatctgtaatgacccgcttgaacggatccttgtaccactacgacgacggagcctacacgagatgccattaagggaggtggagaaccttgtccgtggcgaggtggatagcattagggtcacagcggccttcacatgccggattctatgagagaccaccaggcacctatgtatcctcaggcgccggaccccataggcacaagaaccggctcgatccttttggaatgaaatatcagtacgacttcagtatatgagggtgtcatcaagcatcatggacccgcacaggcggaatgtttgtcagtaacctcgtcaagggcaagcacaagctgattaacccaggcaggggtcagtcggcgagcagggtcctcctccggtgcgggatggggtgcgggggaatgatgtcacggtccttgagcgtctgagcatggtcgcatagcctcttcaccacgatctctcccagctgcgacctggtctcccctgggggcggcagccagtactgccggtaggcctgccgcgccagcgcggcctgcttggcggccagcacctcgggcggcagcgcacgcagcgtgtcaaatatctggtccacggtgtccacgtacagcatgtctccgggcgccaggtcagcgtccaggtaccaggacttcagcacgttgggatggttctcgccgatgccctgcgaggcgttggcgaccacccaggtcacgtggcgcacggtgatgaagacgctggaggcggcgtggtcgatgtcttcggccagggccactgtgtgccagggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcgggtggggcagggccccggggcagatgtcgcagccacaccgcacgtccacatcggtggcgttggacgcctgggctgcgtccaccacggcgcggcgcagcagcttcctggcaggtggggtttatggtggtggggagggaggggattgaagggtgtgaatgagggcggatgatccatcaggcaatgcagcactgggccccacgggcatgcagacttcctttgcccctgggacaaagcacaagcagcctttcaggggcagtcttgcccggaccccggtggttgcgccggggctcaccctgatgcaaatcgccatgctttagggtcgggggggggcggcgcacacccaccccggtggaagagcagagtgtcgcgggtggcgacgagggggtcaaacccctgctggtgggtgtctgcgaggggcggcagggctggggctcacgctgatgggagagcaaggcacaccacacgggatccaggcacagcccatcccgaggcaagtgggcggctgcacgccccatgagtgtgcggcatctcctgagctcatgtcactggccgacccccaacccccggcccaggaccagccgaggatcaacctgcacacacctgtcacgtagggcaggatcaatccctgctgggcatgcgcctcgcgcttctgcgtgcacagcagcgtgtgctcagaggtgatgatgaagggggatgaactgtgtggggttcatgatggtggggagcggagggttggatgggcctcaagggatggtctgcaacacggaagctggaccacgggaatacaccgggcactctactgagtcaggtaactttgcgccagcaagccagggtagggtattcaggagggtgggaggcggtgggcgcggcaggcggagcccattcctgtctttccgttgacctttgacatcttggaccaggtaactgtgggccctacttcatgctgagacactctgcaccgcctggcccacaggttcgctgtgcgcatgggggacatcacccacacagacattgaagattcccaaacgtatgtcccaatgagcctctgcatctcacccacctgcatggcctctgcgccgccagggtactcatgggggttgccgggaagtagggcgccacgacgaatctggagccattgctctgcctccactggggccaggacctgaggtgatgcatcgtctgctgcatgtagagctctggattgacggcgtccaccacgccctccctgaaagtctgccaccacttccccgccctccaggtctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccccattgtcgatgatagcctgctccagccagaactggaccgcttgctggtactcccagtgttggaggggctcggtgcccccgagaattccggtcaccttgagggcatgcggccagatggcggggtccgcgtagttgcacgcgggcatccccaggtctcgagcagggtccaggacgtatatggagcaggatgcctgctccaccgattgaacagggcctatgatcatagatcccgaggagagcgcgacgaggcgcttcggccagatcctttgacctgccaagcctacgagggagaaaagcacgaaccctacgcggtggaggcgtggggccggggtgaggcgccacgggtcgtgagggcaggatctcggtaacttcgtcgatacccatgatatatgaacgaatattacctgccacaaccagcaggatctggagtatgtgaggcatctggcaccctcgcatgtttggtttgctcgggggggggggggggggggg

SEQ ID NO: 34645 - DNA, 114 bp, Chlorella protothecoides
tttgaggatccctgcaggaaactactccttacggtgttcaggtgcatgttcttgcatcgggatattcatcacttccccttgtggactcaccgtcgcagccgccgatgtgctggc

SEQ ID NO: 34646 - DNA, 61 bp, Chlorella protothecoides
gaatcgctgggactgcgcggtgcccatgctcgccgccgccgctgcaatgggacatgacgag

SEQ ID NO: 34647 - DNA, 149 bp, Chlorella protothecoides
aggtaggggtggagtgggcggcgtgggggagtgtggagtttgcgtgactgtcctaggtgcgcgcatgccagggcagggagcagggcctgtgtgtggttgtgagtatggcactctgcacattgccgtctggcagccctctgactagcctg

SEQ ID NO: 34648 - DNA, 107 bp, Chlorella protothecoides
ccccccccggccccacacctgggccacctccaggttactgatgtcccgcgtcgccaatccggcgtcgttcagccgccggacgacggccgtgcactccggggagtgcg

SEQ ID NO: 34649 - DNA, 74 bp, Chlorella protothecoides
ggtagctgagaaacatgggatccacaccagatgcaaggttaattttggccctcatttgcctgctgaagcagtct

SEQ ID NO: 34650 - DNA, 1212 bp, Chlorella protothecoides
  modified_base (777)..(786): a, c, t, g, unknown or other
gcgcgacgctcgcggcggggcgcagcctgccctcctcgctgctctgcgcgctgggcgccatccgcgagtccttcctgctcaccgacccacgcttgcctggcggccccatcgtgtacgccagccccggcttcctggcgctgacggggcacggcgcgggggacgtgctgggccggaacccgcgtctgctccagggacgggaggcctgcgccgaggcgcggcgcgtgctgcgcgaagcgctggcgcgcgaccccccgacggccgccacggtcacgctgctcaaccgccgcgcggacggcagccggtggtggaactgcctgcacatcgcgcccctgcgcgacgcgcaaggcgccgtgcgctacatcgtgggcgtccaggtggacgtcaccgcgcgggtgcgtggccaggagcaccgcgcgggggcttcaggagggggggctgaggtcggtgaggcagcgggtgtcacagatgtggacaaggcggcgggtgtcacagaggtggacaagacgaccggcgccgcctcgcccggcggctcgcctggcgcgggactcccagccaggaagacctgcgcggccgggggccactcctgccacttggtcagggggctggatccggccctgcccccgctggaccccgacgcctggcacgcgctgaaggctaggggcgtggcggggcaggttcggctggcggcacgagccctggggccctccggcctcgtgcgtgggcctgtcgggtagccggcttggtgcgtgtcgcaggagatcacggtcacgcgaatcnnnnnnnnnngctgtcgggtagccggcttggtgtgtgtcgcaggagatcacggtcacgcgaatcagcatcgccccattggctctaccagttcacccccctccccgtacctctgttgtgcaccaggtagcacccccattgctggcagttttccatgttttccctgcgagtccctttaccccagaccgcactttcatgacgagaagattttccaggacatctctcccccttggcaccgcacttcccctcctttttaacagtatggcaggcgacagatggagtgggggtgggcttggggacacgatcaaagcatgagcggggcggcgccgccaaaatccccagggtcgaccgggccgcgacggaaaaacccaatcgatctccgaaagaatgcgggtggtacaattgccattatgtaaagaatcaagtggtggtgggggg

SEQ ID NO: 34651 - DNA, 97 bp, Chlorella protothecoides
gactggtgcctggacatcccagcatgcgtccaactcaaagctccacgcatgtctgtgctcaggccgttcagcacaccgcaacccacccaggaccgct

SEQ ID NO: 34652 - DNA, 114 bp, Chlorella protothecoides
aggctgtatggctgatagaaagggcctgccgataggcgccgcatgatgcctgggtgtgactgtgcggacctcgtcccttcctcaaacccctgcatcaccacgaagtgcccttga

SEQ ID NO: 34653 - DNA, 112 bp, Chlorella protothecoides
ggccgccgcggcgcggctgatgcgctgcgcgccggcgctgcgcgccgcgctgcccgcgctgcgcctagtctccctggccctggacgacggctaccacgtctgggactcgggc

SEQ ID NO: 34654 - DNA, 61 bp, Chlorella protothecoides
gacctgacttcagtttcttgtttgtctcctccagcagggagatgtactccttgttgtcgtt

SEQ ID NO: 34655 - DNA, 98 bp, Chlorella protothecoides
gttggcggcgtccttgctgcgagtcatctcgttccactcatgcttgtatccattcgatcgtttgcctaacccaccccatcccccggcccttctccccc

SEQ ID NO: 34656 - DNA, 114 bp, Chlorella protothecoides
cggtgctctcaccatcgccgctggcaccagccgatgcctgcgccgggccaggaattgcatccgtggcagcgccagggccggcatccccgccgtcgcctgtgttcaccccagcac

SEQ ID NO: 34657 - DNA, 61 bp, Chlorella protothecoides
cgctcgcaccttgatgtcgccctccgtgacgtcgtagtggaggttagtaatgtacctgcaa

SEQ ID NO: 34658 - DNA, 123 bp, Chlorella protothecoides
tcgaccagcgagcgaccaacttcccctgccattgctgcaagcaaggcgccccaccaaccgcctgttgcacccacatccccacattgccacacacagtccatgggcccttactccatggatgca

SEQ ID NO: 34659 - DNA, 61 bp, Chlorella protothecoides
agttcatctcggtagcaccatgtacaccgcaccctgcccagccacatgcatcctcccagtc

SEQ ID NO: 34660 - DNA, 133 bp, Chlorella protothecoides
gcagtggggcaccacacccaccttttgccacgggcaaggagttggaagggggcggggctgccctgcagccctgacgggcatggccattccgcgagggtgccagctgcggcggcctgcccgctggctcgtgccc

SEQ ID NO: 34661 - DNA, 508 bp, Chlorella protothecoides
  modified_base (102)..(341): a, c, t, g, unknown or other
acgtgtcgtgctgggcgtgcggaactggtcgattggtggccctgttggcctgatgcccaggacctccccgaggggccttcacggccatggcaagtgatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaggggcatggatcgagggctgacccatcgcagatgcatcagggtcagacgcccgactggcacccccacgcctgcccccgccgaccaggcccactgccacaccctggacccagtgacccagcgccgccccgcgccacgcatctgcacctcacctcgtccgccgc

SEQ ID NO: 34662 - DNA, 64 bp, Chlorella protothecoides
tgccccaggacttggaaagtcttctgaagtcggggaacgagggccccaggtgatatggcttgcc

SEQ ID NO: 34663 - DNA, 106 bp, Chlorella protothecoides
cggctccgcatgggtcccgtgcatgccccctggtcaaggcgcgcgagaggctgcatgtctgacaggggcaaggggtggtgatgctctgtagtcgcagttacgctcc

SEQ ID NO: 34664 - DNA, 132 bp, Chlorella protothecoides
agacacagcggcagttttggctcgtcgagcacagccccggctcgccacgcaatcactatcacgccagcatgcaatgctccgggtggggcaaatccccccccgaaaggctcacccgcagcagcttgaccagct

SEQ ID NO: 34665 - DNA, 76 bp, Chlorella protothecoides
agtgattcaacgtcacactgatttgcattgggctggaaactagtgaccaactgattcgcatagggctggaatgcac

SEQ ID NO: 34666 - DNA, 61 bp, Chlorella protothecoides
tgccagggtctcgtcggtctgggcctctgccgccccctcatcgccatgccctcccgccgcg

SEQ ID NO: 34667 - DNA, 121 bp, Chlorella protothecoides
gctggatcctgcagcggttgggtttgaggaatggattgcaaatatcaagcccaacccttcttgaagatggtagcatggtctcgaccttcggcggggaacgaaagagctccacatgcgatgc

SEQ ID NO: 34668 - DNA, 61 bp, Chlorella protothecoides
tgctgttctccaaaagccatccgtgggagatcctgccatgtttgagatggaatctccaatg

SEQ ID NO: 34669 - DNA, 91 bp, Chlorella protothecoides
ctcatcatgttcagcctcaaatgtccgccgaagaaacctgtcatctattgcactgggaagcacccttggtaggggcacctgctgcgggcaa

SEQ ID NO: 34670 - DNA, 65 bp, Chlorella protothecoides
cctcctggctggctccggcgccaggtgggaggagcgagtatgtgcatggtgtgtgcaggggtggg

SEQ ID NO: 34671 - DNA, 70 bp, Chlorella protothecoides
gtgctgggcccgggtctggctcgtgtgggtaaaggtcgagcacggttgtgtggcgctgctctgcacatgg

SEQ ID NO: 34672 - DNA, 61 bp, Chlorella protothecoides
gctgggaagcccctccggcttcaatcccaccctcacccatgtgctcttggtgggtagagac

SEQ ID NO: 34673 - DNA, 91 bp, Chlorella protothecoides
cgcccgtcatgcacagcaccccttggtccacccgtccacgataggccatggtctgttccagagtccactccaaccctatgtcttgggtctc

SEQ ID NO: 34674 - DNA, 150 bp, Chlorella protothecoides
ggttgatgaggggagctgtgagagggtgggcgatgatgcgggaaccagggcgggggggttgcgagcgagaacaggggggagggaccagccaatcctacagcccctggcaccaccacaaccccccatccccatgctcctcaccagggagtg

SEQ ID NO: 34675 - DNA, 70 bp, Chlorella protothecoides
accacgaacccacgctcccactccttccttgatccctgccacagagcacggcagtcctgcgggtgctctc

SEQ ID NO: 34676 - DNA, 80 bp, Chlorella protothecoides
tgatttctgaccattcgtagattgttcacggcgcactatgcaaatgcccttttgctggtggtgtgcagtctgcggtggca

SEQ ID NO: 34677 - DNA, 66 bp, Chlorella protothecoides
tttgctggtggtgtgcagtctgcggtggcacgcctgcaacccagtgctcggcccgccatccctttt

SEQ ID NO: 34678 - DNA, 147 bp, Chlorella protothecoides
gtgccctgctggtcgggcccccaggtgtgttcatggtctggtgcttggggtgtcttgtgtgctgggattggtgccgtggtgttgccgacgccgtggcagtcgatgggcagacgtgtgtctgcctgccgatcgaattcctggtcccac

SEQ ID NO: 34679 - DNA, 110 bp, Chlorella protothecoides
catgtacagcaacatgcaggcaccacggagaagtccagaaggcaagtttccaatgtgattgtatcggttgcaacattttcccccggacaggatccaatcacactcgtgtc

SEQ ID NO: 34680 - DNA, 71 bp, Chlorella protothecoides
tcataatacttgggggagaaggttgtcgaacaggggtggacgagggcctcctactccaactgtgccagcgc

SEQ ID NO: 34681 - DNA, 425 bp, Chlorella protothecoides
  modified_base (144)..(321): a, c, t, g, unknown or other
gtcgggacatgcaggtcaccagtctggtacgcatcctgctggccttcagtacaagggacactggggcggtcagatgccagccatggccccttcgcatcccaagcctcctcgttcctcaccttgaaggcttgcctcctcgtgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtgtcaattttaggatttccacgcctggagagcatcttgcatcactgaccatccaagtcccatcatggactcgcatgccctgcgctcattcaggtcccacat

SEQ ID NO: 34682 - DNA, 61 bp, Chlorella protothecoides
tgtccgaccccctggcgctgtcggcgggggggccctacgaaggacgctacgagatccacaa

SEQ ID NO: 34683 - DNA, 63 bp, Chlorella protothecoides
ccccccaaaacacacacacacacacacacattcccctccccattcccccaccgcaccctgcag

SEQ ID NO: 34684 - DNA, 138 bp, Chlorella protothecoides
caccacctgagactgctcggccatgctgggtttttgtgggggcattcaggtctgtactatggaagcaactgcactcgactcatacggacagcggggttggtgggatggggggtggggaaggcacgggctggcaccccg

SEQ ID NO: 34685 - DNA, 70 bp, Chlorella protothecoides
aatcaaccctctgaatgctcgacagggctcgggtctggcggatatgccacagcatttaaccctcgtgcag

SEQ ID NO: 34686 - DNA, 61 bp, Chlorella protothecoides
ggttgtcccaggcacacactggctagagaggtttccgcagtcctgtgcccatgctggtgcc

SEQ ID NO: 34687 - DNA, 76 bp, Chlorella protothecoides
ccatttgttgatttattgcgctcttgcattggtttcttgctggaggtgtcgaggctccagatcatcgagatggaaa

SEQ ID NO: 34688 - DNA, 16840 bp, Chlorella protothecoides
  modified_base (1195)..(1315): a, c, t, g, unknown or other
  modified_base (1381)..(1390): a, c, t, g, unknown or other
  modified_base (2600)..(2609): a, c, t, g, unknown or other
  modified_base (3027)..(3036): a, c, t, g, unknown or other
  modified_base (3646)..(3655): a, c, t, g, unknown or other
  modified_base (5497)..(5506): a, c, t, g, unknown or other
  modified_base (5912)..(5921): a, c, t, g, unknown or other
  modified_base (6233)..(6242): a, c, t, g, unknown or other
  modified_base (6564)..(6573): a, c, t, g, unknown or other
  modified_base (7399)..(7408): a, c, t, g, unknown or other
  modified_base (7628)..(7637): a, c, t, g, unknown or other
  modified_base (7822)..(7831): a, c, t, g, unknown or other
  modified_base (8019)..(8028): a, c, t, g, unknown or other
  modified_base (8260)..(8269): a, c, t, g, unknown or other
  modified_base (8434)..(8443): a, c, t, g, unknown or other
  modified_base (8535)..(8544): a, c, t, g, unknown or other
  modified_base (8667)..(8676): a, c, t, g, unknown or other
  modified_base (9216)..(9225): a, c, t, g, unknown or other
  modified_base (10610)..(10619): a, c, t, g, unknown or other
  modified_base (11040)..(11049): a, c, t, g, unknown or other
  modified_base (11751)..(11760): a, c, t, g, unknown or other
  modified_base (13641)..(13650): a, c, t, g, unknown or other
  modified_base (14467)..(14476): a, c, t, g, unknown or other
  modified_base (14881)..(14890): a, c, t, g, unknown or other
  modified_base (15067)..(15076): a, c, t, g, unknown or other
  modified_base (16034)..(16043): a, c, t, g, unknown or other
cggggcggcagcagccgcggcggcggcagcagccgcggcggcgagcgaggcggcggcggctccaagccagccagccggggcagcggcaagtttggagaccggcgcccaggaggcgtgcgtggcggcggcgtcagcaagcccgccagcagccgtgcgaaggcctctggtcggggtgggtccagcagccgaggcgggtccagcagtcggggagggtccagcgctcgtggaggcggccggggcgggggccggggccggcgatgatgctctgcactctcgccgatgtgctgctgtcatgcaaatcacttggttgggcactgtcagcccctctatgtctcatcaatgtacatggtggttgcatgaaggtagtggcagtcagcgagacctcagggaaaagggcgggtccagggtggccttgcaactctctcggtatcagagtgcggtcgtcgtcagccaaccaagggcgggtgagcaatggacgccagtaggaatgttccctggcgcccagcacgaagtctactccgtccctccccgacgccttccggacccccttttctacttgcgccggcggttggtggccacgtgctttcgctcattggggttgtgcttccagcccgccagcagcgcggccgcgcccttgtccgccatggcccccagacccgcagcctggtgccaggtgtcggtggtgtactcggccgcaaagggatccacctcgccctccgccttgcgcgccgcgcggcgccgcgccttccccgtgcgctgcatcagcacgtcctcggccaggatcacgtccttggcccgcccgccacgcggcttgggcagcgcgaagcgcgtgccgcgcaggacgtgccgcttgcgcacgccgtactgctccacgccctcgggcgagacgctgacctggacgcgctccatggcggcgttcccgcagcgcgcacagaacacgcggcccacctccttggacacctggaagcaggcgccgcagcgcaggacccagcgcgacagccgcgtcacgcggcggttgtcgggggtgaccagccgcaggcccatctgcaggatcacgttctgcatcgcaaagtcggcggtcaggatgcagaccgaggaggcggcggcgggggaggggcccgcatcgtccccgctctggctccgggcctccgcctcgcacccctcgccctcctcctccccgctctcctccccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggtccactcgcccccgtcgacgtcctccctgccgccgtcgtcgtcagaggagtcgtcgccgcnnnnnnnnnntgtggtccactcgcccccctcggcgtcctccctgtcgccgtcgtcgtcagaggagtcgtcgccgccactgctggagcccgccgccacggccgcctcggccagggcccgcgccgctcgagcggcctcagtgtcgccgtccgcggtctccctttcctccagcgccagcgcctgcatctgggcggccacatggctgcccgtccccgccgcggcggccagcgcctcctgttcggcggcctcctcggcggcgttcaggcgctccatctccgcccagttgtcgccgccctcgccccagccgggcagcgtgcgcgtctccttcacgcgccgagagacgatcttgagtgggggggggaggtcccgcacgcgcctggggccgtggcgcgcgatctccagcatgcgggtcagggcaatcagccgcacgtcggcgctggacagggcatgcgcgtcgcccgtggcccgggcaaagcgcagcactgtggatggaggggcggggaggttgtgggcttgatgcaggaacacacatgtgccggcgagcaccggccgaggaatgtttttgggtggggataccgaggtcaaaggactggggcgctggccggccacctgccacccccccccgccagcagcagggctctccgccttggcatgccaattttagcagagcacacgaaccaatcgccgcctcctccacgccccatgcacattccccctctccccgcccaacattgcatacccgctttgacgtcctcctcagcgggctctgttgcctccagggtgtagggcagagcctccagggtggcacgtgactttttgtcacgcacctccgcaagcacctcgggagtggtcactgcacggttggccagcttggccaggaggagcagcccctgccccgagatgatggcattggcatccagcaccgccacatccaccgactcgtccgggcctatgtcggtgctggggattgcaggcgccgctttcttggctatggaagcccagctcatggtcttagcgtgggctgggcagtggtgaagggcttccctgctgcaaggtggtgcggtggtgcagaccccgactggtgcttcgctgtggacggcggcaccgagacggtcgtgggggaaagttcgcaagcacaccaaaacagtacggatagttcatatattatcgagtatctcatgacatgtttagtatgatgttgtagcttgtaatgccgccacgnnnnnnnnnnggagttcgcaagcaccccaaaacagtacggatagttcatatataatcgattatctcatgacatgtttaatatgatgttgtagcttgtaatgccgccacggtccgtcgtggtgatttcgtcgatgtggcgccagcgccttattttggtccgggaagtgccactgagcgcttggtcaagggtctggttcgcgagaagtgcacaattaccggccctagcataccgaggctaggtacgaagctgttccgcgtaaacttctgatttagaagaattgtacggaacccttgaccgttgcgtgttgtggaggagaggcttgacctctgaggacgccacctttggacgatagaagtgatggtcttagaaggcgcattgaatggctggagacgtccaatgcatgttggctacatcttatgaaagttgnnnnnnnnnngtaccggccgtagcatactgaggctaggtgagaagctgttccgcgtaaacttctgatttagaagatttgtacggaacccctgaccgtagcgtgttctggaggagaggcttgacccctgaggacgccaccttaagacgatagaagtgatggtctgagaaggcgcattgaatggctggagacgtcatatgcatgttggctacatcttatgaaagttgtagccagcacactttggtgcatgattcgatcgtctcgtccagccagggtgcgtgaagtcggtcggcaggacctacttatatgtcggatcccatgggcaatcacgaggcgatagcacatgactctgcatttccagaccgggttagtcgcttatggaaggcatatttccatcgatccgaatcccttccccatggacctcccttccatgaccattctcggccatggtcacgtcggggcagttcaacaccacacaaacaacaacgcgcgagggtacgatccacatacgtccttgccgcataatttcctccacattacttgcgttacaatcgcatcccacaccccttgaccattcttggaaggacacagtcaaataagtcgcgcattacccgcgatcttnnnnnnnnnngatttcctccacattacttgcattacaatcgcatcccacaccccttgatcattcttggaaggacacactcaaataagtcgcgcattacccgcgatcttggccaatgaatctaatgggctcggttaagtccacgctctgtggggtcggtctgctgcccacagctcgccaggacgcaactatcacccgcgtttccaccaatccagcctcacaaaaccatgccgaagcgttgagctcctcgcagaggggtcggacaagcccgcgaccctctgcaaaagtgcacgccatagcggaaggccacatggtggcgccaccaacacacaccgagacggaccgcgtagatgagcgggagtgggcggagttcctcaagtcctttacatccctgcaccaggagaggtcatactgggtgcctgatgcccaggtcgaaggtcagtccacgcaacatggacgtggagcggcaggatgtgcacggctaccctgttggcatgtagggtcttggagacatgcgatgcatggacatctccttgcatgctgccataaagctgcaacaaaatatctatcatacacaggcacaatccctaaggaattggaggggaccctcctcaagaatggacccggccagtttgagattggggggcagagggtggcgcatccctttgatggggacggcatggtagccgcctttgccttcaaggaaggccgctgtttcttcagcaatcgcttcgtgcgcaccaaaggtgtgccagggggtgtggttcatgttggatgcaagtttgttacacgccgactcagatcctggtcaaggtgcttgcagtgtccgctccatgcagcaagctgcttctcgctagcgccacacaacaatgctaccaggatgcttggcctccaacacaaggccccctctccccatgatcttctcacacacccatccaacacatgcagcctataccgaggaacagcgggcggggcgcatgctgtaccgaggcgcattctcggctggcaaccccggcggaaagggtttcttcaaccccttcaagcttgatgtgaagggcatcgccaacactggggtggttcgctggggtgggcgtactctcgccctctacgaggtaggtgccctggatgtgcttgaggcatgctcgtgcgcactgatacgtgcacccaagatcccaggtccggctagaacctagcttccataggccttgtcctctcttgaacccttcctcacttcatgtcaatgacagagggatatgccctacgagctggagtctccagacctcaagaccctgggaactacagatgccgacggggcgctcaaggatacagacccctactttggggcgcactatcgcatcaccaccgacgctggtgggatggacgtgctgtgcggtcatgcccttgtgggaagggctggttggcttccttgccctgctttatctctatcgctgatttccttgtgcttctgctctttcatccgagctggcagctcatcatgtgcacactatccggtattgcagatggaaagcggacgctgattggcttctcttcctcagaggtcggcagccagaaccgactgaccgtctgggagtttgatgaggacttcaaccgtttgacaagaacccaagaggtcttcaaggtagggggttgcgctgagcaaactgacctgaatggagtgagattggcctctgtgctctcaggccctgtggctctgttggctgattgacctcccgacgcttgggttgggcagtcattgcttgcgtcatcagccaccacccctggtgcttaccaccttctccccatcccccccccttcagggtgcgttcgggttctaccacgactttgcgatgaccnnnnnnnnnnaacacttgggttgggcagtcattgcttgcgtcaccagccaccacccctggtgcttacctccttctccccatcgccccccccttcagggtgcattcgggttctaccacgactttgcgatgaccgagaaatactacgttttcctacagaacccaatccgactgaacttgtacaagttcgtcacccagtacatgctgggaaaggccggcgtggcaggtgggcaggctgagcttgaccctgggggtgcttggaagaccttccagcttcttgtggaattggtttaacagtgacgatccagtgctgaaactttgctgcccaaagacaagtgtcaaggaatgaatgacagtcctattggtcctcgtatctcccatgcatctgacattccccctgtcctcgcagagtgcctggnnnnnnnnnngaggaatgaatgacagtccttttggtcctcgtctctcccatgcatccaacattccccctgtcctcgcagagtgcctggagtttgataccagccagaagagcctcatccatctcatccccaggcctggaaagggcggcacgcgaggtatgtggaggctgagcacctgtcgtttttcggcatctgcgaatgtgctttgacaagaagcctttaggttctggggtgtgacagtattgcaatgatcatgacatgtgtaggagattgcctgatgcatgctgtgggcacgcccatcatgtccactgactgtgtacgtcnnnnnnnnnntgcgaggtatgtggaggctgagcacctgttgtttttgggcatctgcgaatgtgctttgacaagatgccttcaggttctggggtgtgacagaattgtaatgatcacgacatgtgtaggagatcgcctgttgcatgctgtgggcgcgcccatcatgtccactgactgtgtacgtcacatcatccccctcatactactaccgtaggaacctatgagacaacgccattctttgcattccaccactgcaatgcctttgagtctgccgatggcaagaccctgatcctcgacaccgtcgcggagctcaagggtgttatcttttcgtaannnnnnnnnncaccgtaggaacctatgagacaacgccattttttgcattccatcactgcaatgcctttgagtctgccgacggcaagaccctgatcctcgacaccgtggcggagctcaagggtgttatcttttcgtaagtgttgatgctggctgattgcctcattgtgggcctggaatgctgattctgatcctgatgctgtgcgctggcaggcaattcccactcatcccagcttctgatattgataacagggccaaggtggagggacctgacaccgtctatgggcgtgaagagaaccgtgggtccctcacgcgcctctccatcaatctggcctcgggcaaggtaccgtttggctgctggtgcatacatgatggccttgctcaatgatgtcacaggtctttcttgggggtggggcacctgctttgggggtggggcacctgcttggccagaagtgagcatggtgggctctgcaaatccatcatcagcttcattctggcatgtgcaggtggaccagcgtgtgctcatcgataggtctgtcgagttcccgtccgtggcttccacggtcgtggccaagcctcaccgccacatatacatggtcggggataggttcaactcgccagacacttggggccccgtccaggtcagtctggcttgggagaggttgtatgtgcgagtggagttgccatgagtggctgacatggaatgcccccccccgacctgcagtatacaaggggagggggtgatactgggtgggagtgatggttgttggcgttccatggctgactctgacttcccctgtggattgccacactgagctcccgacgagcacccccccccnnnnnnnnnntgtccaggtcagtctggcttgaggagaggttgtatgtgctagtggagttgccatgagttgctgacatggaatgccccccccacctgcagtatacaaggggagggggtggtgctgggtgggagtgatggttgttagcattccatggctgactttgacttcccctgtggactgccacactgagctcccgacgagcccccccccccccccccccccccccccnnnnnnnnnncccttgtactctaggtgatctgcaaggtcagcgtctcagagggcatcgagagcctgagccccaaggtctcccaggatgtgtactacccgggcaggtcctgctgggtgcatgaacccgtctttgtcccacgcccgaatgcaaaggtaaagtggtacctgacaaggtactgtgctggaagcagtgtnnnnnnnnnnatacccttgtactttaggtgatctgcaaggtcagcatctcagagggcatcgagagcctgagccccaaggtctcccaggatgtgtactacccgggcaagtcctgctgggtgcatgaacccgtttttgtcccacgcccgaatgcaaaggtacagtggtgcctgacaaggtactgtgctggaagcagtgtnnnnnnnnnnagttaaacatctgaggctgtgtgcgcgctgcattatgcttccattgtccatcaaactatgtttccgtacatcccaacccaaccaaatctcaggctgaggatgacggctgggtcctggcaatggtgaacgactcaaccaccggccaggccttcatggcgatcctggaggctcaggatctggccgcagggcccattgccaagattcacctgaagcatcattaccctcaaggtgnnnnnnnnnnctcctgctgggcaggcacgcgaatgcaaaccgcggtcttcaccatcgacatgcactctgcctggccagccattcaagtggtacacatctgaggctgtgtgcgcgctggattatgcttccattgtccatcaaaccatgtttccgtacatcccaacccaaccaaatnnnnnnnnnntttcattggacctgacccaaagcagccctacgagccgcgcctgcacgatacccgtggcgtggatcccctcgtgtacgcttaggcgctagagnnnnnnnnnnggtgtgtctcgaggacagggggtgacctaacgctggcttgtgccttccagaccgtggaccccgacgttccgacacggtggtgaggccgtcgcatcttgcctcacctcacccttcacatgagannnnnnnnnntgtgtgtctcgaggacagggggtgacctaatgctggcgtgtgccttccagaccgtggtccctgacgttccaacacggtggtaaggccgtcatatcttgcctcacctcacccttcacatgagaaccgcgccctttcccgaccacctccccgacagctttgcatggcagctggtccccagactttattggacctgacccaaagcagccttacgagcctcgcctgcacgatacccgtggcgtagatcccctcgtgtacgcttaggcgctagagaacacaacacactcacacactcatatgtatactacatgcatacacgggagtagaatatgttcttgcagatgatgccattcttgtgtggagcctattatggcgatgtgtggcgcttagtatacgcaggaaaacgttcataccccaatagtgtaagcatgggttactggaccacgtgatgtccaccttccctcgatcttgggttcccagtgggcccaggtgcccacagccaagttctcagtaaccccagtgccttcgcatcacgtcaaaaannnnnnnnnnatggagcctactatggcgatgggtggcgcttagtatacgcaggaaaaagttcagaccccaatagtgtaagcatgggtcactggactacgtgatgtccaccttccctcgatcttgggttccagtgggctcaggtgcccacagctaagttctcaggaaccccagtgccttcgcatcacgtcaaaaacctcctcactcactcccgcctcctctcttgcctggctgcacgacccgagaggttcaagtctgagcattatagaggcgaagtggccactcaagcacatgacattatcaagcctgcttcttaaatgtcagaagcacaggtgtgctggagcaaaaattgaggccagttcgtctccaagccgcggcgccactcatgcatccttgagctgcgccaggatctggttggagagggagcaggtcaggccgccgccgtcctccaggttgaaggtcttgaaggtgccgtcctgaacgacggccgagaagcgcgcgctgcggacgttgcctaggaatggcgtggcgtcgaactccacgcccagagccttcaccgcctcgcccgcagggtcggcgtagacgtccaccttgccctgcgcgccggccgaggtggcccaggcatcggcgacaaaggggtcgttcacggtgagcaggacggtgatctcattgccggccgccttcagcttctcgtagtcgttgatgtagccgggcaggtgcgtcttggagcagccgggggtgaatgcgcctgtgcaggggtggattggacggccgggtgggatgagggggtgatgagggtggcgacgaggcaacgatcgagaagaaggcgttgggcaggacaacgaggtcacctgcggaccgactctggtgcagcccacgcatatgagagcacaagttttattgacaccaccatcacccgctcccgtccactcgctcaccgggcacgcccacgaggatgcccttcttgcccttgaagaggtcgcgcagggacaccttctcaggcttctcgttcacgagatgaacgagctggacatcggggaccgcgtcgccagcctgatgagggggagatgtggggtacaagtcaggaagccttctcgatcactctgctgggtagttgatccacagctgcagattgaacctctctcgagcaaacccaagaagcactccggctgatcgtgcatagctaggcattcacgctgcgattggcccaggcggggcctagcagtggaccaggccggtcccggccacaagtcacccgaccctcgtcaatcaccttgggagccatgttgccttgtggtggattttagttatagttctgtatgatctatatttccaagtgagaatttatgcatctctcgatcagcgtgtgtgtgtgtttctatgggctgaaggctcannnnnnnnnncttatagttctggatgatctatatttccaaatgagaatttatgcatctctcgatcagcgcgtgtgtgtgtttctatgggctgaaggctcacgtactccctttcggacggaagcatctcatgctgacctggcgccgcgcctcgatcttcgacagatgttgacaggcacatgcaggcaggcatcagacagaagggcaggctttcatgcagggcgatgagggggcaagggtgcgtagatctggctcggggcagacacggtgcaagggtgtgtggaagattcggtgggcataccctggcgcaggggcacaggtcgatgcctgggcacaagaaacttcgggaagggacgcgccctgtcgaggtgcggcgggcacccagggcacggcgtccgaggtgctgacacccatcctagtggcagccggtgcnnnnnnnnnntgatgggcgtaccctggcgcaggggcacaggtcgatgcccgggcacaagaaacttctggaagggacgcgccccgtcgaggtgtggcgggcacccagggcacggcgtccgaggcgctgacacccatcctagtggcagccggtgcaggcgtggcgcgggccatgggcctgggcctggggctgggctgcggccttcgccccctgctgcttcccctccgcgccctccacctcggcgcgcaggatggcggccgcctgcaccatgttgcgcaggctgggcaggacctcggcccagcgccgcgtcttgaggccgcagtcggggttgacccagatgcggcgcgcgtcgccacccaggatgcccgtgccggagaaggagcgcagcttgtccaccaggaactcgacgctggggacgacgggggagtgcacgtcgtagaccccgggtccgatgtcgcgagcataccccgcgctggccagggccagcaccatctcgttgtccgaccgcgagttctcgatggtcagcacgtcggcgtccatggcgtcgatggcgggcaggatgtcctcgaacgaggagtagcacaggtgggtcaccaccttggattgattggaggtgggtgggggtggggaggaagtgcgtgagggtgtgtgcgacatgcccgtgggtgcacaggcgcaaaggtgacggggagcctccctgtgcgtacatcagcnnnnnnnnnncgcgagggtgtgtgcgacatgctgtgggtgcacaggcgcaaaggcgacggggagcctccctgtgcgtacatcagcaggtgccaccactctgcagcccactcttcctcccagtcaccccccaacacctacattcctcacagcttcagaccatggacgcacaccacccacccactccctcccggcgcaccccaccccacgaccccaaacacgatcaccccacctgcgtctcgggcttggcgccggcgacggagagcttgaaggcgtccaccgcccagtccaggtaccgcgcccagcgccgctccttgagcggcaagccctcgcgcagcgcgggctcatccacctgcacgatgcggcagcccgcgccctccaggtcctccatctcctggcgcagggccagcgcgatctggaaggcctgcacgctgcgtgccacgtccttgcgcgggaaggaccagttgagcatggtcaccgggccggtgagcatgcccttgacggggcgcgccgtcaccgcctgcgccaggcggtactcgtgcaccgtcatgggcccggcgcgggtaacgtccccggacacgatgggcgggcgcacgtagcgggagccgtagctctgcacccagccgtgctcggtgaaggagtagccgtccagcttcaggccaaagtactccaccctgggagggcaaaggggagggacgggtggctggggcggagcgagctttcggtgtggggatggaatggggcgatgcagcaggaacatgaacagactgcttggcctcgggtctgagcggcaggcattcccccccacgccgacaccttccccctgcccacgactctcacatgtcggagcgctcgggctcgccgtgcacgggcacgtcaatgtccagggcatcctgcaggccgatggcatacccaatctccacgccgatctgctccttgtactgctccgtggagatggtgccgcgcttgtactgcagccgcgcacgcctatgcgaggatggggcagggtggcgaagggggggtgattagggttggaagcgtacaggaagccgccgctgctgcatggctcagatactgtaccgggggacaggcgcctgacgccgagccattcccccggctcatgtcacagtaacagacatccccccacgcccctcctttcccccctgctgccatagccttcacctgatctgctcggtctgggggaaggagccgatggaggtggtggggaaggggcggaactggggctgctttgggcggcgcgtggcgtagtcctcgctgcggtggtacttgctggcgtcgatgccggagcggccctcgtcggaggggaaagcggcgccaaaggtctccagcgcgggcggcgcggtgccgctcccagacttggccacggccacgatttcctgcatggcggcggggggggtggggttgtggagtgacccggggtcgggatgaggggatggggcgcgacaggcgggcgactgggttgtgaggctgtgcgcaagggtggcgttgcaacaagagggacgccaggggcccgggggttgtcggtgcactccatatccagcccacccccaccatatcgcttgcatcctccccgcatccccgccgcctggacacctgcaaaaccccacccctcacctccagcttctgcagggcaaaggccagacgggcagtcagctcccccggaaggttcttctcggccctcacgtcgtagggcaggtgcagcagcggcgcggagctctgggcgggaagggagggagggcggcaaggatggcacttgattggggggtggtgctggggatcagagcgcagaggtgtcgcaccacaggtgcatggtctcgtacttctcaaaagcctccctcttgccctcacacgtttcactgcccaaccaggctnnnnnnnnnncactggtgcacggtctcgtacttctcaatagcctccctcttcccctcacacgtttcactgcccaaccaggcttcacctgcaccacgatggcctggttgggtccaagccttgcgcggagcgcggccaggagatccactgcagtgccatcgtccctccagatgctgcggccgtccacgatgccggcgcccagccgcttgtcctgccgatcgtgtgagggggtggttgtgatgcagggtaatgaggggctgccagagtccagtgtccagtccggcacccaactcaaacaagctcgcatgccccacctcaacaaagcaggtcgtcacccacaagcgggcaaaaccatcccaagtacgcacctcagggaagcccagcctggcgatggtggcagcggtggcacagccgtgggcggccccgggcacggcgcagaagtcgagggagatggcctgcacaggcaggcgcaccagccaggagtagacgtcctcctccacatcgtcgtagtagaccaccaggttgagtggcacccccacgcccgccagctggctgtagctggattcgaaatcggcctgcagcttaatggctgtccccagggccagcacaggctcgtgcatctgcaggcatggtttcacgagggaaaacttaacaggcattggttgtttcccccttcactcacgcgtgctctggatcccccttcatcttttccaacccctgccccgtctgtgagtctgggccctcctgtcatcccaggcaggtccccagagagaagcaagcacccgacaggaaacaagtagtgtgcacggagcagggtcgcagggtagannnnnnnnnnaggaaaacttaacaggcatcgattgtgtccccttcactcacgcgtgctctggatcccccttcatcttttccaaaccctgccccgtctgtcagtcttgcccctcctgtcatcccaggcgccccccagagaagcaagcactcaacaggaaacaagcagtgtgcacggagcagggtcgcagggtagagatgatcgaggattcgaacctcgttattctcccaggggggagcgctttaccaatcggccaatcatcaaggttgcgacggtgcaggcacaaggcaggagacaggcagggcagaagaaagtgagcaaggcatgcacagccctcccaccccccttcccacagtttacaacatcgacatggcatgcaggcatcgacacctctcgcagtgcagtgcacggcagagnnnnnnnnnnacccccttcccgcagtttacaacattgacgcggcatgcaggcatcaacacctctcgcagtgcagtgcacggcagagcaggccccggcaacacagagtctacaaacgacgtcgacgccccgcccccggccggaggatccacccatatcacagacctggacctccggcacacccagcgnnnnnnnnnntcggcaacacagagtctacatacaacgtcgacgccccgcccccgcccggggggtccacccataccacagacctggacctccggcacacccagcgccttgagccgccccaagacctccacgtaggcgggcagcagcgccccgaccagggccgaggcgtcggtgccctcggggtagcgcgccagggacaccagggtgatgggcccgatcaggatgggcaccgccacatcagaccccagcaccgcctgcccacgctccaccttggccagcaggccggaccagtctgccttgaccgctgggctggcctccagctccggcaccatgtagtggtagttggtgtcgaagaacttctgcatgtccagcgcgtgggcaccgtgcacaccacgcgccatggcaaagtactgagcgaagcccggctccaggtgctgcaggtgggaagaaaggggacatctggttgtgatcaggaatggaatgaggggggtcgctgtggcacatcccaaagtcagtcctccatcagtcacgtgtcccactgcactccgtgggcatcccaaccccatgcacaatcaaggacagtttgtccaacttcagccctaaccccttgactgcaagatcctttcctaacctggaagcgcttggggatgaggcccaggtaggtgatgaagtccaggatctggtcgtagtaagtggagtccagggccaccaggtccaggccagcatccttctgggacagccaggccacccgctcggtctgctcagcgacggtgcgcaggtcgtcggcggtggacttgcccgaccagaaggactcgagagcctttttcatctcgcgattgggcccgatgcgggggaagccgatggtggcggacgagatctgcgtggaaaccatctgcgcggagaagataggcaaggtttagaggagaaaccgcgggtacgaggcgcaagaacaggtcttggcaggtgctgnnnnnnnnnncgaggagatctgggtggaaaccatctgcgcggagaggataggcaaggtttagaggagaaaccgcgagtactaggcgcaagaacaggtcttggcaggtgctggtgtccgtttgaatacggcgtcgaggcagatctcccccgggcccgactgcaacaggctcgaccagactcacctcgatgaacttgcggtgcagattgatgataagtgaagctttgtcttgatttgcggtcgaggcggcggcagcagaacagatgatgtgtgggagatgtgtgatccccgggcggcgaacgtgcgcatttgtgcgaagcatccgttgccccccgggtcgattgctatacttcgaccctggagaatcacgccattgtttgattgtcaccgctggggacgataatctggagggcacgggaattaaattagctgggagagaggggaatcgcacggcaggttcgcgtggcgagtgccacagtttagtggatgttcattgaatggcctgtcaaggtgggtgccagccagttcgggctgctgttagctgagccgcacctcccaggccaccgccggccgcggccaggccaggccgtgcagcagcgttgcgccgaggccgcgcacggcttcctctcgggccagcgtcagcgtgcccgcgaccaggccacgcgcgccctcgcccgccttctccccttcctcctgcgccagctggcgcgccagctggcgcagcgcgcgctcggccagcgcgggccacccgcccccgcgcgccggctcccgcacgatggcaacgaagcgcagcggtccggccgcctcgc

SEQ ID NO: 34689 - DNA, 141 bp, Chlorella protothecoides
agtgacctgatgaatgccaggggcgtcatcttatggcagatgcctgaaaatcgggggggaaattccatgcactgtaagctggtttccaagtagtaaaagataattctttatggactgtcaggtgagcaatccgaatgcgtg

SEQ ID NO: 34690 - DNA, 393 bp, Chlorella protothecoides
  modified_base (96)..(325): a, c, t, g, unknown or other
tagccccctctgaacctgcaggccggcggaggaccaggacacgtcgagccaaggtgatgggcaggacccgctggccgccagccccgccagccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaggtccccagccaccagcacaccgacattggcgacccccccgcatgcccagactctgacggtcca

SEQ ID NO: 34691 - DNA, 73 bp, Chlorella protothecoides
agagggtggactgccatgcgttggagccctggttgggtgcaaggggcgcttggtgtgtttctataccagaggg

SEQ ID NO: 34692 - DNA, 61 bp, Chlorella protothecoides
cgcaagcgccttggccagcatcgtcttgcctgtgccgggggggccgtagagcaggaccccg

SEQ ID NO: 34693 - DNA, 101 bp, Chlorella protothecoides
cctgagccctcggcgcaagaggcttgggggtttggcccgctgtccgggcgggtgccaggtgcaggacgacaacgcagctgcggagcgggcctggcatcccc

SEQ ID NO: 34694 - DNA, 61 bp, Chlorella protothecoides
cggaccccgggcgggggccagccgcgcatcaatgcgcggcgtgcggggcgggggggtgacc

SEQ ID NO: 34695 - DNA, 61 bp, Chlorella protothecoides
cggcgtgcggggcgggggggtgaccaaggccgcgccggccgcacgccgccggcgctgacat

SEQ ID NO: 34696 - DNA, 70 bp, Chlorella protothecoides
cagcgcctcgcttgctcgccccctccagctggcggcatgtcaggacgatgagtcgctgcaggttgtacgt

SEQ ID NO: 34697 - DNA, 88 bp, Chlorella protothecoides
agccatggtgggtggaagaccggtacgaggtgctccacaatactgcatgctactgaattaacaaggagaatgcggcaagcgtgtaatc

SEQ ID NO: 34698 - DNA, 75 bp, Chlorella protothecoides
caaggagcctgacactgaaggactggacagtgccactggcccacgccctgtggacagtagcagcgatgttccacc

SEQ ID NO: 34699 - DNA, 80 bp, Chlorella protothecoides
gctggaagagctcgatgtgaggcaggggcggcggagcggcggcagggttgcctgcctccggctttcatggagtagcatcc

SEQ ID NO: 34700 - DNA, 61 bp, Chlorella protothecoides
cgtgccggccaggcgcttggcgggcgcggcgcccggcgccctcggcgcgggctccgggggg

SEQ ID NO: 34701 - DNA, 61 bp, Chlorella protothecoides
atggatgttcttcttggcgcaggctacgtgggacggcacacaccgtccctgcgggggaggt

SEQ ID NO: 34702 - DNA, 179 bp, Chlorella protothecoides
cggcgtgctcgccgggcgtcagaggcgagtccatgcacacgtggtttggggggctgagcttgccgggagccggcatgccggcatgcaggcctggcgttccttgccgccacggagcgcccgcaggtgcatggtgttgcagacacagccctctgccccgtctccatgcccaggtggcggca

SEQ ID NO: 34703 - DNA, 64 bp, Chlorella protothecoides
aaagagcaggagggcgatggcgggggtggcaacaaccgggtccagggacagcgcgctccacacc

SEQ ID NO: 34704 - DNA, 61 bp, Chlorella protothecoides
gacttggtggtgcaagttcgtcacgcaccccccttccagggtctacctaaaccctcgtgcg

SEQ ID NO: 34705 - DNA, 61 bp, Chlorella protothecoides
gatcacaattaatggtctggatgatggtagctgggcgaatctactgaataaggtcctgccg

SEQ ID NO: 34706 - DNA, 72 bp, Chlorella protothecoides
tctccaccgccaatcaaccctccccgcactcgacctcctcattctctgctcaagcacgccggcctccgacgt

SEQ ID NO: 34707 - DNA, 80 bp, Chlorella protothecoides
atcgcatcgtctcctgctgcagcatgctccgccccccaggcaggatgagccacctgggaacactgcaggctcctgattcc

SEQ ID NO: 34708 - DNA, 120 bp, Chlorella protothecoides
cggggcggtgtggggaaggctgtcgtctcggttgggccgtggggaatcgcgcgtccgcgcacccagcggcgctggggagagaccccgcgtgtcgagggctggggctcagcgtgcggagcg

SEQ ID NO: 34709 - DNA, 61 bp, Chlorella protothecoides
gatatggtcttcattcgttttgccatcgccacccacaacaacaacaacccaacttcttccg

SEQ ID NO: 34710 - DNA, 63 bp, Chlorella protothecoides
ggcagactgtttcgacgggcaaattaaggccaaggtgaccttgtacctgctgtaattcccatg

SEQ ID NO: 34711 - DNA, 66 bp, Chlorella protothecoides
acctttgaccagggcgggggccgaattcaccatccagagaccgtctgcatcgacgacgagcgggat

SEQ ID NO: 34712 - DNA, 70 bp, Chlorella protothecoides
gcactctggacaggcatgcctgggggggggcccacgccctaagtcaggcaggcgaatcttgtggtgaagt

SEQ ID NO: 34713 - DNA, 61 bp, Chlorella protothecoides
tgagagagcgacacaggactttcaaggtgtctgatggatcgatggggacgtgaataataat

SEQ ID NO: 34714 - DNA, 72 bp, Chlorella protothecoides
gatggatcgatggggacgtgaataataatctatagagtatatatcagcctgaccacagtcctgagcaccatc

SEQ ID NO: 34715 - DNA, 136 bp, Chlorella protothecoides
tccgcgatgaaggcgccgtcaccccggatggagggtgcggtgggccgagaagaggggtgggccggcgcctcatccagcgcgctgcgcagggaagccagctccatgatgagacgagacggtggaattgtttgaactt

SEQ ID NO: 34716 - DNA, 127 bp, Chlorella protothecoides
ggcgccgcacggcggcgccgcgcggcgtgccgcgcgggacaagggtgatgccaaggccctcaccgcctgggagctacgtgcccgagcgggcatcctggctgttctcgtcggggtcgggggcgtggac

SEQ ID NO: 34717 - DNA, 80 bp, Chlorella protothecoides
tcctcatgcccaacgccccggtgagggcgtggagtgggcggtttgctgctgagtgggcggtttgctgctggtggggatgg

SEQ ID NO: 34718 - DNA, 71 bp, Chlorella protothecoides
gtggatccagccccacaaaccatgcaggttgctatgcagtagctaggcgatacggtggcccagctgtgttg

SEQ ID NO: 34719 - DNA, 362 bp, Chlorella protothecoides
  modified_base (99)..(275): a, c, t, g, unknown or other
ggggggggaggggatcgcctgggtgaaggaggggaccgttttggtgagggaggggatcgcctgggtggaggaggggagcgactgggcgatggcggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgatgttctgggaggtgggggtggttctagcaggctgatggcacgctcacgaaagtctgtcagcttgcagtcgttgaccactttg

SEQ ID NO: 34720 - DNA, 113 bp, Chlorella protothecoides
gcagcaggctttgagacattcatcatgccaccccccactgaaccaaatacatgctccattccctcagtggacgtcaccgcagcccaccacccgctgaacacacctgcagcagg

SEQ ID NO: 34721 - DNA, 77 bp, Chlorella protothecoides
ggcgcggcttgcgcaagcggcctaccagcccctcaccgtcctgtcgtacgggcgggcggcgggcccctcacggtacc

SEQ ID NO: 34722 - DNA, 61 bp, Chlorella protothecoides
ccagcggcagacgaacctcctgtaccaggccgggacccgtccccagccccgggcgcagcac

SEQ ID NO: 34723 - DNA, 115 bp, Chlorella protothecoides
ggccgtcttgacggtgacgctgcgcaggtgattggcggccgcaatctcgtaggcccccgcgccggggacgaccgccgcgtcgtcgatggtgttcttcaccgccctcagcccgtcc

SEQ ID NO: 34724 - DNA, 1076 bp, Chlorella protothecoides
  modified_base (100)..(270): a, c, t, g, unknown or other
  modified_base (528)..(668): a, c, t, g, unknown or other
  modified_base (736)..(963): a, c, t, g, unknown or other
ccctaggggttgtgggcggggggtgaagagcgtcggtgacagctgccaggatgtgtcatgagcaaaacttgctccaggcaggcctaagaggggggtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttacctgccggacaatatgtaggtgggaggtgttgcaattgcgaaaggtagctgcccgcaattttctaggcaagtgcaatggacacttgatgaaaactttcagactaaatgacgacaagactgtacaaggcgtgccttgctctggtgctgatgtcctctctggcaccctctgcagcaggttgttcccgccatccccccatgcgatgtttccaagactcgctgaacctcctcaccttggcaaactgcgcggtgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatggtgcagcagctcctcaagggtgggcctccaccgagccttatgactggcagactgcgcctgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatggcgtggtcagggaggtgcggagggtgcacacatggcgctatgccatcccctttctgtttgtattagcgaacctcgccccccgttctacaggtgccaggcgcctcactt

SEQ ID NO: 34725 - DNA, 61 bp, Chlorella protothecoides
gcgtggcatggcctgcgtcctcgggcagtcgcattttcgaatttgccgttggagagtgcat

SEQ ID NO: 34726 - DNA, 76 bp, Chlorella protothecoides
cacgccgcctctgtcgtcgtcgcgctgcacagctgccccccggagaggggccccggggtcgcggaagtcgccgcgc

SEQ ID NO: 34727 - DNA, 108 bp, Chlorella protothecoides
cggccggggagtggacgtcgatgcccgtaatgtctggcatgtgatctgaagctgcaggcccgagcggacccccgcacatgccatcggctcgggcctgcatgctggaga

SEQ ID NO: 34728 - DNA, 73 bp, Chlorella protothecoides
ggcagcccccgcggcgcggccaaggggcgctccggcggagcagcacaaacccatccaggcgcgggcgacgacc

SEQ ID NO: 34729 - DNA, 171 bp, Chlorella protothecoides
acgaatttatcctcctgcctcccaaaatctctcattgaaaaagaattgtctatgcacaggcatgccaatacactcttccagggtcagggcatgtactgtgatggaccccatcatgagtgccttaacgcatgccaaagacgagcatgctgtgagctaccggatattggaagg

SEQ ID NO: 34730 - DNA, 103 bp, Chlorella protothecoides
gagtgggaacaggggaattgtcagggtccaaggccagccccccgccgctgccaggtcgcagttaccacgagcgctatcgccgggatactctgcacgccatacc

SEQ ID NO: 34731 - DNA, 61 bp, Chlorella protothecoides
caggggccgccttgtcgcctgcagagggcgtcgcgcccggcggcgcgctccgcacggtggc

SEQ ID NO: 34732 - DNA, 65 bp, Chlorella protothecoides
ccctcgcgcagggccagcagctgggacacaccgaagagctgggcctggaggggggtgcacccggg

SEQ ID NO: 34733 - DNA, 121 bp, Chlorella protothecoides
tggctttggagtcgttgctgaggtacaaattttgatgtagttgggaagagtgggataggaattccctccggatgtcctctcctgagccacagtacttggccatgaaccaatagacacaatc

SEQ ID NO: 34734 - DNA, 79 bp, Chlorella protothecoides
ccatgcagccaagcaacgattgcaatttcaagaatgtagattccgcaaaaacaccctcgtgaaacgatcccgtgcgtcc

SEQ ID NO: 34735 - DNA, 107 bp, Chlorella protothecoides
gcgctcgacagggcgcccgtgcccatggaggcaggacactgctctagcaccgccattgtgaacttttttatatactgtttctgaagcagatgccatggcagaggacg

SEQ ID NO: 34736 - DNA, 616 bp, Chlorella protothecoides
gcgacgacccgcgccgcctcttcgtccgggacgccctgccctccaccgccgccggcgcagggcccgggttcgtggcaggcgtgctgccggcgccgcgcacgccccggccggcgcctggcgagggaggggccggtgtgtccccggcggctaagaggggtggcagcggcgccgcggacgaccgtgccgacgtcgccaacggcgacgcgggtgacaacagcgccgccgctgcgtccccgcactccgcccaccgccccgactcggatcccgatgccacgctggcgggcctgctgccgcgcctgacccgccccgactactacacggtgccctcgctggcggagctggcggcggcggcgcgcagcgacccggccgccgccgccgcggtgcccgagtttgtcatcggccgtcgcggcctgggcagcgtggcctggctggagcccgtggacgttcgcgggctggacctggatgacgtgatcaccatctcgcggggcggggtggaggtgtacctggagggcccggccaagccgccggtgggcgcgggcctgaaccgccccgcggaggtgaccatgctcaagatcttcaagacggacaaggccacggggcagccggtgacaaacgc

SEQ ID NO: 34737 - DNA, 79 bp, Chlorella protothecoides
acccgaatctccgcgcccggccagacaccttttaaagtatgtggggtcttggagccaggggcgggcctgctgcatttcc

SEQ ID NO: 34738 - DNA, 149 bp, Chlorella protothecoides
ggctgctcctggggaagtttagtgagcgcccctgcggccggcgcagcatgtggaatggggccctggcccttgtaccgcatgcgcggcagcttgtactgcgggttgaggcgcagcgcgcgcttgtgcgccacctcgctcaggaccagctg

SEQ ID NO: 34739 - DNA, 69 bp, Chlorella protothecoides
ggggttgattgtggccacgagttcagcccgcgatgagcgtcataagggttcgatgaggagcttggtggt

SEQ ID NO: 34740 - DNA, 161 bp, Chlorella protothecoides
ctgagacagaagaattctgggtggcaagtggggccgtgctatggggcccaacaatagtgcttggagcatgcagccatgcttgccacctcaagtgtaccccaactgtcaccttctgtcccaccccacagggtccggtgagcaccgtgaggaagggtgtcctt

SEQ ID NO: 34741 - DNA, 91 bp, Chlorella protothecoides
caccaggggcgggggggtggttgatgcagcatcgcgtccctcagcgacgcctggcacgctatgcaggctgcgtctcgcctgctgccggcag

SEQ ID NO: 34742 - DNA, 114 bp, Chlorella protothecoides
gggggggggggggttgatggcgggggtaaacatgtcgcacccccaccgcaccgccgcatgtcgagtgcggcgccccgcatcccacgtgccccgcccacctgcaggacgttgagg

SEQ ID NO: 34743 - DNA, 61 bp, Chlorella protothecoides
cttgtagtggagttggtggaggggtgtgagtgggagaaaagagcggtcaagccaggtggca

SEQ ID NO: 34744 - DNA, 69 bp, Chlorella protothecoides
acacggccgcggtcgggcagtcttgttatgggatatccactttggcacaatccagaggacaaaccggca

SEQ ID NO: 34745 - DNA, 120 bp, Chlorella protothecoides
gtgggcgtccaggtggacgtcaccgcgcggttgcgtggccaggagcgccgcgcgggggcttcaggaaggggggctgagctcgctgaggcagcgggtgtcacagaggtggacagggcggcg

SEQ ID NO: 34746 - DNA, 65 bp, Chlorella protothecoides
ggatatcataagccagagggtgggtgaaaagggcgttgcattgttgccttgtctttggggtggct

SEQ ID NO: 34747 - DNA, 76 bp, Chlorella protothecoides
ccttgtctctacttcagtcgctgccacagggcaatctgaatgccggtactgcttgctggtgcaccctttggccagg

SEQ ID NO: 34748 - DNA, 61 bp, Chlorella protothecoides
agaaggtaggctgatcacggctgtcgagggtgcctgggtgatggtggtggcacccggtgca

SEQ ID NO: 34749 - DNA, 61 bp, Chlorella protothecoides
ccattgtgcagccggcgcgcgtggcgggggggaccaccgatccccaccacctcaagtacgt

SEQ ID NO: 34750 - DNA, 116 bp, Chlorella protothecoides
agaaagggtgggagtggtgccggcgtgtgcgccgcccggcgtggggataccccgtgcttctggcatctggaaaccaccctggggtctgtgcaggtggtggcatgtccctgatggtg

SEQ ID NO: 34751 - DNA, 170 bp, Chlorella protothecoides
cggcagagcgggcgggctggagcttctcagaaggataataggtgacttcagggctgtgcgaggtacgaggcgggacacctactgtgttggccaggggaaatgttgggcgctgcgggccaatgccccagggtgatccatgcgcggcccacagggcaccccttccttgccat

SEQ ID NO: 34752 - DNA, 166 bp, Chlorella protothecoides
ggcggtgggcggcctgtgcaggccctgctgttgaggggtggggcgggcgtgctactgtgcgctgctgctcgtgctgacggtacaatccctcccgccttcgtcccgcccgctccctctccagtgtttcccgcctgttccacgctgagctgcctccaccctgatccca

SEQ ID NO: 34753 - DNA, 67 bp, Chlorella protothecoides
aaactgggacgtcttctcattggtagggaaagcgcatgcatgcggtgcagcagcccatacgacgctg

SEQ ID NO: 34754 - DNA, 61 bp, Chlorella protothecoides
tgcgaggcgagcgccgggtgggaaaggctactggcgcgcctgcatcccttacagcgtgcaa

SEQ ID NO: 34755 - DNA, 180 bp, Chlorella protothecoides
aggaacaaggaatcttcccctgcgcaattacctgccatcttgcttaacggtgagcatccatccagtgacaggacaattctttatacatggagtggtaggtatgcattacctgccttcttgcaatctgtatgcccagggctagatgcactgcttcatgtgtgggcttgttggcaggcgccc

SEQ ID NO: 34756 - DNA, 77 bp, Chlorella protothecoides
cgcttgccagcggcgactgtgctgcgtcaggggccacagagagcgcagaggcggagctcacacctcgcaccgcccag

SEQ ID NO: 34757 - DNA, 64 bp, Chlorella protothecoides
gcggtgcccttcgccctgggcccggcatggctggcatacccctcgccccaggtgcgtgtgtgct

SEQ ID NO: 34758 - DNA, 100 bp, Chlorella protothecoides
cctgcgctgaggccaggatgcagggccatgaactgacagcaagtaacagttgaactgatagcaaacatttccaacctcctccctgccctgcttgcagcaa

SEQ ID NO: 34759 - DNA, 61 bp, Chlorella protothecoides
atgcatataggccaacgtgtcggctggcggtcggggcgcgagtgcgtaggtttaattgaaa

SEQ ID NO: 34760 - DNA, 151 bp, Chlorella protothecoides
ggtcgaggcagcgcggcgcgggcgctccatcgggagcggcgtacaggtaacggctgcgacttcagggcgctgcggacgccggcatcccccccgctgccgtcccataccctgcacgttcttcgaggctcgcatgcacccccattgccccgca

SEQ ID NO: 34761 - DNA, 72 bp, Chlorella protothecoides
cctcacatcacacacccatcctctgctaccgcagggcgcagtacaccgcagactgcctcaaggacgaggtgg

SEQ ID NO: 34762 - DNA, 78 bp, Chlorella protothecoides
tgctcaggggtccgggaaaacgtacacacatgggcatgcgcctggtgaaaaaaatggcaacgaccccatcaagcctgc

SEQ ID NO: 34763 - DNA, 145 bp, Chlorella protothecoides
gctcagttggttagagcggcagtctaatacctcatattttttggaatcaatgaatcacattaggagcgaaaaagtattccagcgctgcggccccccacagctctccaattccaatacccgtcccctgctctcctcgcgctgcctc

SEQ ID NO: 34764 - DNA, 77 bp, Chlorella protothecoides
tccccatgcacaactctgcgcgcgactcaccagacgaccactctcctacttcaagtcgaccacacatctgcaagcag

SEQ ID NO: 34765 - DNA, 331 bp, Chlorella protothecoides
cccccccgccccgcctgcgccccctggcggtggccggcggcgcgtgcccccccagcacgccaaagtaccgggggcgcgggggcgccggccccctccgcccctccgccgcgccgtccttcgtgaccaccagcagcctgcgcctgcagcgcgacgagggcctggcggccatctgcgagtcgcccagcttcctgctggactccagcgacgtggagtgggaggggctgtcccccaccgcgcgcagcgccgacagccgcgcgctgtcggccatcctgtcggagcccagcggcgcggcctcctccgcgccgcgctcggcggggcgcccgggcggcga

SEQ ID NO: 34766 - DNA, 61 bp, Chlorella protothecoides
atgtccagtacccatcaacgcaccccttccacccaggagctggagcgagaactcaagttca

SEQ ID NO: 34767 - DNA, 93 bp, Chlorella protothecoides
ttccctgtttgctctgctagggcggacagacgtgcctcctgctgctctctcctcaccgcgaggtactgcaatcagaggatgaagtgtttgctc

SEQ ID NO: 34768 - DNA, 61 bp, Chlorella protothecoides
tggggaaggagtggctttagttggtgcatactacatctcctagaacgatgtgcttgtctta

SEQ ID NO: 34769 - DNA, 76 bp, Chlorella protothecoides
agcgacatatcttcgactcgcatatgtcgcacattgctgacctctggcctttttacatgagcaacagaattggtga

SEQ ID NO: 34770 - DNA, 67 bp, Chlorella protothecoides
cacagtgcccgcccctgtggggcctgtccttgcacacactccacaacccaatcaccactcactggtg

SEQ ID NO: 34771 - DNA, 64 bp, Chlorella protothecoides
tgcctgggcgcaggcgcgtatgagctcctccgtcagctccatcatgccatggtagtcggtgtag

SEQ ID NO: 34772 - DNA, 120 bp, Chlorella protothecoides
ggtgggcgggacacggtggggggctggctgctgggcacgcccggatcctctgatatcccctcaggagctcactgttgaggtttgggggcggaggtagtggaggatgctggacttgcggcg

SEQ ID NO: 34773 - DNA, 61 bp, Chlorella protothecoides
agagttgggtactgggtggagggggggggttgaggctgcaccaccaaggcgggagtgaaag

SEQ ID NO: 34774 - DNA, 61 bp, Chlorella protothecoides
acagagggtttcggggtggcatcctgcctccccgggtgtctgtgcagactctgactggctt

SEQ ID NO: 34775 - DNA, 61 bp, Chlorella protothecoides
ccgggtgtctgtgcagactctgactggcttttccccccccccccccccccccacccccccc

SEQ ID NO: 34776 - DNA, 461 bp, Chlorella protothecoides
gggggggaagatgtgtgtgtgttcatgaaagttggggacgacgtggatagcgtgtaggaccatggctcatgaggttcacccttcccaaactccacctcattgctgcccggcacggaggagtcagcgggagacctcacacgccaaccccataccccaactaacaaacacacactcacggacccctcacaaaccccacctggaagttgaagttggggaccttgatcagggtgccgcgcacgacgtggaagctctctacgcacagcgcgagcgcggggcgcggcaactccggaccccggcgctttgccgccggctcgtcgcggttcttggcgtccagcggcgtcagcagcgcgttgccctccaacccatcggccgcgtcggcgtctgaggcgcggctgctgtcctccgcggggacatcctccggctccggcggcgggggcggggcgccacccagccgcgcccgc

SEQ ID NO: 34777 - DNA, 61 bp, Chlorella protothecoides
ctccccgccaatgacctcctcgacgccttgtccggaccgcaaaatcacggcgcggagggag

SEQ ID NO: 34778 - DNA, 61 bp, Chlorella protothecoides
tccagtcccttgttcatcagcgtggctggggcgacaggaaagaaacagggggtaggttttc

SEQ ID NO: 34779 - DNA, 127 bp, Chlorella protothecoides
tctgcgcagggatgggtcccacctgtgggccctcaggatgcttgaccaccaggccccttttccacctgcccaaaccccacccccccacacacaccctcagggacatggagagccggaaccacgacaa

SEQ ID NO: 34780 - DNA, 61 bp, Chlorella protothecoides
gttgtcatgtttagccttcacgtaactttgcgattgcccctctgttcgcggggcctaggca

SEQ ID NO: 34781 - DNA, 61 bp, Chlorella protothecoides
gacaggctggatctcggggtcagccccggcctcactggcggccggggaggcgccctgggag

SEQ ID NO: 34782 - DNA, 64 bp, Chlorella protothecoides
ggccaaccctcgccatgccactcatcacccaccaccccccttggagcaggtgggcctgggtctt

SEQ ID NO: 34783 - DNA, 64 bp, Chlorella protothecoides
gcccctggcccctttgtttcttctaacccgccctggtggcatttgtacctgcacaccaccacga

SEQ ID NO: 34784 - DNA, 143 bp, Chlorella protothecoides
tgcaactggtcaatcagagcagtgaggagatgagggacaggaagggcatatttgagggatgaactgcatcggcaactatactgcctgccgtgaaggtcgccaactccggggcatcaataaggaatccatacaccgggcctgca

SEQ ID NO: 34785 - DNA, 61 bp, Chlorella protothecoides
ccagtctggctgaagcttctgcgcaaagctaatcccttgcccagactctggggtgctttgg

SEQ ID NO: 34786 - DNA, 109 bp, Chlorella protothecoides
tcctgtgccggatcgacgagcaagaatggaccatgcttgcatccctgcccatattccgagtatatccactctggaacgctcagagtctgtgttcaagaggcttgagagt

SEQ ID NO: 34787 - DNA, 61 bp, Chlorella protothecoides
tatgtgggcatctttcgttgcatctcggatattattagcatctacctgcatgcagacttca

SEQ ID NO: 34788 - DNA, 77 bp, Chlorella protothecoides
gggcggcaggggttggggcgggtggggttggggcggggggggttgtaagcaggaggggagacgtcgaggtgattacg

SEQ ID NO: 34789 - DNA, 79 bp, Chlorella protothecoides
atgtatgcaagctctgttcgatcccctgttgtgaacattgcatcttggggaaaccagtgattaccaaggctggctacgt

SEQ ID NO: 34790 - DNA, 65 bp, Chlorella protothecoides
ttttggatgcaggccggctctgaggcatggtcatcgaggagaaccaagtcacaaacctcatggct

SEQ ID NO: 34791 - DNA, 77 bp, Chlorella protothecoides
ggcctcgcccggttgactgcacgcaacgggcgtttggcagggggtgtgtgtttggcagggggggtgtgacagggtgc

SEQ ID NO: 34792 - DNA, 61 bp, Chlorella protothecoides
gggattagggggaggtcatgagtggcagggtgcaagtggggtgctgccacagtttgtctcc

SEQ ID NO: 34793 - DNA, 79 bp, Chlorella protothecoides
cggctccctcctccggtgcaaggccccaatcgtaccacccctctccagcacctctcctcacccgtatgaagttctgcat

SEQ ID NO: 34794 - DNA, 114 bp, Chlorella protothecoides
gtgggtttgcactggccgtgtccactgccacgcaggggacacccctgtccaagtagagccacaaagagcgccgcccagtgcccgtccgacagtcgcacacccaccgccctcctc

SEQ ID NO: 34795 - DNA, 420 bp, Chlorella protothecoides
  modified_base (84)..(347): a, c, t, g, unknown or other
cagagtatgccgtacgctgtgcgcaatgtgacccttccaccatacaccggatttttcaacaatgggtacatgcttgctggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttattgatacacgagtaatcatttactggggagcactctgcgtgatcgcgacgccaggggcactgccgcaa

SEQ ID NO: 34796 - DNA, 73 bp, Chlorella protothecoides
aaggaacaagcgccctctccacctgcacttacgcggcactctcgcacgcaccgcatggccgaggaccatgtcg

SEQ ID NO: 34797 - DNA, 135 bp, Chlorella protothecoides
ccatgcagggggtggcagcaccctacaggggtcggcggggctggccggggttgttgcagcaagggttttctccagtaaggtgcactgtccccgacgggagcattccatttgagcccgtgtttcaagatccattac

SEQ ID NO: 34798 - DNA, 685 bp, Chlorella protothecoides
  modified_base (138)..(396): a, c, t, g, unknown or other
actgtcctgaagccaaggaggcacttgctccagggaattctgctaccctgcacgcccctccacctccaaaaataacacggtcagccctcggcccctttcccagccacacacacaaacaacccacttcacacactcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggagggggggttggggtgtatgcatgtttcaggggctggaaagtccttgttgaggatgaacttgaggcaggggagggtcaggccgccggggccaaagattcgctgggcgtctggtgtggggctggataccagccggtatgcaccacagcaggcagaagttcgggtccaggctgggataaaacgccacggttacctcgccaggaaaccgctccccttctgaaatctgggtctctccagcccgcgatcactcccttccccctcctgacacctccttccaatcctcc

SEQ ID NO: 34799 - DNA, 2233 bp, Chlorella protothecoides
  modified_base (809)..(818): a, c, t, g, unknown or other
  modified_base (1733)..(1742): a, c, t, g, unknown or other
  modified_base (2131)..(2140): a, c, t, g, unknown or other
cggagcgcggcacgcgccgcgcgtcggcgccgggccccgccgccagcggctcccccgcggcgttgacggggaccaggaccacgtcgtcatccaggcggccgcccagcaggccgccggcgtccaccgcgttcaggccaaaggccaggaacacggcgccctggaccaggaggtagagggccatgcccatctgcgcgccggccagcgcgccccaggcccccgccgccagcatgaagccggagaaggccagctcgttgacgtagaggcggcaggagggcaggggcacgctggtccccgtggcgccggggcgcttgtcgctggagcccagcttggtggtcacaacccactcctgcgcgcgctgcaggtccaggatgccggtgaccaccgcccagagcttgaccgtgcccatcgcgttctcgaacagcacgtacaggatgctgtacacccagccgcgcggcgtgaaggctgccgtggtcagcgtgacgcagacggggaggtgcaccagcgcccacaccggcagcaccacctgtgattatgaaagggggggggcggggttttgatgaggggggggggggtatgcatgtggatgcagtgggagcatgggatggcaggggagggtgtgtgttttgagggggacctcaagaggggtgcccgggagtatccagtggacaggaacctgcttgtagatcccatggttgactgaggcaggggccacgcagcaccatcgtgctttctcatggtgacattcccccacccttcccactccaccccccctcttccgccacccacctccggggtgaacatggtgaggnnnnnnnnnnagggtgtatgcatgtggatgcagtgggagcgtgggatggcaggggaggctgtgtgttttgagggtgacttcaagaggggtgcccgggagtgtccagtggacaggaacctgctcgtagatcccatggttgactgaggcaggggccaggcagcaccgccgtgctttctcaaggtgacatccccccacccttcccacccctcttccccacccacctccggggtgaacatggtgaggggcaccagggtgcagaagaagccgagggagacaaagtgagtggcgcacttgcgcacgccaaagtacatgaagatgagctccagcttgcgtatgaggggcagcttggaggcccagatgtccttgctggccttgctccagagctggatggggccgcaggtccagcggtgctgctgcttgcggtaggcgaagaagctggcgggcagctcgttcaggcaggtgacgttgtccaggaagatggccttccagccgcgcacgtaggcgcgcagggagaggtccatgtcctccaccgtggtgcgcgaattccagccgccgctggtctcgatgcaggcgcagcgccagacgccggcggtgccgttgaagttgaagaaggaccccgcggcgctgtgcgtgtactgctcgcacttcatgtggtagttcagggacacctcctgcgccttggtcaggtagctctcctgcgggttggtgaacacccagcgggactggacgtacccgacctgcgcgaggggggggggtgagagaggagggaatgagtgatgagcagggggccaggggaatgggatggtgggactgctccctgagggcaaccgacaccacatggctcagctgacggcagggtttgggttggcagggggagcctcaccacaatcaccggtgcacatgggtgagggacagggcggatgannnnnnnnnnagagcctcatcacaatcaccagtgcacatgggtgagggacagggcggatgacacaccgccagcaacgcagtcctccaactcacgctggggttgccttcgaggtaggggatggtctggtaaaggaagccgggctcgggcttgaagtcggcgtcaaagaccgccacatacaggtagccctgcttgatcaagaggtccatgccctgcgtggatggaggatgggaggagggtcttgacacaaacattgggcgggagagaggctggtttgcaggctgcagggagggaggacgagaaggtcggcaggttgggccattcgggggcccaaactcagcctgagcactgcaaggagcactcgctcctcagacctcacctctcccccacctccccccccnnnnnnnnnntgcaggttgggccattcggggcccaaactcagcctgagcactgcaaagagcactcgctccacagacctcccctctcccccacctccccccccc

SEQ ID NO: 34800 - DNA, 61 bp, Chlorella protothecoides
attgtgaagggcaccagagctgtcgatcttctccattttcgcgagatcgaggtggcggagg

SEQ ID NO: 34801 - DNA, 147 bp, Chlorella protothecoides
ggaggcagtggggatgggtgcagcgctctgcaactcagagaaaacagtcaaggtgcactgcgagtaaaacattgctcaattcgcatcctgcttgatgcccaccagggtggccaatcgggtccaggcgctgcacgactgcggcagtgc

SEQ ID NO: 34802 - DNA, 77 bp, Chlorella protothecoides
caagctacttgagctcctgcgatctgatgcaccctgccttgctgcacaattagagctgaaatggaggtgctgaggag

SEQ ID NO: 34803 - DNA, 99 bp, Chlorella protothecoides
tgcggtcgcaagtgtacttacggaggaggaggaaatcatggacgcacaacgacctggggtgctccgcccccggctcccaagccctctcccggcccactg

SEQ ID NO: 34804 - DNA, 65 bp, Chlorella protothecoides
atctagattacaagccagacgacctggcatgggggttgaaaacacacggtgacccaggccaaagc

SEQ ID NO: 34805 - DNA, 73 bp, Chlorella protothecoides
gcctgcttcggatgtcttcagggaacgtcctgcttcggatgtcttcagggagcgccccgcctctgacgtcttc

SEQ ID NO: 34806 - DNA, 79 bp, Chlorella protothecoides
gcgcagcgggtgaaagggtgtgactgcggcatttgaagatctggtgtcgaagtgggaccatgtaccaacacgaaccgtc

SEQ ID NO: 34807 - DNA, 75 bp, Chlorella protothecoides
tcgcggcatgtggaatgcgctggtgatcacggccaggcatctgtagcggcaggggtggaaagggtgccatatgcc

SEQ ID NO: 34808 - DNA, 71 bp, Chlorella protothecoides
cgagcgcgggccggcacgcaggatcactggctgggggggtggggttgggcgcgagatcggaggttgtcctc

SEQ ID NO: 34809 - DNA, 76 bp, Chlorella protothecoides
cgcgctggattgcgccgggcggccgcgcggtccatacgccgatgcatgggccgacccagccgccgccgacgcatcg

SEQ ID NO: 34810 - DNA, 70 bp, Chlorella protothecoides
gacgcactttccagtggccgcgtggaaggcgtggacggctccccccgcgccggcggcgcacaccaccccc

SEQ ID NO: 34811 - DNA, 61 bp, Chlorella protothecoides
cttggagaagagggccctgtgtgtttgggtgttggcttgtgcttgattcacacgtgcttga

SEQ ID NO: 34812 - DNA, 66 bp, Chlorella protothecoides
ccgctcctacgtgtttcttgctgctgtaacttggtcgacttacactcggtgcaccatgttgaagca

SEQ ID NO: 34813 - DNA, 61 bp, Chlorella protothecoides
cttgggaaggccagtgtggcaggggataggggtccggagactgccacctcccaaacacatg

SEQ ID NO: 34814 - DNA, 61 bp, Chlorella protothecoides
ctcttgaccaccaggatcacagtcagtcccacccttccacacccaccgccaccggcgtgcc

SEQ ID NO: 34815 - DNA, 76 bp, Chlorella protothecoides
ccagccacacgatggcctgagcgcgacgttcggcccctccagtggtccccccatcattgcaaggcggagagctggg

SEQ ID NO: 34816 - DNA, 78 bp, Chlorella protothecoides
tcagggagcctcaacaaggaacgatggcctgaccatctcgtggaaacacgacagcctacctttgaagcggcatcggcg

SEQ ID NO: 34817 - DNA, 174 bp, Chlorella protothecoides
gctgatgaggctggtattgttcaggatgaagacgtgctcgatggcaactgtcggagtctcagccaacatgatcctccgcagcgagttggccacctgtgcacggaagtgtgcggcatcagcagcaagtgaacaagaggactgagaacatggggctggaaacccatggctgtgagc

SEQ ID NO: 34818 - DNA, 112 bp, Chlorella protothecoides
gggggggggagcagagccccaacctgggcatgtcgggaggcacgagggcaggctcggatcccagatcgctgcctcaattcctctcaccgtcacgcaggcatcgcaggaggga

SEQ ID NO: 34819 - DNA, 105 bp, Chlorella protothecoides
atgtatggagcaggcgagcatgcccgctgtcgagtcttgagtgttcatggagttaatgtctagagtggggggcgcttctgaaagcccggacttcaggaatcataa

SEQ ID NO: 34820 - DNA, 165 bp, Chlorella protothecoides
ttcagcgttctgattgaggaggcacttgatgctgcttacgcgagcgggcccaacccaccagctggctgcatgagctttagccccctactcaacacaaacagaatccaggccccccgcctctcccccctcaacactcaaccattacctgcatcaggcttcaggttc

SEQ ID NO: 34821 - DNA, 93 bp, Chlorella protothecoides
gcctcaccaccctcggccagctgccggccaacccattccaagccctgtcctcccctcaacccacctctcaccccttctttaatgcccagttca

SEQ ID NO: 34822 - DNA, 112 bp, Chlorella protothecoides
tggcgtgccctgccatgtcggcctccagcaacgcctcgccacccgggccccacagcctatgcgccgtctcgtctgcgagcgtgtgctgcccgctcagccccagccaggaggg

SEQ ID NO: 34823 - DNA, 1977 bp, Chlorella protothecoides
  modified_base (1231)..(1240): a, c, t, g, unknown or other
tgaagaaggtgcggcgccgcggcgaggagggacccggcgggcccgggcgcgaggcctttgactcggccggcgcggcgcggcggcggggcaaggcccccgccgtcgagctgcgtgggaagaagaaggcgcgggccgttgccgcggcgaggcgcgccggcggggcgggggcgaatggtgacgcccgcacggggccggagcgtgagtgaatggactccgtctctgggcagggacgcgctgggtgtgtgcacccggctgcgggccagcactttcatgcccctcccgcgtgccccaacccctcctctcccagacctgccgtcgctcgagcacaccacgcctgctggtgtcagatccgtgcctccctggcgcaccccgtcaccatcatccatcctcatcatttctgcccactcccgcccggaaagggcgtcgcacgatcaccttggccccatgctatatcctcccttgacgcacgcctgtggcccacatttcgttccatgaccatgactgtaggagacctgaccttgactgtaagatcttagggaaatcagggacggggtggggtgggagcccggccgtgggaggtgtttctattgagcaggagggcccccgctgcatggtgaagttcattcgtgcgcggcagggcctggtgtgatctggttgggctcagtactcgtgcccgggcaggctgcacatcgcaaaagtcatccttggctctgattatcaaaccgctggtatcaaaaccagatctaatacgccaggagtgtcaacacttgttggccaccagctgcggtgcctttgcgacactcaatggcccgcaagagcagccgctgcgatagaaagcgacacactctgacgctgtgaagcttattttggaacacaaaagtattcatccaggacccagaagcccatctagcgatccacatctcgggagagagggatactgatggcgttctctttcaacagcacgcctgcctctgtgagctcggttgggggagtggagggacctccacactctcaatgtgtcggtagagtcggctgacgaacgtgatcgagatctcaccctgcccgaaaccccgaccgcagaccaccgccttcagtttcgggggaggggctcccgtgacccagcgaacagggtcggcccccctctttgggggagcctcctctggcgcagcagccactcccagtgagtgctgggagctgaaattctgcgctctgactcctaccgcgattacgnnnnnnnnnnacccctctttgggggagcctcatctggcgcagcagtcactcccagtgagtgctgggagctgaagttctgcgctctgactcctaccgcgattacgtgaccacctgcgctcccaaaaccagcagtctccacccatccccgctcgcaggtctgtttggcgcagccccctccccagccacccccggcgggggcttctcctttggcttcggagcggcctccacccccgctgccgcgacgggtaccggggcgacttctgcgcccctgtttggggcgggggttggcggcacgttcggcgccagcagcacgccgtcgctgttcggcgccagcagcacgccgtcgctgttcggcgccagcagcacgccctcgctgttcggcgccagcagcacgccctcgctgttcggcgccggcgcaccacctcccaccgcctttggcggcgcgtccgcggggacgctgtccttgttcggcgccggagctcaacagcagcagcagcagcagcaggcggtgccctacgcgacccccgacctcggcgcggtgcgtgagctggaggccttgcgcgacgctttcctgcccggcacctcccgctcccgcttccagcacctgtttttgaacgtggtggaggaccccgcggcccgcgtccggcccacgggcgtggacgagctggcgtggcgcgccgcgctgcgtgccgcgggcggccccgacaaccccgaccacctctggcccgtggtcgcggcgggggggcg

SEQ ID NO: 34824 - DNA, 80 bp, Chlorella protothecoides
tctggaggtgtgggagccatgctccgccacctccgcccctctgaatctcatggccacatcccaccctcatgactcaccgt

SEQ ID NO: 34825 - DNA, 120 bp, Chlorella protothecoides
gtctgggtgcagttattggtgcaggtgcatgccttgggatcgtatctcccagcaatggtgagtgtgagccacggggcgtccctcccgctcaatgtctcaccggcagaatgctgggccgct

SEQ ID NO: 34826 - DNA, 78 bp, Chlorella protothecoides
ggtgagggggaggcggggagggtgcaacgccgggggggcctggactctggggaagaggtcaaaacaggcgggaggctg

SEQ ID NO: 34827 - DNA, 80 bp, Chlorella protothecoides
cagtacgcctcatccagcgtgggaccgatgactcggtgcaggacgtccatgcgcaccatgggcaccatgatctccacaaa

SEQ ID NO: 34828 - DNA, 105 bp, Chlorella protothecoides
gcgactcctaatcacgacctgtacatacattattccccccacaggaggctagtgcggagcgctctgcgctggagcttgttgctgcggagcaggcgctgcctgcat

SEQ ID NO: 34829 - DNA, 130 bp, Chlorella protothecoides
aaggacgagaacctggcgctgcgggtgcggtgggcgggggtcccgacggttggacagataatcttgcgtgggagtattcgccccagagtcccctgccttaacaccgacccttatgtctgcaggagaaagt

SEQ ID NO: 34830 - DNA, 134 bp, Chlorella protothecoides
gggtggagacgggggcggcgggaaaggcggcggcggggatggagagctgggcagtgaagggctctgatgcgagggttgaggaggtcgggaaggcgctgggttaggaggtgggctggacttctgatgaggtgggg

SEQ ID NO: 34831 - DNA, 61 bp, Chlorella protothecoides
aaggggcgttttgttgtcttcatggccgggatgagtggcgcactgtagtgttccggcctta

SEQ ID NO: 34832 - DNA, 295 bp, Chlorella protothecoides
ggtccatgggtacaaggttgttgcacctgcgcgggttggtgtgtgcatcacggctgctggttgtgcgacgcatgttagcaccagggaatgagcggctcccttggtgcagatgggtctccctggcctgaaccagcctccaacctgtcaacaaccatccgccaacttggtacacaggtcttgaaacaccctcaaaccctgctctcagtcccaggccatgccacggcagccacctgaacagggtgacaatcacggcgcctcgagcagcagatttgtgccccttcagctgatcaaaggg

SEQ ID NO: 34833 - DNA, 70 bp, Chlorella protothecoides
gtagacgtgcgcgcccgcgaaccagggtctgccggccggcggccccccggccgcgtcgtcgccgtccagc

SEQ ID NO: 34834 - DNA, 91 bp, Chlorella protothecoides
aggtggccacctgctgtattgcattgtagtatggaaaacgttaaaacgttgagggatggtgaatgaatcattttgaggcaccggtcatgcc

SEQ ID NO: 34835 - DNA, 120 bp, Chlorella protothecoides
gcttgggcgaccaccggggtccgtggcgtgatgccccggaccaagggtgtgacgtgtgatggcacggctgaggcagacgccgtcctggttgaaatgaggggggagacgagcaagcgctct

SEQ ID NO: 34836 - DNA, 61 bp, Chlorella protothecoides
ggagatgccgtggttgcagggggaggacgggccactggagcgccgggtctccacgacattc

SEQ ID NO: 34837 - DNA, 61 bp, Chlorella protothecoides
cagcgcggtggagacatcggagggcacctcacccttgccaatcctcttgttgagttccacc

SEQ ID NO: 34838 - DNA, 158 bp, Chlorella protothecoides
tactgttggtgttcgtggtcaaagcattcccttttggccgcttatacagttgcatccctggcgacgctctgatctgcaccacttcaccctttgcttgctattgatactcccaagcagactatcatccgatacaatcccatcctacaccatcaggtcgg

SEQ ID NO: 34839 - DNA, 63 bp, Chlorella protothecoides
ccgtccgcagcagtgctctctgcaagtgtgggtggggaggtgtgtgtgtgtgtgtgtgtgtgt

SEQ ID NO: 34840 - DNA, 77 bp, Chlorella protothecoides
gtagagatgatggaagggacacaaggggagttttttgttggagagtgatggcacagagagaacatgaccaggctttg

SEQ ID NO: 34841 - DNA, 125 bp, Chlorella protothecoides
catctccatggcggtgagtggtggcaaatcgcatgttcttttgtggggggttgacgggatgttcagtgggtgggacacccctttttgccgccctgcgcccagctcatgccctttgccacgctccg

SEQ ID NO: 34842 - DNA, 68 bp, Chlorella protothecoides
ctgttgcctgcggggggagccgatccttcaggccgctccctcacgccgacagaacgatgcacacttct

SEQ ID NO: 34843 - DNA, 87 bp, Chlorella protothecoides
cagccccatctgcaccgtgccgtgagttttgttggttctgttgcagggtgggggggaagaaagggggacccagtgtccactggtacg

SEQ ID NO: 34844 - DNA, 61 bp, Chlorella protothecoides
gggtcctgtaaccttgagcgtgatgtgctgacccgcgggcagccccagctgctgatcggca

SEQ ID NO: 34845 - DNA, 93 bp, Chlorella protothecoides
cggcctcgccatccccggcagtcagccccgaatcctccccctctccaacggccagccccaaggcatccactcccactgcctcgactcccgcca

SEQ ID NO: 34846 - DNA, 79 bp, Chlorella protothecoides
acatccacgacggtggggatatgatggacaggttgctttcgggagggtgagggcagagcacagaaggtatacttcagtg

SEQ ID NO: 34847 - DNA, 70 bp, Chlorella protothecoides
ctccgccccaacccctcgccccaacccccccaaacccctccctctcaatccactcactgctgcacgccat

SEQ ID NO: 34848 - DNA, 61 bp, Chlorella protothecoides
gtcacctttttgtaggaaaatgctgtccagaaggccagggaagatcctggcctgcgcttct

SEQ ID NO: 34849 - DNA, 226 bp, Chlorella protothecoides
ggagcttgcgtgaagggtctgggcagattgtgatggggagcagcagaagtgggtgtatggcggggcagcgctaggccctcagacattccagcacagaccaaggcatccgttccccccatgagtgaagaaaaagggcaccattccctcacgtggaaggcacgaggaaggtgtaaaggtgggtggcattgggcgcgatgggggtggaggcggggtcgctggcgttgga

SEQ ID NO: 34850 - DNA, 65 bp, Chlorella protothecoides
agggtagaggcctgtgatccctgtgcctgctttgagcccagccccctcagtacctttcgatgcca

SEQ ID NO: 34851 - DNA, 77 bp, Chlorella protothecoides
gctgagcccggagcggtggggcctgggagaatgtcgaaaggttttttcatgccctgtctgggtcgtggaggctggaa

SEQ ID NO: 34852 - DNA, 444 bp, Chlorella protothecoides
  modified_base (120)..(343): a, c, t, g, unknown or other
ctgccccaccctaccaaaacataacccccctgtgcctcatgtaggaagacgagccccgagtgtgccgcgccgtgttcataggcaagaatctggaccgagaggctctggacaagggcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcccaggctagcagaagtggaagtaacaattgttgaatggcacgcatgtgttcagtttggtcgggtgctctagcgcaacctgtgggctgcccggtccgg

SEQ ID NO: 34853 - DNA, 72 bp, Chlorella protothecoides
caatgcacccacacattcaggcagacccctggcccttcacaccgagtgctcctctcatgggacccccccccc

SEQ ID NO: 34854 - DNA, 71 bp, Chlorella protothecoides
agagatggtatatgagtggggggtggttggggtgaaggcctgggagtgggaggcgatctcgaggccggagc

SEQ ID NO: 34855 - DNA, 61 bp, Chlorella protothecoides
atgaatggtaccctgggaagggctatccgcacaggtcatgcactgctcgatgatactgaca

SEQ ID NO: 34856 - DNA, 68 bp, Chlorella protothecoides
cctgccggctgcgcagcgcacaatcaacctgtgtgagagcagcacaattgcacctggaggttggaggc

SEQ ID NO: 34857 - DNA, 79 bp, Chlorella protothecoides
ctaaccctaacctaaccctaaccctaacccacattttcaggacgaggatgaggtcggcaccccaggcgcccagctcgct

SEQ ID NO: 34858 - DNA, 79 bp, Chlorella protothecoides
gaggtcggcaccccaggcgcccagctcgctgagtgctgcgggctagtcaggtccctccacagcacccgctgcctctggc

SEQ ID NO: 34859 - DNA, 116 bp, Chlorella protothecoides
cgtgcctgtgcagccaaattgataataacctataacataacccgaaggcatttgcagattgacaatcgacggaggttggctgggttggctggtgacagttggggagtgcactgcca

SEQ ID NO: 34860 - DNA, 74 bp, Chlorella protothecoides
gggtgtcacagaggtggacagggcggcgggtgtcacagaggtggacaaggcggcgggtgtcacagaggtggaca

SEQ ID NO: 34861 - DNA, 134 bp, Chlorella protothecoides
aggccggcggcgtggaggcccgggacgcagcggccggcggtgcgcctgcgggggcgggcgccaagccggagggcctggatgtggaccccgatctggaggcctacctgcaggcacgtggcggtggggatggcgag

SEQ ID NO: 34862 - DNA, 1136 bp, Chlorella protothecoides
  modified_base (728)..(737): a, c, t, g, unknown or other
gggcggtggcgcggcgggtgggttggccgcggtgacgctgggcgccgaccgccgcgtgctggcgctggcgccgggcgacgcgcggggcgtgagccatgtggtggccgtggcgccgcagggcctggagcccgcggacgtgctggaaagcacggcggccgtgctgctgcgcctggaggacgggggcgcggcggaggcctggttccgcgcgctctgcgcatcgcagcaggcgctgcgcgagctgacgggcgcgggcggcgccacggtgccggcgccggagtgggacgacgcctcctccaccgtgtccggggaggatacgatgacagcgtcgcacgacgcatccctgacatcgatgcccgaggatgcgccgccggccgcgcagccggcgcccaccaccctgctccaggtggacgccgagctgggcgagctggcgctgtttgtggccgggcgcacgccgctcgtctggtggccgccggaggtgagaggccggcggatggattctgggagggcgagcgcgttcctggggctggcaacggtgtggtggtgcattgggatctcacccccgtgcacgacgtcgttgggtgcaaccgaaagcggccagcatagatcctcaacaccaggcccacacgagtccacacacccctcctcaaccagctccctccaccactccccacaggaggaggacccggtgagccccaggacggcggcggcgcgcgccaaggcaggcttcnnnnnnnnnnattggctgcaactggaagcgaccagcatagatcctcaacaccacgcccacacgagtccacacaccccttctcaactagctccctccaccactccccacaggacgaggacccggtgagccccagaacggcggcggcgcgcgccaaggcaggcttccctgcgtttgtcccagaccacgtcccccacctggccggggagagccacatcgtggtggtgcgggccacggggggcacgctgggcttcgtctacggcgtgccgggcatgtcggtgcacaccgtgctggaggcgctggaggtggaggacctgctggtggggccgcgaagcccacgccagcgctacctggcctgcagcggcgcggaagtcggtgcgactgtaggggggggaggggggtgggggggaag

SEQ ID NO: 34863 - DNA, 125 bp, Chlorella protothecoides
ggtttcactgttggaggctcttggaggggggcagcacttgcgctctgtgcagccgcaaccagggaggcagatgcagggcatgcgtgctgcaggtggggcaacgatgctctccaagaatgtgccgc

SEQ ID NO: 34864 - DNA, 79 bp, Chlorella protothecoides
actgtgttctgagaatcgaaaccagccatcgtaatccgccagggtgttgaggggtctaagcttgccagctcacattccc

SEQ ID NO: 34865 - DNA, 99 bp, Chlorella protothecoides
ttgaaccagggctgcagaagggttttggggtgcctttcaatataatatcaccattacatgtctctggaacccccgatgaccgcctcggagacgcaccat

SEQ ID NO: 34866 - DNA, 61 bp, Chlorella protothecoides
tccgctgggaatcgctgtccgatgactgggactcctctcccagagagtggagctcatcatc

SEQ ID NO: 34867 - DNA, 61 bp, Chlorella protothecoides
gccgaggggcggccagctctggtcccatggacagcccccgtacctggtgcccgacatcaaa

SEQ ID NO: 34868 - DNA, 121 bp, Chlorella protothecoides
tgcttgggctggaggctaccaccgtcttccatggccagatgctcataattctccagctcccacagccctgagatcaggctgttgaggtgccgcataaaacccacaccaaaggcgtcacctg

SEQ ID NO: 34869 - DNA, 61 bp, Chlorella protothecoides
ctccgagccggtgaagaatgccaacaagaacaacgcggtgcacgccatcgtgttcgaggcg

SEQ ID NO: 34870 - DNA, 61 bp, Chlorella protothecoides
atggcgtggaactcctttgaagagcaggatatcgcgttggcgtgttcatccaccacggtgc

SEQ ID NO: 34871 - DNA, 61 bp, Chlorella protothecoides
aggggagacgctgcagtgccccagtggcaatgccaatggcaactgggccaagggcgttttt

SEQ ID NO: 34872 - DNA, 61 bp, Chlorella protothecoides
tctgccctcaactcagaggctggctgggagtctgacccgcctcaccgcatgccctctgctt

SEQ ID NO: 34873 - DNA, 74 bp, Chlorella protothecoides
cccaaggtactgcgaagggtgcaaagggtgcaggggctatgtttgggcattgttgggggcattgttgggggcat

SEQ ID NO: 34874 - DNA, 77 bp, Chlorella protothecoides
ttctcatattcccagccacgcctgtatcgatcctgccacccacactcctcacccgtcgcaggccgggcgcagcgctg

SEQ ID NO: 34875 - DNA, 67 bp, Chlorella protothecoides
ccaagcgtgaaactcaccctcctcgcaccaaaacgtaaaaatgtctcccctcttctgacaccaaacc

SEQ ID NO: 34876 - DNA, 74 bp, Chlorella protothecoides
gatgccatcaggtggaaggatgctgaggccatgagcgcacagcccaatcaaagctcgtcgcttgccgatactgc

SEQ ID NO: 34877 - DNA, 74 bp, Chlorella protothecoides
cagcaggcgggcctgggtggcgcgcagggtttctctggtcgtctgtgaaggggggggggggggggggggggggg

SEQ ID NO: 34878 - DNA, 78 bp, Chlorella protothecoides
gagcaggcgctctggcgccaggcccgctccgtgcaccgcctgcaccaaccggtccagcaggcgccgcagcaggccgtg

SEQ ID NO: 34879 - DNA, 131 bp, Chlorella protothecoides
tgggactgcaatgggaggtgaggttttgggtggtcgtggcagggaagcgaatcttttgaagagcagcgggctgtatgctttggtttgaggttttccaaccggcctaccacctgtacaccctgtctggctgg

SEQ ID NO: 34880 - DNA, 61 bp, Chlorella protothecoides
tgggcacaccgggctgcacgtgcgcgtgattgacctgaccctgggcatgatggcgggcccc

SEQ ID NO: 34881 - DNA, 74 bp, Chlorella protothecoides
ggagattgcctcaatgcacatgcacatgcatgcgcgaggatgacggacacaccccaggctcaccttggatgcct

SEQ ID NO: 34882 - DNA, 63 bp, Chlorella protothecoides
cctcgcagccgaggcggaggccctggcggccaaacaccccggcgcgtccctcagcgtggtcag

SEQ ID NO: 34883 - DNA, 67 bp, Chlorella protothecoides
gttttggctacatcctgcaacccacacgtgcacgtatataccttcacccctgcgctgtgatgctcat

SEQ ID NO: 34884 - DNA, 110 bp, Chlorella protothecoides
cgcacacgtctcctgctccaaaacaacagaaccccccccccccaaaaaaaaaacctgacaggtcgaagaggacgcgcatctgacccagggggttgagcacagggtcgtgc

SEQ ID NO: 34885 - DNA, 149 bp, Chlorella protothecoides
acagcctttgctgtccatgtccccatgtattaaaccttgccatatcctttccctctgattataactccgaagccctggggcgggttgacataccgccctgtgccctggcctgcatactgtgtagcaagtagccatactatagcttgttc

SEQ ID NO: 34886 - DNA, 75 bp, Chlorella protothecoides
cactgcgggagcatgctggctggaggctcaggggatgacattcctgcctcgctgcccaacctcccacctcagggc

SEQ ID NO: 34887 - DNA, 127 bp, Chlorella protothecoides
gccggggccgcccccgaggtccttgccaccaccgcctgatcgaccctgcaaccgccaacgtatctggctggcatccatgcgttaggcacttggtgaaattccaaggcatgtgcccaccactttgacc

SEQ ID NO: 34888 - DNA, 95 bp, Chlorella protothecoides
cgcagggtgcgacggcggccggcggctgtgcagacgacagcagggagcatgtcgaggaagcagacgaggtacccgagggaggaggacagatcccc

SEQ ID NO: 34889 - DNA, 79 bp, Chlorella protothecoides
tcgcgtcacgcgcagcacgctttccctgtcggccaatacgattcatttgtgaactgtcaataagtggcacatgcaatgc

SEQ ID NO: 34890 - DNA, 73 bp, Chlorella protothecoides
ttgcgcgaacagcacgtcgtgtgctgatcatcaacctgtcatccgcggcggcgaacctgcctcgcctgcgcca

SEQ ID NO: 34891 - DNA, 188 bp, Chlorella protothecoides
ctgaccctccgcatggcaccagtcccacactcccctttgaccccggaaatgctagaggatgtcgccatccagccagttatgtgcggccccatgcgaatgcaggcagactgggatggtgcctgggccaagcagactggccctggcgcacgggtccgaggggaacctggagcacccatctgcccccagct

SEQ ID NO: 34892 - DNA, 76 bp, Chlorella protothecoides
ttgtaccctgaaactccatctcagcaagcgcttgattctgcatgacgctatatagctccagtcatgtgtcttcaca

SEQ ID NO: 34893 - DNA, 61 bp, Chlorella protothecoides
ctgagaccccagccaccctgccgcctgcagcgcctgagataaatgctcaccactgctcctg

SEQ ID NO: 34894 - DNA, 107 bp, Chlorella protothecoides
gcgctcgacagggcgcccgtgcccatggagtcaggatactgctctagcaccgccattgtgaacttttatatatactatttctgaagcagatgccatggcagaggacg

SEQ ID NO: 34895 - DNA, 61 bp, Chlorella protothecoides
ttccgagtcggatcacccctattcattccttgtaacccaagcatccaggagtgtcatctga

SEQ ID NO: 34896 - DNA, 87 bp, Chlorella protothecoides
ccgggaagcgcctgcatgcatggatgcgagggcggggctgattgtgacgagggtcggttgatggctgttgtttggggccaacatcgg

SEQ ID NO: 34897 - DNA, 79 bp, Chlorella protothecoides
ctttgccctgcagaagctggaggtgaggggtggggttttgcaggtgtccaggcggcggggatgcggggaggatgcaagc

SEQ ID NO: 34898 - DNA, 61 bp, Chlorella protothecoides
aaatacaacatatcccagcctacagcaggatgctgcatctcaggcacccgactcacttgag

SEQ ID NO: 34899 - DNA, 63 bp, Chlorella protothecoides
cgcaagcggctgagcattgcagtggagctcattgcccggcccaagctcatttttgcagatgag

SEQ ID NO: 34900 - DNA, 75 bp, Chlorella protothecoides
gaagaaggacgcgtcttccacctcgatgccggggcgatccaactcctccacatgctcgatgcggtcctcggacat

SEQ ID NO: 34901 - DNA, 79 bp, Chlorella protothecoides
ttggctcctgaggctaattgttgaccgcggcatcgatcgccgcctgattggcagctatgtcagccgcgggtcggctcgt

SEQ ID NO: 34902 - DNA, 80 bp, Chlorella protothecoides
aaccggagggcagcctgggaggggagcatgagaggtggtctgatgcgagaggtgtgccagctccacgaggcatccagcgg

SEQ ID NO: 34903 - DNA, 115 bp, Chlorella protothecoides
gcaggcgtgagtacctcgcaacacgttacggttcgcattgacgtcactgcactgaatttgtgggctgtcactcgggaggcgttccgagaggaggatgcaatgaagcgatccagac

SEQ ID NO: 34904 - DNA, 139 bp, Chlorella protothecoides
gtcgtgaccagccgcccacagtggcacagccaaggtcatccccccctctgaccttgattgcctccatgaaacaccccgcaggaactggaaggaccggccgctggcggcgcagctcctccagcaccctttcctggcctcg

SEQ ID NO: 34905 - DNA, 79 bp, Chlorella protothecoides
aggattcattgtgctgcagtccccctcttgtcccccccatccccacccgcccacccctggcaggaccagtgtggaggac

SEQ ID NO: 34906 - DNA, 79 bp, Chlorella protothecoides
cttggttgcgctcccgcgatcgcaatgtttcgggttgtgctgtcccgcgtgtatctcttgttgtcacacgcacaagagc

SEQ ID NO: 34907 - DNA, 94 bp, Chlorella protothecoides
gctgtgctccctccagggtctggacaaccctgaccaggtgcaggcgaaggagggggtggggtgggggggggctgatgctggtgagggtggtatg

SEQ ID NO: 34908 - DNA, 62 bp, Chlorella protothecoides
agggcgtgggttcgaatcccacttctgacagatcttttgtgttttatcactcagtttaatgt

SEQ ID NO: 34909 - DNA, 125 bp, Chlorella protothecoides
gtacttgcacggcaagccccagcccaacactgaaaaggagaggaggggtgcctcagcgaccccggcctccaaggccatcctccagctgcagtcgtcccaacatcactcaccctttccaccacgcc

SEQ ID NO: 34910 - DNA, 72 bp, Chlorella protothecoides
accttacgctgtgcagagaatacgaatcaaccacctcagccgtggctccctgagaatgcaactggtgtctcc

SEQ ID NO: 34911 - DNA, 68 bp, Chlorella protothecoides
gaacctgcatgcaccaaagcagcacagcccttcccatcccgacagcacacacacacacacacacacac

SEQ ID NO: 34912 - DNA, 96 bp, Chlorella protothecoides
ctgtcacagagcacagcaatcagtggccagtacacacgtgcacgccccacctctcccaagagtggggggaggaggtggggcacgtcttcagagcag

SEQ ID NO: 34913 - DNA, 783 bp, Chlorella protothecoides
  modified_base (86)..(338): a, c, t, g, unknown or other
  modified_base (415)..(672): a, c, t, g, unknown or other
cgcccccactccaggcgcttgcgtggaggctgtcactttccacccccaacctttaggaccagaagtgtagacgtcctagcctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccccttgtgctcgtccacccctttggcccaccggatgttgagtacccctgcaaagatcctcctcccacactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgatgaggccagggattcagggggtttgctttggaggggcaaaaagggggatttcgggcacgtcgctgcgcagctgcgcagctgggcttgggtgcagggtggcacgcg

SEQ ID NO: 34914 - DNA, 82 bp, Chlorella protothecoides
acactagtcatccagaaagggcgctgctgcagcagccttgcgtcctgctcctgggtcctcagagggaatgtccactgcaggg

SEQ ID NO: 34915 - DNA, 90 bp, Chlorella protothecoides
gcactctccagtctgcaacttgactccccccttcccaagacccctcctcaagcagcctgctgcaacatcaccgccacagcgtaggctgcc

SEQ ID NO: 34916 - DNA, 119 bp, Chlorella protothecoides
tgttcatgttggatactgtgtgtgggggatcaacttggatgtcaagcccagcctgtggagcctgcatgcaatgaaacatggcgctgttgccctcgtggcacgccctcacacagccttcc

SEQ ID NO: 34917 - DNA, 145 bp, Chlorella protothecoides
gttggcaccggcttgtccgcaccaacactgtgatgagtgactgctcccgctcaatacaaagcagggcaatgtctgctcgcacaaggcgatgttcctcacgggggcttgtcagatgatgctgccatggtggtgcacaagcttccag

SEQ ID NO: 34918 - DNA, 150 bp, Chlorella protothecoides
gcggcggtgcggggaagggaggaggggtcggggttgtggggaatcgggggggggagtggcgcagaggcgaggacgtcgggggaggagaggcagggggggtggcacgtgcggggaggaatgggaggcggggagcgccttgcgccagcagga

SEQ ID NO: 34919 - DNA, 61 bp, Chlorella protothecoides
tcggcaccggcttcaggtcggggaggggggtggggggtgggaagtgatctttggatgaagt

SEQ ID NO: 34920 - DNA, 64 bp, Chlorella protothecoides
gtgccatccacatgcaaccaagatcagaccaattgtgggatcagcgtccatcctgcggccctga

SEQ ID NO: 34921 - DNA, 92 bp, Chlorella protothecoides
tggagagggacgagtgctcattgcttcgcacacccacagggtgcctaccccatgacaccacttcctccctacacctcgtcggtgtcttgcca

SEQ ID NO: 34922 - DNA, 72 bp, Chlorella protothecoides
ccgctgatccaccacgattcataccgtcatcccccccccccgcgctcatctcaccgactcggaatcgccgtg

SEQ ID NO: 34923 - DNA, 386 bp, Chlorella protothecoides
  modified_base (143)..(311): a, c, t, g, unknown or other
tgcgggcggtgtgtttggccgtcgtgccgcggggctcaagcaggctctgtccttctccagcacctgccgcgcgggccacgacgttgttgccaattgcgacggcgggcccctctccccgccctcccctcgccagggtgcacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcttcgcctttgggattgaagatcgggtcggcagccccgcgcgcatcagcctgcgccccgacccagcccgccc

SEQ ID NO: 34924 - DNA, 61 bp, Chlorella protothecoides
aaatttcgacacggtctgcgcaaggcattgggtggagatcttcgcagtctgcgcacagggg

SEQ ID NO: 34925 - DNA, 80 bp, Chlorella protothecoides
cgcacgcgcccgaggtgagggatctgtgggtttggggttatgagggggggtgaaacctgtctctctggctttccctgcaa

SEQ ID NO: 34926 - DNA, 116 bp, Chlorella protothecoides
tctttcccgacggcccccgccaggtgtccgcggaggagactttcggtaaggagcccggaagaggagaggggggcgatctaccaataaaatatcagtgccaggcctccctggggtca

SEQ ID NO: 34927 - DNA, 80 bp, Chlorella protothecoides
gattcgcgtgctgcgtgagagtggccatgggtccgggaccatccttcctcaccacacactgctcttgatgggacgatggc

SEQ ID NO: 34928 - DNA, 65 bp, Chlorella protothecoides
ggtggagatggtgagcagggccttggatgtgaagatgtccagtgcacacatgcatgcatgcatgc

SEQ ID NO: 34929 - DNA, 9303 bp, Chlorella protothecoides
  modified_base (1324)..(1434): a, c, t, g, unknown or other
  modified_base (3526)..(3535): a, c, t, g, unknown or other
  modified_base (4480)..(4489): a, c, t, g, unknown or other
  modified_base (5053)..(5204): a, c, t, g, unknown or other
  modified_base (5902)..(5911): a, c, t, g, unknown or other
  modified_base (6976)..(6985): a, c, t, g, unknown or other
  modified_base (7710)..(7719): a, c, t, g, unknown or other
  modified_base (8179)..(8188): a, c, t, g, unknown or other
  modified_base (8429)..(8438): a, c, t, g, unknown or other
  modified_base (8753)..(8762): a, c, t, g, unknown or other
  modified_base (9008)..(9017): a, c, t, g, unknown or other
tggaggaggggaggggcttggtggagatggtggaggtggaggggggcttggtggagatggtggaggcgatgcgggagggggactgggtggagatggcggaggcgatgcgggagggggactgggtggaggcggtgatggtggtgggctggctggcgatgaagttggaggggggctgggtggaggcggtgatggaggggagctggatggaggcggtgatggaggtgggctggatggaggaggaatgttgggtatgggatggggccttgggtttggcagaggggacggggacggtctggccggcgtggcaggggacagcttgagaggagatggcggcggtatcctggacgccggaattggggatttcttggcaggtggagggtatgccttcttggccggtgatggtggtgacttcttgccgatcggcggcaaatgtctgctgggtggggctggtgacttcttgaagggcgtcggcggcgtcggcgacttcctggcaggcgggggcgggaagccaaggacccatgcatacttgcagaactcgagcaggctgcagaagttcaatactttgcgagttccagttctgttgaagcagcggttgctcgtgccatcattgttgtttccccagttggcggtacccacgttggagttgcctgcaaaggcagcattgtcttatgggtggatacattctcatcttagcatgcatcagctgtgcacatcttggataggtcctcacataccaccccgtgctcaccgatgttatcattcccaacgtttctggtgccaaagttgttcttgcccctgttgccagagccgatgttgccatcgctgtctgctgagcacgccttttgtcctggcttcaggcactccacggcggtcaggatctccgtggagcgatccgacaggatctcaaagttgctcacgcgaatagctgacatggagagccccatgatgtggagggttgaggtgcggatggaccccgccttgctgaagcccttatgcctgctcgtaaggggaaagggggcggaggggtgcatctactgggatttgtacagtctggtgcacttgagaggctatgcctgcctcaggatggcttttagtggcctggccgctgatttgcaagcaccggctgggatgtcacaaccccactcatgctgcccacctgcagatggcgtcggcgtcgtcaactgtcatgaggtacacatgggctcccagactgcaaggaggcgagcatgtgcggcatgaggtcagagaattggcgtacagtgccttactgaaaggcacaatcgaaggctctgagtttgtgcatgtccgaggaaagcagggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccgtgcggacaggaacgttgcccgtgcagcacacaattccccgtgtgaacacagctctcagctcacattgcactcgggagcgcgatgaatgtggagctgcatggagcctgcactcagaagggaggtagggggaagtaagcgaagccatggtgtagcagcagggatgatacgggatcgtcatcggcctgagtgcactgggactcaccgcgaaggcacaactggcgagcagcagcaacagtgcagccaagacggcaggattcctggccgtcgctggcatcctgcacctctcagcaacttctttcttccgcctgtacgagttacgtgtgcggtcggagatggatgcaccggtttaaatgaactgcacgctcagataaatactgcgttctggtgaaactcgacatgtaatacggggaacccttgccagttcactggcttccctagagctgtgcgttgccagcttggacctgggcggcttcgagagattccgcggctcgagtccggagtgtgccttccggtccaggacaacaagcttgccagcgtaatagaagcgtcagcctgtccgaactaaactaaacacttgcaaaggccctttatatctctggtgcatttttgtgccctcttctcacctcattcctcgcacccaataatggtttccgcaatggcccttaccggacgtggcagccctcacccccggctgcacataaactgcgggcaacgtcgtgcagaatttcaaatgcttctgctgagtataatcgttcccataatactctattgagcgtcaccagccatattcgactgcctgtctcactttgaaagcattagccgaacatcatttcccagcttccgttcagccaggcctcgccgggctccctgtttccagcagatttacccaaaacatcatacagggcctgtctcgtgtgattaaccggagggctgtattgccccattatgcttgcatgatcaagcacgagcatggacacaaaggaatgttcagaggcttgctgcatatgggctgcagcctcctccacacctttccacaagtcgaagaagtcttcacccctaagaggagaaaagcgtgtgaagccaggatatctaactttgccaagtcctggccccgtagaagcgggtcccagccactttgctgcctgtccatgcttggaccttagcaatccattgcaagaggattgtcctaagagtcgggaaaggggacagcagtctcaatggccgcctggtgtttggtccaccaatccatgcccatcaggatatcctgctcccactttcatcttgaggccctaacttgcacaggcagaacagcgtcctggacacacaatggtatcgaatcctggacctgacgcagcttgacgtcctgaccgccacacgcctttacaactcgtccggcctgtgagactagccggggcccgatacattgagcaagagtgcctgaaatgagactggcatttgagctagtgtcaaccaaacagtccactggcatgtcacccactggaccctggagtagccacagggaaccagcgtcaaagtgcaggaggtctgcgagcactcgggtcgaggtgcctggaggaatcgccgagggctcaaggcgctccagggtctggggtgctgctacaggtcgacgttgctctagcggtatcgctgggccctccccgatgaagcgcccgtctgcctcgcactgggcgcaaagccccctatcgaagcactctcctccggtgcgtctgcgctcgcgctggagccggcgccaaccggcgcggcggctggcagaccggtgggccgggtggggcccgtcgctgccgcgctggccgccgcggtgccagaaggtgcacgccggcggtgcgctgccgtggctggacgtcggggtgcactgctggtcggggtacgatgcgccgctgttgtagagcggcaccgtggcggcatggcagtcgtggcggttgatgcggtggtccgggtcgttcaaaatcgtctcctggtaccactcggcgagagtggtcggaacgtccgtggtcctgatggccaggagggaggagcgcttgaggccggcctgggcgcgatggcaccactcattctccgtgccgtgnnnnnnnnnnggtctcgcgaagcccgtccagctcgcattgcactatgtgggccagagattctcccacaaaccctgttgctagggcgtcgagggcctcgggcagggtcgtgtgaaggtgtccctcctgaaaccaccagtaggcggcgggcaccgtgagggctcctctcaggaggacaggggtctgcgcaggagagagactccgcgagaatgcaagtccgcagctgcagagcccagtccacgaagtctctggcgattgtatcacccttgtagcattgtggattgcgccgcagtcgaggcaaaggagttcccatgtctggatctgctaacaaggcgggagggatgagcaatggtgtcgtcccattcgaccttggggcaggcacagcgacgattgtcggggaggtcgccgtggtttgaacgctgtgaagggcggcagccttttggggcagcgccgcagggacacaggattcccactccttcatcttctgctccagaattgtgatgcgtgccagagctgtctccaacttctccgcaaggagtcgacaggcctcggtaggctagcttgccgcatagttctgtcgtcttatcgtgggcagacgcctgcacgtcctgtacggcggatgacattggatcggccgacaccggcgtgcgcacaacggcttcacgaagtaggactgcgcgctgtgcgcgagcgaggtcctagccagctctcttggctgctgtcagggtggaaatgggcctcgggtcacaagatctgaaatagctgtgtcagagactgagtgtcttccgaaaccacatgtagtgggagtaggagtctgctccccaaaattgggtgagattttgcttgctcggagtcccactccactgcaaaatctaccaagactctcccacaagccctgtcgcttgccttatgtaaaccttagatgagccccaatctgccagcgagaccaaacacgannnnnnnnnntagatgcagggcaaagagaagcagatctgagcagcaggtgcgagttgtgccccacgctgcagcatctacagtgcctctccacatggcccccaggcaagcggctgccgcgattcaagagaggcgggagcatgggcagaagggcgcgacgcgatgtggcagcctgaaggggctggcatggctggatggatgtgccgccgatccacccgccagcactgctggagggaggagcgcttgaggccggcctggaagcgatggcaccactcattctccgtgccgtgcttgcgcaggacacagaggagctccttgaagctggggatgtactcgcgaatgcctcctgtctggtgaagcacgtccagctcgcatcgcactatgtgggccagaggttctcccacaaaccccgttgctagagcgtcgagtgcctcaggcagggtcctgtgaaggtgtccctgctgaaaccaccagtaggcggcgggccccatgagggttcctctcaggaggacaagggtctgcgcaggagagagactctccgcgataatgcaagtccgcagctgcagagcccagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagccttggggcaggcacagcgacgatcgttgggacggtcgccgtggtttgaacgctgtgaagggcggcagccttttggggcagcgccgcagggacacaggattcccactcctacatcttctgctccagaattgtgatacgtgctagggctgactccaacttctccgcaaggagtcgccaggcctcggtagacgccaaggccagcttgccgcatagttctgtcgtcctatcgtgggcagacgtctgcgagtctggtacggcggacgacaatggaccggccgtcaccggcgtgcgctctacggcttcacgaagtaaggttgcgcgctgtgcgcgagcaaggtcctagccagctctcttggctgtcgtcagggtaaaaatgggcctcgggttacaggatctgaaacagcggtgtcagaggctgagtgtcttccgaaagcacacgtagtgggagtaggtgtctgctcccaaaactgggtgagattcttcttgctcggagtcccacttcactacaaaatttaccaagactctgccacaagccctgtcacttgccttatgtaaagctcagatgggccccaatctgccagcgagaccaaacacgagtagcaccatgttggcaaggccagaggcatgctgcgcctgggcagctgtcccgtttctgcgcacccatcaatttaactttcatgatccgagggtatnnnnnnnnnncgcccatgctagcaaggctagctgcgcatgggcagctggcccgttttctgcgcacctatcaatttaactttcatgatccgagggtattcccaacaagtctgtcccaggaaactgcaaaaatattgatcgagatggatatattttgaatcgttgcggctgctttgaggctacaaaactccacacagggaagcgtggctgcagacacaagcacaatgggcaggccccggcaagggctctctcaggacagttgacacccggtgaacagccatgcgcgtcatcttcctagcaatcggctgcgctgccacactgttggcaactctgtatgcaaagtggttgtcggtggaacatgacgtccaaggcaaatccgcgctgattctggtggatgtgcagcgggacttcatggacgacggccctggtgagaccctggacaaccagcgagatcccggagtgctacactcactgacttacaatctcatactccctctcagtgtgcatcgtacattctcctcactccatacatagtccctgtcaggggtgcactcgccctgctccccatctggaatgagctcctggagctagcaggaggggatggcccgatagaccatgccatcgccaccgcagactggcatcccaaggtgccaaacctgggatgacccggggacatgcctgaggcactgcttgcacgtttccagtgagttgcacagcccatacagtgcctgcacttgcagtcatcacagtgcacctggaccatacgcattcccaaatccccccaggaccacatttcgttcgtgagcagccacaaaggcgttcagctgggggaccagatccaccagtgtgcggcaagtggccaggccggtgccggcggctgccacaacatcaccctgttcaacagtcactgcgtagctggcagcttgggggcccaggcacctggtgagaatggcggctgggtgtcaattcttgccactggccacaaataaagctaccccttcctaggctctgcctagactgctgccctttcccatcgccatgcagatggactggccacagatcgattagatcacactnnnnnnnnnnaggggcccagtcacctggtgagagtggcggccgggtgtcagtacttgccactggccacaaatacagctacccccttttaggctctgcctagactgctgcccctttccctcgctgtgcagacggactggccacagatcgattagatcacactgttcgcaagggcaccctgcccgacgttgaatcttacagtgggctcttcgacctcggccacacgcactcgacgggcttggtggagctgctgcgggcgcggcgggtgaccgcgctggtggtggcgggggtcgccaccgactactgcgtcctttacacggtgctggatgcgctggaggagggatttcaggtcttcctcgtcctggacggctgtgccggcatcagcgcggaggcggtgcatgccgctctggatcgcatgcaggcggcaggcgccgtcctcgtaagccttcgtggacgggagggcgaccatggagcaccctcgctcctgacggagctggagcgagcccgggggaaggtgcaccctggttcccagcgagagctgtagggcagggaagcatgatctggtacttgccaagcacttatgaagatgtgacatggcatgacgcacaaagtggggcacctgcaatgtgtctgtagattcttgactcattctttcactcatggctgcatccaatcccatccaagaatggtattgtttcacaaattttctgcatctgactcagcacacttgggcacannnnnnnnnnggcaccctggttcccagctagagctgtagggcaagaaaacatggtctggtacttgccaaggacctgtgaagatgtgacacgacatgacgcacaaagtggggcacctgcaatgtgtctgcagattctcgattcattctttcactcatggctgcatccaggctcatccaagaatggtattgtttcacaaattctctgcatctgactcagcacacttgggcacaggtgagtcaggttggggtgctaaggtttctgtgtcacctggcacgagattcccaggttcaagtcctgaagcttccacttccgctaccagcacaccaggcccgtgtccagggctgcgtttcctcctgtggtggcagggccagggtagtgggatctgaatgtgaactgagaccctgcacctgagttcactccaggcgtgtacatgtctctgctcagcacatgctcttcgctgccatgtgtnnnnnnnnnngctgtgaactgggaccctgcacctgagctcactccaagcgtgtacatatctccgctcagcacatgctcttcgctgccatgtgtgaacatgcaatgtgacacagggcgcgacagcacccaggaactgggctccacaaaatatcctctcagttctctagccggcctccccttcacccccgcctacttggctgcgccgttcgcatcatcccccagggagggaccctttcccgggtcgtcaggcnnnnnnnnnnttgtgctccacaaaatatcctctcagttttctagccggcctcccttcacccccgcctacttggctgcgccgctcgcatcatcccctagggagggaccctttcccgggtcgtcaggctccttgccacgcctggccgccagcctcgcagcatccttctcagctttcgctgcggcacgctccgcggcgcgctcctcggctcgtcgacgcgccagggcctccttggcctccctctccgcctgcaggtggatggaggtggccacgcaggccggcgctcagagggtgtttctctgctgcccatccaggcccaggacagcannnnnnnnnngcgcgccagggcctccctggcctcccgctccacctgcagggggatggagggggcaacgcaggccggcgctcagagggtgttactctgctgcccatccaggcccaggacagcagggcgggaagggcattgaggccaccaaccggtcatgtccattccaacccacgcagagacctccatcttcaccccccctccaaaaagagaaaacacccgagactcacacctgcgccttgcgctcccgctccgcannnnnnnnnnctgaggccaccaaccggtcttgtccattccaacccacgcagaggcctccatcttcaacccccctccagaaagagaaaacacccgagacccacacctgcgccttgcgctcccgctccgcagcggcctgctggttcagcgcggccacggcggcgatgtccagcgtggcggtgcgtcggacctgggcggcccccgcccccgccagccccgcgcgcggccgtgccgtaggcgcgggccggctgatgaagatgtcggcggcggggcggggcagcgagcgcggtccggcggc

SEQ ID NO: 34930 - DNA, 133 bp, Chlorella protothecoides
ccgcagaagacccctggtgcgtgcacagggggcgaccagtggcttctctaggacttttgattctagggggggttcttgagtggcccaagactgctgggcctcaggtctcgggatgccatgtctgagcctgaag

SEQ ID NO: 34931 - DNA, 129 bp, Chlorella protothecoides
ccgtccgcccagtcgaacagctcgaaggggtgctgcggggaggacgctgccggctccgaggccgcggccaagcctggctcctgcacgggtggcgcgggccctggcgaggggccccgcccggactcagag

SEQ ID NO: 34932 - DNA, 149 bp, Chlorella protothecoides
ccgcaccccacagccatcgaatccgcacccaccagccactccacccccgtcactcccgatccccggccctgcagacaagggagcgtgcaggggcggccgtcctttgccaacacctactccgctgtgaacgcgatcgccgggcacataaa

SEQ ID NO: 34933 - DNA, 122 bp, Chlorella protothecoides
tggggccagcggggtggatgcacggcgcagcccctgtcctgtacccatcattccattacccaaatccccctgaatctgcacagacaagcccacatccacctggctcctgcgtcgcgcggcca

SEQ ID NO: 34934 - DNA, 66 bp, Chlorella protothecoides
gcggtcgtggtggcccgagagccggctagttagggaggagaagcagctagagcggtacaacccttt

SEQ ID NO: 34935 - DNA, 741 bp, Chlorella protothecoides
  modified_base (263)..(272): a, c, t, g, unknown or other
ggggcagggaccctccgccagtggcgccgcgcccgccgggctgggcgccgcgcccgccagcgtggccaccgactccagcggcggcagtgccgggcccaacccctccgtcttcatccgcgacatcccgcccgcaggtgggtgggcgggtgggcgggttggggtctgtgcgtgttgagtgcccggggttgggctccttgtttgtgaggaatccctgatgcaacctgccagacctacaggacgcccgcagcctggcaagcggctgnnnnnnnnnntctttgtttgtgaggattccctgatgcaacctgccagaccgacaggacgcccgcagcctggcaagcggctgatccatcgccagatgtctgctgctcccgcccaagcttcttccgcccacccgccacagcacccacccccagaacaccccccccacacacacatccatgccccgcagtgaaactggagcagctggtggaggcgctgacggccttcggtccgctgcgccccaatggcgtgaagctgaagcagcagcgtgggcgcgacagctacgcctttgtcgacttcgtctcccccgacgcctcggccgccatcctgtcccagggcctggagctggaggggcgcgcggtgaccatcgcagagaagcgcgcgcaggtgttctaccgcgcgccgcgcggcggcggcgccgcacgctccgctggccgcggccccggcctgcagccggatggccggggccgagggggcgcgggg

SEQ ID NO: 34936 - DNA, 156 bp, Chlorella protothecoides
acactcaccgaggggggaggagcccaggacgcgcgcatgagggcccacctgcacgggcctgccgcgctgggcgccctctcccaccgccacccccgctgccctgcgcttgccctcgcgcgcgttccgcgcgccggcggggaagtagtcggcgcgccc

SEQ ID NO: 34937 - DNA, 93 bp, Chlorella protothecoides
caggggccaccaatgagcagtcaggaggccctttaaaatacaatttgtgcctaggaaagtaacgacaatgcacgcacgctcatggaaacatgt

SEQ ID NO: 34938 - DNA, 78 bp, Chlorella protothecoides
tgccgttccttcctgagacaggaggaggatctattgtgtcggagtggtcgcttgagagtttgaataccagccgaacat

SEQ ID NO: 34939 - DNA, 61 bp, Chlorella protothecoides
ctacacgctggctgcagatagagctccctttattgttatcatcttccatcccctctcttca

SEQ ID NO: 34940 - DNA, 76 bp, Chlorella protothecoides
ctgcgctcgtggagagcactgggtgcctgcggtgcgaggaaccccgccctggatctcccaccgctgaaggcacgcc

SEQ ID NO: 34941 - DNA, 68 bp, Chlorella protothecoides
cccggcgcgtggcccccagctgcggccgaggccgaccctgtgtcatcctcggcagcaagctccccgac

SEQ ID NO: 34942 - DNA, 188 bp, Chlorella protothecoides
gctcaaagtagatcttgaaggcctctgtggcacaatgcacggattgtcaagctgagaacgctgatagtggcgcgtcaacgagagaaacaggcgagtaagccaccatctctggccgatgctaatgtcagggacacagggtactaagcttgccaggatgatatcccatacacaggattgagacaaagcag

SEQ ID NO: 34943 - DNA, 78 bp, Chlorella protothecoides
caccccttctagcgcgacaaactgcacactttcctccgtgcttggaatcccttagcccgcgacgtagcgctgctcttc

SEQ ID NO: 34944 - DNA, 14416 bp, Chlorella protothecoides
  modified_base (146)..(190): a, c, t, g, unknown or other
  modified_base (267)..(276): a, c, t, g, unknown or other
  modified_base (1019)..(1028): a, c, t, g, unknown or other
  modified_base (1373)..(1382): a, c, t, g, unknown or other
  modified_base (1776)..(1785): a, c, t, g, unknown or other
  modified_base (2242)..(2251): a, c, t, g, unknown or other
  modified_base (3449)..(3458): a, c, t, g, unknown or other
  modified_base (4354)..(4363): a, c, t, g, unknown or other
  modified_base (4746)..(4755): a, c, t, g, unknown or other
  modified_base (5068)..(5077): a, c, t, g, unknown or other
  modified_base (6090)..(6099): a, c, t, g, unknown or other
  modified_base (7498)..(7507): a, c, t, g, unknown or other
  modified_base (7758)..(7767): a, c, t, g, unknown or other
  modified_base (8044)..(8053): a, c, t, g, unknown or other
  modified_base (9248)..(9257): a, c, t, g, unknown or other
  modified_base (9777)..(9786): a, c, t, g, unknown or other
  modified_base (10303)..(10312): a, c, t, g, unknown or other
  modified_base (10724)..(10733): a, c, t, g, unknown or other
  modified_base (11606)..(11615): a, c, t, g, unknown or other
  modified_base (11745)..(11801): a, c, t, g, unknown or other
  modified_base (11986)..(11995): a, c, t, g, unknown or other
  modified_base (12465)..(12474): a, c, t, g, unknown or other
  modified_base (12818)..(12827): a, c, t, g, unknown or other
gcgcgccgctctcgaggccgcggcgagggcggcgccgggctcgagggcgccaggctcgatggcgcagggcatggggccctccgcagccccaaaccccggcgctgggccgcccccactccccgtgccctgcctgttgttgccaggcnnnnnnnnnnnnnnnnnnnnnnnnnnnnnnnnnnnnnnnnnnnnnacgctctgggaagcgggccgccgcccggggccgccggagtttgaaagcgcgctggaggcgctgcgggacggcggcgnnnnnnnnnntcgatggcgccgggcacggggccctccgcaatcccaaaccccggcgctgggccgcccccgctccccgtgccctgcctgttgttgccaggcccggcgcccacctccgacgagacggtgctggcggccgccgctgcggcgaccagcctcgcgctggcctccagccagacgccggagggggagggcctggcgcccgagctcgcggcgcaggtcgagcgcctgctggagctgccgggcatggcctgcgtactggagggcgccgcgctggggctggaggcggcactgcgccagcagcagctcggcctggccgagctgcgcagggcgctccgggaagcgggcctccgcccggggccgccggagtttgaacgcgcgctggaggcgctgcgggacggcggcggcccggcgcagctcgccgtgcgcccgcccacacatgtatcgtggcccgggccgggcgcggcgaggggtgcggcgggttgtgcgcccagggccgcgccgagcgcggccgagcaggagcgagcagccgaggcgcccctgagtgagcaaagggacgcggatcggcagcaggagcggggatccgcgtccgatgcggaggcggccgcgcgcatgcgccgcccgacggagcggcaagatgcggccatggccgcggcgcatgcggcgcagggggacgcagcagtgcatggggacgtgacccagcagccttcgcaggcgacgggccgcgtccagcacgcccgagcggaggccggcgnnnnnnnnnnggggggacgcagcggtgcatggggacgtgacccagcagccttctcaggcgacgggtggcgtccagcacgcccgagcggaggccggcgaagtctcggaagaggtcgcggagctgcgtcggcgccggctggcacgcttcagggcggaggcgcgtgcccaggatgcctgaccgattgggtgggtggcgaggacaccctgtgcagctcgccttgcccgcatgcgctcgaaagggctgcccgagccgactcgcacagtaggttttgtgcggatacagttgggtcacacagtggcagagtatttattcagtgcttagttagtgggctgccacactgggcgcaacaaaggcnnnnnnnnnncgagtgggtggcgagtacaccctgcgcgatttgccttgcccgcatgcgctcgaaatggctgcccgagccgactcgcacggtagggtttgtgcgtacacagttgggtcacacagtggcagagttttcattcggtgcttggttggtgggctgccacactgggcgcaacaaaggcactgctgcccccacgctctgattgcaatgcgcagctctgctggctggtgaagcccgccaccactgacacccctgctttacatgtgagaatccattgtttctcgtgcatagagattgcgcatttacaaagatcaaacgacgggaatgctcaaacctcgggccgcacttaacgagccggcccgtgttattccggtcggtctgcgcctcactggaagtggggctnnnnnnnnnngttgcgcatttaaaaagatcaaacgacggggacgctcaaaccacgggccgcactttacgagccggcccgtgttattcctgtcggtctgcgcctcactggaagtggggcttggcggccagcgaaccctccacgatgtcggcaggcaggaaagcgggctcactcaggggtggcgcggcctggtccaccacggcgggcacgtcgttgaagagccggggggcggaggggagcgcggccgcgggaggtgcggccttggtggaggtggagaagggggcctgggggagggggggggcggagggggtgcaggtcgtgagtgatgtgcacagcaaactcaatttctgcccaggtcgcgggggtgctgggaattctcgaccctgaggtccatgaccagcatggatacacgcacctgaagtgctgaggagatcttgctgctggttgccttggtcttcttgtcctggcnnnnnnnnnncgtcagtgatgtgcacagcactccatttctgcccgggtcacgagggtgcaaggaattctcgacgctgaggtccatgaccagcatggatacacgcaccttgagtgcggaggagctcttggtgctggttgccttggtcttcttgtcctggcccgcctgtacctctgacagcaggaacttctcggcaaagggggtgagggcgggcagctccttcgccttgctcgctgccgcaatgatgacggggcgcacgacgatatcgtacacgagggttgcgccctggaacatcagatgaggatgcacaactcaagatggtgttggaaggggaacaagagcctcagcaaccactccgcatcagagagagggtcccagcaggacttgccaatccctgcaggctgcaacaatgatgatggacttgaccagcaggccgctcttcagtgctcaccttgaactgtgggtgggacagccatgcgacgagcaccagcctgaagatactgtacagcggcacccagtagaggacgacatagaggggcctctcaatcagctgcagggtgcagaccaccacccagtatgtcagccactgcttgtcgtcagcatcattgggggactcgatggccaggaaggaattgtaggtggggtataccatgccaatgatgaagctgcgtcggggcagaggggaaaatgggaggtggcttcaaagtatggaaagggttggagcaccaactcacacagaaaaggaagcgggtgcgagggcgggactccgctggtgggcaatcggctgatcaggaaccgaatgacgaatccgatacaacttgatctcactcacgttgcgagggcgatgatcttccccggagtggggaagagcttcaagaggagcctgaagaccatccctgcttgtgttggacgtgggtcaaagggaccgctcgctgcggagttggtgattggtcggaaaccggaagcaaactgtgctgatgtaatgtaaggctcagtaatattagtcggtcggtaacttccaacttccacgcagcagcagctcaccgagagaagccatggcatcatggctacctccccccacatgggtcacatgatgtttaccctcgcgcgcgcgctcaggaatactgcagtgatgccagtggcaccatctgaaacctgatgctgcgtggaactcgagtgtaagctgagaaatcaagaatatatatgctgnnnnnnnnnnactcgcgcgcgcgctcaggaatactgtagtgatgccagtggcaccatctgaatcctgatgctgcgtggaactcgagtataagctgagaaatcaagaatatatatgctgttcagtacgacaaggagtttggcgtccgatatcgtcacaccatggcgaccccatcaggacttgacgacgaatcagaacttgacgctgaccttaaaacaacgatcaatgagctcgaaaaattgggccacggatcctcattcatagaattggctcaatgggcagcatgctcactgcggacgctgcctggtgccagagggctagctcgaatcgtcctgcaggagccccatcccagctcttcattcctgtggacatgcgccgcggccttgaccaccgtgagacaaccagaagggtgcatgcgcaccgcctggatgcgcatcctgggcggcgggtcctcaccttgggatgagtcccagcagcttgcgctgtgccaggcggcggcaggaagtctggaccccaccacagctgggagtctgctcacatgcatcctccaaggctcacacgaggtggcgagcatctgccttcccctgaggatacggctggcagggtctctgctccagtcgggctctgccggcatcggtgaccgtgaggcagggccagcacttgccatcgcagaggctgtgctgagtcagcgtgacactgccgcctgccgggccctggcccaggcactgttcccagccctgctacagtccggccaggcacggcgcacagcggcatggctcgagtcagcgtgcaggtgacaagagggccagggcaactttgggacgtttggttgtgggtggaagtgagaaaaggattgcaagaaacttgctggcaaatgctccgtggagccagggaggggcactgtgcannnnnnnnnntgaaaaggattgcaagaactttgctggcatattctccgtggagccagggaggggcactgtgcacatgtatttcaaggactcattgcagcagcaagagctgcgtttgcctctttggcacaggcacctcctgaagggccagcaagcatgggaccgacagacggccctggccttgctggtccagtttgctcgtgacgtacagcccagtctggagcggtccggcacagagcagacagagggcctggctgagctgagcctcttggtggtcgccatccgagaatccttggtgcatggaactgggtcggatgttggggtgggaccacgcttgttggctcgagagggtaaccatggtattgtgtggttggctgagagcccttgtcatgaannnnnnnnnnctgcttggtgcatggagctgggtcggatgttggggtgggaccatgcttgttggctcgagagggtaaccatagtatagtgtggttggctgagagcccttgtcatgaaatcagggaagagaaaactcttctgcacatccacagaagagaataccagcaaggctcaccattcccctccccctctgttgtcagtgtgacccagagcctgtcaacaggaagcgggccctgtacatcctcacagagcttggactctgtgagctgggaatgtgtcagcaggagtggaacgtgttttcaaagctcctaggagtgtcagagnnnnnnnnnntaggagggaataccagcaaggctcaccatttcccctccccctccgttgtcagtgtgaccctgagcctgtcaacaggaagcgggccctgcacatcctcacagagcttggaccctgtgagctgggaatgagtcagcaggagtggaatgtgttttcaaagctcctaggagtgtcagaggagtactccctgcacctcttccaggtgaggcgtgccgcttgagaaacgagggatgtgcacatgcctgcagcaggaccgctcctcaccatcggccatctggactcggcttttgtgaagggattctgcgccctccctccccatgcctcgattcaatgccatccccttgtgccggatccactcactgtctcatccccaataccctccgcacccaaccccctcaccaggagggctgggggagtgtggacgcactgcatcgccccaggtcaggtcccgagccctcccccgccaccccaccctgcctcctcccctttgactggatggcggtgctgtgggggcgcggcttcgcccagcccaaccagtctgcggggcggcaggccgtgctttccttctttgcccgcgcctgggacccgcccaccctctgctccgtgcccgctgcctgggccgccggcgtgctggtccccgccgtcggggccccgcacatggccaaggggcgggatgcgggtcgcgtcagggaggaaagcgcggcgtgggccgaggcgtggggccaggccgccgggcgcggcgccgtggcgcgattcgtgcatgcctccctctgcgacgtggcgaatacggacctgccccgctcggcggtggccgccgccgccgccatggccctggctgcggtccggggcatgcagcagcaaggagtctcagccgaccagcaacagcaccgccagggcggggattattcttcagagagcagtacgggagaggacctcgcggcgtgtgccaccacgttggaggccaccacgcttcaatcagacatggacgaggtggagctgctgggcacctgcgctgnnnnnnnnnnatacgggagaggacctcgcggcgtgtgccaacacgttggaggccaccacgctgcaatcagacatgaacgaggtggagctgctgggcacctgcgctgacgtggcgcacgctctgcgtggccagggcaccggccgctttgcgttggacacctgggtggccatgctgggcgccgccggcgcgctgtgcgcgctgcgctccggcgaggcggtgctggccgcgggccgctggctgggcgccgcgccggcccagctcttctggcccggggagcggctggccgaccccgccgccgccctgctgaggggtaggcacggccaggcggtgcctcccagccgccgcgtcgccgagctggcgaatgcgtggctggccggcgcggcctggagttccacggccggcaaggacctggcggccgaggccaggatcctggctaccctggcgctgctggtgcctgacgccggcgtggcccttgagccattggatgcagccctggcctctgctcgggcccctcccagtgtctcaggttctcgaatgtggcagctgctggccgctacctttcaggtgagctgctgctcctgcacaggaggggtttgagtgacatggagatgagtctctgactcagactgattgagttgagaacggggttccattgccggcgtgggctgggtgccaggcatgggccacaccatcccacgcaacgctcgtgctgcgtttcctcctggcgtgccctgcaatggccgttcacacctcacccaaccctgtgccccttctccaaccatgtgctcgccaggtctgcccacccgacccaggcggcgagagtccccggagtctacatgcctgggcccggcaggccgcccgccgctgcctgaccttggcggtgcaggagcccctggatgctggtgtgctgctctgtcagggggaggaaagcaagaaagatgccagcggctggctcgcacggctacagtgcaccatggcggcgctgcagctcctccccgaagtggaggcgccagccgaccgcaccgcctgcctgcagctgctgctgcgcacgcgccacgacctgatgaagtcgctcggtgatactcaagctgacgcggagatgggcattgcgcaagcgagcacgctggatgccctgctcgcgctggtcacgttgagcggcgtcctccccccctcctccgcctgcctggaggccctgatgcgggtaacccaggtgtccctccccgagtccgcccccggccgggatcccgacggctggagggcacgcgctgcacccctttccacctcccagcgcagcgtgctcagcgcatggcgcgccgtggacgccatgctgtcgtcctccggacgggcagaccggagcgcggtggcctgggcacccccggacttgctcactcacaccctcgctgaggccnnnnnnnnnncggacgccatgctgtcgtcctccggacaggcagaccggagcgcggcggcctgggcacccccagacttgctcactcacaccctcgctgaggccgcagccgggctggcggcggcgccagacccccaagtcctgcccctgctgcgcatagccagggcattgctgccgctggcgctggctggcaaggcagcgcccttgtgcccggagtccgagggtgcctgccacctgctgcccttggtgtcggccctagcccannnnnnnnnnattcgatgggccccttgcgagacgcagatgagggaccattggctgtgcgctgcatcacactgcggcccggcccggcctgtccaggatcccactgggaaggggggggggtgagccgaagctgccggcctgggtctgcctggcgggagccgtggggactgactcatcacgacgctacctttgtctgcatagccagtgcacacaggtgcatacttattctccagccctcccccatccccttccacccaaccccttccgcagggtggcatgcttgcacgannnnnnnnnnggtcctgcccctgctgcgcatagccagggcgttgctgccactggcgctggctggcaaggcagcgcccttgggcccgagttccgagggcgcctgccccctgctgcccttggtgtcggccctagcccagggcggcttcaaggcgctgcgccggagctcgcggaggaagacgggactgacggcggcgctggtgtccacctgcctccacccagacctctttgacgttggccggtaccccgggtgaggcctggttgcgggttttgatgggccccttgcgagacgcagatgaggggccattggctgtgcgctgcatcgcactgcggcccggcccagcttgtccaggatcccactgggaaggggggtggttgagccgaagctggcggcctgggtctgcctgtcgggagccgaggggactggctcatcacgacgctacctttgtctgtgtagccagtgcacacaggtgcatacttattctccagcccttcctcatcaccttccacccacccccttccgcagggtggcatgcttgcacgatcccgccaccggcccggtccaccacttgatcacacagctgctggcagcggggcgccgctcctgccggatggccagccttacggccctccagctcgcgggctgctgggccctgcacccagcctcagctgcccactacaccgacacgctgcgcgagctgtgcctgtatggcttcgcggacgacgccacggcgctcaacggcgccgacgacgccgtggtcgacccagagaccctgctggacctggcggcggtgcgggcgccgccagatggcacgctggccgaagcacatgccgccacggagctcgcaccacgcgtggccacgctgtgcctgctccacgcctgggtgcagcaggcgcagcaattgggggaggataagctggcggcggactcccgccgcacggggcatgcggcctgggcgcagctcctccacctggcgctccacgacccggagctgtcctcgcccaagtaccaattcaaggggacgacgcaccggcgaaaggcgagtgctggtgggggggatggaggttggggtcatgttgagggcacattggcatgaggacagggagggagctctgccaggctgaatctcacgccgggggtctccactacttgggctggggtcttgtatcaatcctatcgcattcatgcattgctggcttcaatctcnnnnnnnnnnaccgggggtctccaatgcttggctggggtcttgtatcaatcctgtcgcattcatgcattgctggcttcaatctcccatgtcatgagcaaaaccaaccccaccccccctcccaaaccatacaccaggtgcggctgtggcaggccctggctgtgctctgccccctcatcgtggcgcaaagtggggacccggcgctgctcgaggaggcactggaccaggtcatgtcggcgctgacggtgaccaacgcatccacagtgaagcagtaccaggaggtggtggcagtggtactgctgcgtgccacgcccgatgcccccgccgcactgcgggcgagggtgctttctttgctgtgtgactgccgcaccagcaagcgggacgacctgccctccctcatcctcatcgccagccagttcctgctcctggaagcccggcccttgagggaaagtgctgagcctggccctggtttagcagcagctgcaccgcctggaccaagcctagggcatagcagcgcaggggctgcaccccnnnnnnnnnncgagggaaagtgcagagcctggccctgatctagcagcagctgcaccgcctggaccgagcgtagggcatagcagcgcaggggctgcaccccaagcaacagctctggcccgggaggtggtctgcgccattgtgccctgggcactgagccacgttcaccccgtgcggacctttgcccagctcgccctctggcgactgctggagacctttccccaggtggtaaaggacgaccctgccctcgtcaccatgctcggcttcttttcctccaacaccgacgtgcagcggctgaggaccgccctcggcctggggcaggacctggattcattcgaccctgagagggcaacctgtccggccggtgtcctgtacaaggtgatctatgagtgggtcagagagcggaggttcggtgggatttcttgcccaggggctcggactgcgggggagggtgatgagttggtttggggttgtgtaacatttgaaatggttttttgttgagagacaggctgtggcacgctggatcatgnnnnnnnnnnttgtgtaacatttgaagtggttcttcgtcgagagacaggctgtggcacgctggatcatgttgggggctggcatcgagtagaaactgtccagcaaccaagccagactccttccaacgcatcccaaactcccttgaacactctctgtcccctcacagggagtagccctggccgggcgctccgatgagctttccaccttcgagggggctctggaacccctggtggacgcgattgctggcttcctcgtggccgagcggctcaagctgcggatcgacatgaaggatcggctggtaggcagctgttccaaatgtgcatgcttcatggaggagcaggttgggggatgcgtgcgtgattggcgggtgtggcactggcgggatgcccaaatcagcagtgccagaaccccaccctccatccnnnnnnnnnngatgaaggaccggctggtaggctgctgttccaaaagtgcatgcttcacagaggagcagggtggggatgcgtgcgttattggcgggtgtggtactggcgggatgcccaagtcagcagtgccagaaccccaccctccatccaaaatgctcatggcaggaggcctcggtgcatgaagagtactccagagccagtgccggcaggccgtgcatccagcccagccagcccccaccagccccctcccggtctgctgcccagcgcaagatcacccccgccggccagtccgtagtggtggaggacccctgggctgccaccctgggcttcgcgcccctggcacagggatccctggacgacttcgaggccaatgagctggcgccagcgctgcgcgaggcgggcagggcgggcgctgcaccgcgccagcgactcatcgtggtggccagcctggtggacaagctgcccaacctggccggcctggctcgcacctgcgaggtgttcaggtggggggggcatgggtgtggtggggcgatttgtatatggaatggagcccctggacactctaggggtggtcggaagatcacagtgtgcgcagaccctggccgagcgcaagctcatgtgcagaggcttgatgttcctttcacgaggttgggaagcctccccgcctactcgccaagccaggaccacgcttgccacctccgcagggcgacggcactcgtggtggcagatgccagcatcgtgagcgagccgcagtttcagtccatcagtgtctccgcaaacctttggatgcccatccaggaggtgccaggtgggctggggtgctgttcgtgttcatgcatgtggagtacgacgtgctcaaacgtggaggtgggtatcctcagannnnnnnnnntgctgattgttttcatgcatgtggagtacgacatgctcaaacgtggaggtgggtatcctcagagatccaggacgtttgaggagtctctgcctaagccagaagcacagatcagcgagacatggccagacannnnnnnnnnnnnnnnnnnnnnnnnnnnnnnnnnnnnnnnnnnnnnnnnnnnnnnnnaccttagtgggtctggagcaaaccccagactccgtcagcacaaaggtgtctttggctcaggggtgtgggtaggtgcagtgaaaggcgctgcctgggagcctgagcattggttgtgccattccctcaacccgccttgcctccccacctccttgtcccttggcaggactttgcgtggccggagaagnnnnnnnnnnaagtccctcaacccgccttgcctccccacccccttgttccttggcaggactttgcgtggccggagaagacggtgctggtgctgggacgcgagaaggagggcatcccagcgcacctgctggcccggctgcaggccacggtggagatcccgcagctgggcctcatccgatccctgaacgtgcacgtgtcgggcgccatcgctgcatacgagtttacaaggcagggtctggcgggcagggcctgagtgcagcgaggccagggcgccggaagggagacaggatttggagacaggcgcattcatcgactgcgcatgaggagggaagtgcgggggtgcatgcctcagcagatgtgcgagcatgtgacaggcatccacatgagattggggtgtggacagcagtgcaaacaggtcgtgactcgacgaccgctgggcactggggccatcagcaggacacttgcagatggacgagaaggnnnnnnnnnnacgacgactgctggacactagggccaccagcaggacacttgcagatggacgagaaggacacagaagggcgtaggcgatgccttgctcgcagtcgccggggtggagctatagttacatgtgcatgggggacagcccgcccccagaggggtcatgctcataccgcagcttcttctgcagcgtgcccacgccggggacgtcgcaggccagcccccgcttggagcgatgccgcttctcgatgcctgctgcagatgtggggcgagcgagcagtgcatggggcattttcaactgcgagtacctgtttcaggacacatagtctgggacagccacctttgccggctgcagtnnnnnnnnnnggacgtggggcgagcgagcagtgcatggggcaatgtcaacagcgagtaattgtttcaggacacaaattctgggacagccacctttgccggctgcagtgaataggcaggctccctgtcttgactcacccttcacgcgggcggaggcgccgaggggggataagctcctgattccaaatgcgtgggccccccttccagccagcctccggccgcagctcgggatggctgcgcctggatgggctggggcgctgccagcagtggcgctcttcaacagcacagcatcgccctggaagtcagagtaggcgatgcattccgcgcgcgccagggaggcctccggtatctgccacatggtatgaagggtgtggctggggtggagagacctagatggctgggtactgtggccagcagatcacctccacagagcccccgcaacgaccaggaggtgcatttgcaagaccagcttctcagtgcagtgcttcatcagtgcaacccccgcaaagctgttggcgctccagagccccagcacaatgacgcaccgtgtaaaccgcccagttgccctgtccgtgtctttccaaaaggtgctgctccaagagggaaaacatgaccatgtcgaagtggtacttcctgtgtggggccaggactggagtttgaggccttcagcctcaacaccgagggcagctttccaggaaaggcactccccagcgaagtcgcccttccaagcacctctcgaagacattgcatgcatccgcacaccgcgcacctgggcccggaggcattcccctccaagactcgggagcgcagggagtgatggaggcagggtccgttaccacaccatcccagcgcatgccggagcaccaggcttcccatgacgcgcagttcctcctgtgagtgtgacagggtatcctctcggccactacagcgtcgcagcacctcctcgcagctggcctccatgccgtccaactcgcaagcggcatccgggctgcaggccgtggctgcccagtccccgccccacattgaagtgtatctatcaatgaatggtatggggattggcaggctggacattgggacgtcaaggagcttcttcacggatcgtggaagtccggaggtctttcccagcaggacacgcacagcactcgggggttcgaaaagcatccaacgacagctgcttgtgcccccctcgttcacttctttccggggcaggtggtcagcgtgatagttacagggaaggtgggggtgcatccatgccccccgacacctcgtcgcccgggccgtgaccagtcttggcggcgtcccgccggccatcccctgcctcgccaggctgctcacccccctgcctgtccatgccgcacgcctccagccagccagcctccgggtcccgcagcacgtccacgacctgtcgcgccaccgcatccaggtcctcggcgccacgcttccccctgcgcctctcccccgcccccctagacagctcgtcccagcaccgcagcagcactgcctcggccgagtccagggccaggcgagggcagggcgaccccgccaccacgggtgtggccgggggtgcggtggcccgggccgcctcgcccaggcaggcgcgc

SEQ ID NO: 34945 - DNA, 80 bp, Chlorella protothecoides
gtctgcaagcaagctggggatgcactacatgtggcgagctccaagtgaccggcaatctcatccacccaaccactgcaccg

SEQ ID NO: 34946 - DNA, 122 bp, Chlorella protothecoides
ttgagccgctcttcagcaggttgagaagaggttcgactccttgcagcattagaagatgacctagtggagatagcggcggcttggtcggatgatttggcccgcggaaatggggcagggggggg

SEQ ID NO: 34947 - DNA, 77 bp, Chlorella protothecoides
ttactccagaaagtgagcgtgcagcgcacgtatagtaatggcagagtccaagcctagacccttgttgggcccgttgt

SEQ ID NO: 34948 - DNA, 75 bp, Chlorella protothecoides
ggggtagattcaagcataaaaatggatccgccgtgcggggcccaaacaggcaaccgcttggggtccagagatcga

SEQ ID NO: 34949 - DNA, 447 bp, Chlorella protothecoides
  modified_base (101)..(299): a, c, t, g, unknown or other
caatgcccgtccctagaccctcccaaaatcttagcccaggagggcgggcactgcccatccaccccctgcacacccgcggacccaggtcggggacgcagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatggctgtacggcgtaacccgcgcatgccagggtggctaggttgcagcatactacgccccatcatggttcgcaagccatgagggaggtcccccgagccagcaccccaatgccaccttcccaccggcttccgatccgaccccacct

SEQ ID NO: 34950 - DNA, 79 bp, Chlorella protothecoides
gatgtccgggtgtcgcccggagcagtggtcaaccgtacaggcatgcccagtgtccttttcctcgctcatgggcttcgca

SEQ ID NO: 34951 - DNA, 672 bp, Chlorella protothecoides
  modified_base (108)..(117): a, c, t, g, unknown or other
cccccccccctcctccccgacaaacccagatgcatgccgcgcacggctcagagctggcccgcgacgggcctgcctttgaggcggcgctggagaagtacgtgacgcgtnnnnnnnnnncggctcggagctggcccgcgacgggcctgccttcgaggcggcgctggagaagtacgtgacgcgtgcggtgctgtccggtcgcccgcgtgaggagtggcgcgcggacgtgggcgcgcgctaccgcgcgctggcggcctcctcgcgcgacgaggcgcaggccggcttcctgcgcatcatccgcagcctgccctacggcaacgccgccttcttcgccgtgcgcaagatcgacgaccccatcggcctgctccccgccaagctcatcctgggcatcaacaagcgcggcgtgcacttcttccgccccgtgcccaaggagtacctgcactccgccgagctgcgcgacatcatgcagttcggctccaacgccagcgcggtgttcttcaagatgcgcgtggcgggcgtgctgcacgtcttccagttcgagacgcgggccggggacgaagtgtgcatggcccttcagacccacatcaacgacatcatgatgcggcgctacagccgcgcgcgcgccgcgcaggacggcggcgacgacgcgccgggtgccggcgccggcggcgcggg

SEQ ID NO: 34952 - DNA, 100 bp, Chlorella protothecoides
gcttctgcccatcatcgagcacgccccctctggccccctggccgatgcacacaggcgccctggcgcggcgtgcctgcgcggccttgtcggagatgtagga

SEQ ID NO: 34953 - DNA, 61 bp, Chlorella protothecoides
ataccagggaaaggcaaaggacatggcctccaccaccttggccccgcagaactcttcaggc

SEQ ID NO: 34954 - DNA, 92 bp, Chlorella protothecoides
ggtgggtaccaagcaatcggctgtgaggaagtcaggtaacgcaaggggttggggccttttaccgatggcggccaggggcggcgcaggtgaca

SEQ ID NO: 34955 - DNA, 93 bp, Chlorella protothecoides
ccctaacgaaggagtgggtgagcattgaataatgctttttttatcgtagggtcaccgagcatggagcttggcttcccttccaccatccgcagg

SEQ ID NO: 34956 - DNA, 70 bp, Chlorella protothecoides
gtacctcttcaacggctactgggaggacatcgggaccatcgagtccttcttcgagtccaacatcaacctg

SEQ ID NO: 34957 - DNA, 74 bp, Chlorella protothecoides
cccaggtgtgcaggtcatagtgatgccgtcatggtcggaatggtgtgatgccgttgaatcagtgctgcatggct

SEQ ID NO: 34958 - DNA, 61 bp, Chlorella protothecoides
cagcagctgcagtgaaaaacaccggcaggggaggaaaacaagccgcagggcacggcatgcg

SEQ ID NO: 34959 - DNA, 174 bp, Chlorella protothecoides
gtaggtgggagggggacggagggggatggggggaggtgcagaatgggggggttgacatgccaacaatggggactgcctcttgggaaagtaaaagagggtatctggaaaaacttcatggctttgtgcaagacaggggcctttgttttgacagggtttgccagcaaagccccgcaa

SEQ ID NO: 34960 - DNA, 66 bp, Chlorella protothecoides
tacatgtgtagctgtgctgcccatttgtcatacccctggccgccccttcaagggtgcgagaaagta

SEQ ID NO: 34961 - DNA, 73 bp, Chlorella protothecoides
actcactgcccttgagatgcatgtcgccactctctggaataattcccccccgtccaccccacccaagcacacc

SEQ ID NO: 34962 - DNA, 63 bp, Chlorella protothecoides
ttcttggatgggggcggtggagactccttggatgggggtggtggagatccaaggacccatgca

SEQ ID NO: 34963 - DNA, 70 bp, Chlorella protothecoides
agacaacctcggccgtcgctcggctgcagcccaggagtcgcatcccccctctctacccctgaccgccccc

SEQ ID NO: 34964 - DNA, 8840 bp, Chlorella protothecoides
  modified_base (444)..(453): a, c, t, g, unknown or other
  modified_base (1135)..(1144): a, c, t, g, unknown or other
  modified_base (1728)..(1737): a, c, t, g, unknown or other
  modified_base (2011)..(2020): a, c, t, g, unknown or other
  modified_base (5290)..(5299): a, c, t, g, unknown or other
  modified_base (7614)..(7623): a, c, t, g, unknown or other
  modified_base (7911)..(7920): a, c, t, g, unknown or other
  modified_base (8496)..(8505): a, c, t, g, unknown or other
ggccgcggcctcgtccacggggcccagcgcctccagggccgcggcctgcaccgcctccgaccccgcccgcgccagcagggaggcgagcagcgggcagagggtctgggagcccgccgggcgggccagcgcggcgcgcagcgagcgcagcgcgcccaacacggccacgcactccgagggggcggtggtgccgtgcagcgcacgggtcaggcccttctccaggtccggcagcgagcggaggagccctggcagcgccgccagcggcgcgtgcgtgcagtctgagcgggggtggggtgggcggggtagttggtggtcgaagaggcgggcaggaacatgcccgtccccctgcactcaacaacttgagaagcctcacatcagggacaggggctctcgccgccctccaaagaaccccccagagggcccatccccaccgtcctcccgcagctnnnnnnnnnngacatcagggacaggggctcccgccgccctccaaagaaccccccatagggcccatccccaccgtcctcccgcagctgttgcacggcgtccagccgggcggtgatagctgcggcaatcctcagcgggtgggacacccagtgccgcaggcgccgcgccccgaaggctgtgcgcgtgtggttgagcagccagagcaggctgcccttctcctggccggtgctgctgttcaccagcacgtccagctgcctggcggtgtggggcccaggtgtggaaagggtggggagtgcagccgcaatggcccgtcgctggagactgcttggcccgagcaggcctggtttcctttccccccaaagcaaggcgaggctccaggaacccagagaccgcaagcacaagcggcacctcactccctggaccccccccagaacatccacactcccccctccccgccgccgcaccggagggtgttgggggacagggccagctcggcctgcgtgttcagctgctggaacccggcgccccagcgcagcaccccctccaggtggaaagggcggaggtggtccagcgcgtgcgccagcgcacgcagcgccagcggcggcagcgcgcccgccgcccgcccctgcgcctcgttcccctgggactggtcatccagagcctcgctttcccggacctcgttcccatgcgcctnnnnnnnnnnattcccctgggactggtaatccagcgccccgctttcccggacctcgttcccatgcgcctcgtccgcccgcccatccagatcctcccccggtcccgccccgccccgatcctcgccgtagaactccgccacggccctgcccgcggcgccgggcgcagcgtaccgccccgcgtccacctcctcgacgcgcgccgccggcccctccccgccgtccaggcaggccagcaggcggcgggtgggggcgctggtgtcgctgggcaccaggacctcggaggggggcacgaacagcaggcgcgcctccagctcgctccgcagcaccgagtccctggggagcggcgtggaagagggcggggtccaccgggctgtgaaatcttgtgtgggcccgggcgcatgctgcaaggccccgcggcgccaccgtacgcctcgcagggatgcggcatctcgaacgccatcctctgggacccagccatctcaaaacagaggtgctcccctcggcaccatcctccccccctcctcaccacacctaaactgggagaagaggacagcgccggtggctgtctccacggccaccatgccgacctccagannnnnnnnnntccccctcctcaccacacctgaactgggagaagaggacggcgccggtggcggtctccacggccaccatgccgacctccagacctccagaccgcccctgggcgccctcggcctccacgacgcacacaaggaagcgggcggaccccccaggctggccgggggcatccccaggcctctcacacgccgactcgccaagctcccccgcctgtggcggccgtgggcttgtgtgtgacgggcgcatggatgagtaggaaggcagggatgcagagcagttgnnnnnnnnnngagctcccccgcctgtggtggccgtggacttgtgtgtgacgggcgcatgaaggagtaggaaggcagggatgcagagcagttgcacagagcggggggtatggcgttcccgccgccacacccatcatccacaaaccatctcctcctccctcgcatagccaaagagcccaggtgcccgacctccagggtagcacgggtgtagagctccgtcatcctcctctggaagggcgcgctgcgcgtcgtaccggcggccttgatggctgccgtctcggtctgacgcacgatgcccaccttgcagcccgcctccaccagccgccgcacgtgcacgtgcaggcggtgggccgggattgaggccaccaggtagttgtggtctgggaaggagaagacgttgaggatgcgggacgccgtctccgcgtcctcgccgaagaagcggaacttgtacccgcactgcacgcatgggcgggaccgaggtgggggcttctggtgaggttctgtcagtgtcctcatggaagacacaaaggcacagcaggatggtcgtaaagtggttatggatttcatagcaatgcaatggtcccgtgaagcgttggacttgagctagactgccatttcctgggccgtaatccccgtacagtacagtgcaatcgtcgcaggtcagtgcccccttgtgcatccaattaaaacttcctgaatacaggaagaaagacgctgcaaactccgtcgcacctccactaccagcaggacgccggggtgctgcctcttgagatctgtgacctgctgctctaggggtgtcagcttggccccggggggaggggtcccggtcacagtcacactctgcttggcctccgccgctctctctcctcgagtcgcagcctgacccgataccagcttgcgctggaatttgtcgtgcaggagtgcttgatctggaccattgcgcttcttggagggcgtctcctggggggctgggagggcctcatcggacctggcgcgcttgaggggcagaatggctacaccacccccatccgagcgatcaggtgatctcctcgggcggtcttcgcatgcgtgggttaaagtctctgccttatctgcgccattatcagcatggcgctgcttgagtggagtcggctccgagggaggcggtttcttggagccaaggaaggaagtgatcgagcgctgtattggagcggaaggtcgagcgccctttcgcgaactcatccctcccacttcaagtcatgtgcagttttgtttcatccatggtgcatgccgcaggatgggtgtgaaggcctggcttaaaagccgcatgcatgctttcaaatccgagtgttgtgtcggaaagattgcgcgcgcaagctcatggagtggtcgttacccgcgaggtgggtcaagtacagatgaagcacagggcaagcaagcaaaacccaaaacccatgaccggaaatgcagcaatggaggggtctgggtgggggcaagggtaggtgttgtccaccagggcgtggggaggtcgggcgcctgggaagtacacaccttcgccggttgtcatcctgccagagccacccgatggaccatgcctcggcgcccctggtggtaggcctgacaggcggtataggaatgggcaagagcaccgtgagtcgcatgctcgagcagcgcaacgtcccggtcttggatgccgaccaggtgcgggtgtgagtggctgtacatatggctccctcctgccacttccctgatgcctgcctcatcgggatcacagcagcctcgctgcatgaccgatggtagatcctttctttcgattgcggtcatctctttgtctgtcaaccgatcctcaggccatgcatttctacttgcctcatacgctcacgcccatagccagaactccaccgtcttcacaaccgaatccaaacatagatggtgcacgagctgtatgccgcaggcgggcttgctgtggagcccatcggtgccgcctttccgactgctgtgacgggcggcgccgtcgaccgcacggcgctgagtgcctgtgtggtcggcaaccccgccgctctgaggcagctggaggacatcgtacatcccctggtaaaggcccagaggagtcttggactaaggcgggccgccgagtggggggcggaagccgtggtcctggacatccccctcctgtttgagacgggggccgaggcggactgcgacctcacagtagccgtcagcgcccctcctcacatccagcgccggcgtgtcctctctcggaagggcatgtcgccaggttggctattgttctgaatctgaatgagctttctgattctgttgcacctgagcttgcctccacctccagctgccgcaaggatctgcatcccgcgctatctttcactccctccctgcacagagaaactggcttccctgctggctcggcagctgccagatgcggagcgatgccgcaaggcaaacgttgtcattgatacggtgagggtacagcatgcgcgtggaccttcccctgaccggctggaccctctgcttgagtgcacacaaagtgctcgttggtgcagtgaggtgtgcgaatgacaggccggtatgcactggtgggagccacccacacaaaaacaggactgtgacgtcaggatgcccaccccactcctccaccaggggtgcagcctgaaggagacggagaagagcatcgacgaacttgtaagcacctttccctcccgcacccgcaaggcctactcaaaggtctccaccgacgcagggtgagggacttggaacctgacagatccatgcgcgagacagcttatgggcttcaaggggcctcacaccaatggaggcccaccatgcacagaatacgtttgaccagtgcgggatacgttgtggcaggacaaggaaggcacaggatcctctgtgggatccctgcgcatgcagacaatttcaagtcaaagcgggagagtgcccactcgactcggggaggggagaactcaatgatcattcaaaatctgccgcgagccgcagttcgcaagcattggcctccgacaggaacccgggcaaggaaaatgggagggttcctctctctgcgccgcaggttcgacggcgtggtggaagacgggcgcggcctcacgctccgcggcgaggtggcattcgtcgtgctttctggcctttgggactctgcgtccgttcggcgcggcctcaccggctcagcgcggcgtcctcagcgcggcgtcctcagcgcggtatccttggcccgacctcgatggcctgggctgcaccccccacccccgccggcccctcactccgcctgaggcnnnnnnnnnnccctcagcgtggtatcctcggccccacctcgatgacccgggctgcacccctgcccccgccggcccctcactccgcctgaggcatcaggcgtaggacgatggcagtggacccgccgccgccgttgcagatgccggccgcgcccagggtgccgccgcggctgcgcagcgcgttgatcagcgtgaccacgatgcgcgcgccggagcagccgatggggtggcccagggccacggcgccgcccagcgcgttcacgcgctccgggtccaggcccagcagccggcggttgaccaggtccaccacggagaaggcctcgttgatctcccaggcgtccacgtcggcggcggcgaccccggcgcgcgccagtgccttgggcaacgaggccgagggcgccgtggtgtactcgcgcggctcccgcgccgcgtcggcgctgcccagcagctgggccagcgggcgcaggcccaggcgggcgaccgccgcgccggaggccagcaccagcgccgccgcgccgtcggtcagcggcgaggcgttgccggccgtgatcgtgcctggcgccgcgtcggggccctcgggccggaaggaggggcgcagccgcaccagcttctcggggtccatcttggccagggcctcgtcctgtgaaggtcgagtgggggggttgacaggagaggagtaggagggattcaaggtggtgtggaggcaactgcttgagcgggatcgatcatcagggcgaggcgacggcccagtgagtagccgcaatcaccgtgccgagcagcatgcagcgtagagggcttgcgccgcgcagggtcgtgagacgcccccaggtcgcctgcccagctccccattcctcctcccagtccccttctaccctgggacaacatgctcatccgggtccacgccctcccagacccccggcctcaccccacccacctgcgagacaaccgccgtcccgcgccgcgtcgtcacctccacgggcaccacctcccaggcggtgacgccgccggcctgcgcgcggcgcgcccgggccgcgctctccagcgcgtgcgcgtcctgctcggcgcgcgtgatgccgtgctcctcggcgcacagctccgcgcactcgcccatgtggatgtcgtggtgcgggtcccacagcccatcggccaccatgccgtccacgagctgggcgtggcccaggcgcgcgccgccgcgcgcggagggcacgtagtaggggatgttgctcatcgactccatgcccccggccaccgccacctgggccacgcccagctgcaggctggcggcggcgatggtcagcgccttcatcccggagctgcacaccttgttcaccgtggtgcagtcggcggagaagggcaagcccgccttgagggccgcctggcgcgctggggcctgccccaggttggcactgagtgtgtgtgtaggaggtgtgggtgggtgggggggcacagagtgatgccgagggcgagggtttcggcagatggatttgtggtatgggagaacagcgatggtcctggcgctggaggagcaggcaatgcctcatcctgctccatgtcgccaccggacccgagtcccgacacattcccatacgtccaaaccctgcatgcattggcatgtgaacgcatctcgactctcagacaacaagtagacgcacgcgcacctgcacacgttgcccatgtacacctcgtccacgtcgttggggctcacccccgcccgctccagggcggcgcggatggcgatgccccctagatcggtggccgacaggctggataggccaccctggaaggatcccaggggggtgcgcgccacccccacgatgtacaccgcggtgtcgtcgagggcgtccccaggtgtccccctcgcccgcttggacccggccccggtgctcatgccggaggtctgttggcaggctatgccgttcagaggtgtctccggcttcgcgggctccaggtgcaggcccagggtggtgagcctggacagcgccctgtccatgcaagacccagcccgcaaggtgcggaggatcccggtgcgcatggggaagcacacggcctgcaggacagaggattggaggtggtggtccctgctgatctccccctgcgcagcgcctgagggccagtgtacgaaccgagcacatggggcgatcctgcccgcggcatcgccgctgactgggacgctggtcgggactccgcagggcgcgacggactggccctctgccggtgaagtcgagacggtgggcgacagcgggaccacgatgggaggtattgccaaggagtcatcaatctgcggaattgctttgtaattctgggtgctgtgtcccaggatgcctgatnnnnnnnnnnttaaggagacatcaatctgcggaattgttttgcagttctgggtgctgtgtcccaggatgcctgatcggtgagtgtccaggggtcctgcccgtcgagaggcagcacactcgcccagcttgtgcgcacgatgacggacaggtgaggtgtgagcttattgggaataccaacacagacatccatgtattcggtgaaatgtaggcgcccttaccttgtctcctgtgtttgctatcctacccatttgctgcccatggactccgtaatgtcactcaacagggtgctgtgccgatnnnnnnnnnngttcggtggaatgtaggcgccctcaccttgtgtcctgtgtttgctatccgacccatttgctgcccatggactccctaatgtcactcaacagggtgctgtgccgatactacttggaggggacttgccggtatggccaggcttgcaccttctcccacgacctccaggacaccccctccatggtgaatggcaggcccatgctggctgtgcactgctgcttgcgctggcaaccccctgatcacaggggcagtcacagcggccccacccacactgtaccatgcattgcgaccatcgcctccccgcacccacgccacaggtctgcaagtactgggccgcgggcttctgcaagtacggggacaaggtgaggtgcccttaccattgcatgctccctcgcctcgggggaaggtgtgtgtgggagacatggatgcactttccttgagccgaggtgctgagccgccctccatcacatctccatcagtgccgatacgaccacaagcacccgcaccgtgcgccccgcgctgcgctcaagcctgctgccacgaccggcgcggcgccatccccggagcccggtgctcctgnnnnnnnnnnaccccgcgccgcgcccaagcctgccgccacgtccggcacggcgccatccccggagcccggtgctcctggactggggtctgagccgcctgcaagccacgcgctgctggccagcctgcccctggacccgtttgagaccgacgcggggcagggcgcggagccagacgctgcggcggtggtggacgacgacgcgatggtcggcctcggcggctgggaggaggaggggcgtgacccctgggcgcaggccgccgcggacgccgcgctgcgcgccggcgcccggccgccaccctggtctcggcctggcgcgatggcaggcgcgatgacgggcgcagtggcgc

SEQ ID NO: 34965 - DNA, 129 bp, Chlorella protothecoides
cctccctcacctggagtcacgccgtcgacgaggcgatggcgagcgcctacgcgcaacgggctcgtaggacggggaacgcctacgcgcaacgggctcgtgggatggcgaacgcctgcgcatcaccggctc

SEQ ID NO: 34966 - DNA, 77 bp, Chlorella protothecoides
aaacgacactgtggcatcgcctgcgattcgccggggtggcagcgtcaggcgtgctgctgagcccaggatgccagtgc

SEQ ID NO: 34967 - DNA, 124 bp, Chlorella protothecoides
cgagctgggccagcagagctgcgtcgggagcgagctggctcatggcggcctgggcgtcaggagcacgcggcgctcccctctgcccttcagcacacgcgccctccagcgcgcgcgccagccgcga

SEQ ID NO: 34968 - DNA, 15525 bp, Chlorella protothecoides
  modified_base (359)..(422): a, c, t, g, unknown or other
  modified_base (1709)..(1718): a, c, t, g, unknown or other
  modified_base (1911)..(1920): a, c, t, g, unknown or other
  modified_base (2035)..(2044): a, c, t, g, unknown or other
  modified_base (2441)..(2450): a, c, t, g, unknown or other
  modified_base (2876)..(2942): a, c, t, g, unknown or other
  modified_base (3887)..(3896): a, c, t, g, unknown or other
  modified_base (4339)..(4348): a, c, t, g, unknown or other
  modified_base (5269)..(5278): a, c, t, g, unknown or other
  modified_base (5384)..(5620): a, c, t, g, unknown or other
  modified_base (5772)..(5781): a, c, t, g, unknown or other
  modified_base (6612)..(6621): a, c, t, g, unknown or other
  modified_base (6966)..(6975): a, c, t, g, unknown or other
  modified_base (7197)..(7246): a, c, t, g, unknown or other
  modified_base (8197)..(8206): a, c, t, g, unknown or other
  modified_base (9907)..(9916): a, c, t, g, unknown or other
  modified_base (10033)..(10042): a, c, t, g, unknown or other
  modified_base (10301)..(10310): a, c, t, g, unknown or other
  modified_base (11929)..(11938): a, c, t, g, unknown or other
cctcccaccccgccgccagccgcgcctccctccccgccgccagtcgcgcctcccaccacgccgccagccgctcgccgctgcctcttgggtggcccccccctcgctccaaacatgtcccggatggagcgctggcgggtgtccaccaacgactcccaacgccgttgccacagcgcgcagggctggtcgggggcggggggcgccagaccctgcaggcgcagcagcagtccggcgtggtcgctccacttgggcggcaggcggtcggtgcccaccacctcgcaggcgaccacgctgggcagcagccctggcgtgcacagcacgtagtcaatgcgcagcccgcggttgaaggcgcgggcggaagnnnnnnnnnnnnnnnnnnnnnnnnnnnnnnnnnnnnnnnnnnnnnnnnnnnnnnnnnnnnnnnnaacccccgggtgcaggcggcgccagacgtcaacataggccgtggggcccacggtgagggcatgcagggctgccagctcctcgggtgcatacaagtcgtcaaagggcatggaggcgtggacgtcggcaggggtggcgaccacgttgaagtcgcccaccaggatcacctggtgtggggaggaggagaggggagttgttgggcgtgcaagggggaaggcggaacacagagggcccatgaaactgtcccaggcattctcttccacagctcatccccatcccacctgcctgccctgcttccgaaagccgtccgccgtgcgcttcagggcgtgcaggaacttgagtttgaagccgaggcggggacgcgccgggcggtcgccggcattggggacgtacacgttgatcaggacaaaggcgccgtggtccgacactaccacccggcctggcgtgggacacaggaagggtagggtttgcgtcttgaacagggctgtagggaatctgcccatgtttatgggtatgctgcactctagatggtgtcaccacactgccgacgcaccccagccattcccaagggaccccttcatacacatgcactgctgcacctcacccgccccccagcctcaccctcgcgatcgatatccgactctccagaggcaaggcagtccacctcggcatgcgctgcacgccactggcccctcgcgtaggtcaccacgcccgagtagccttttttctctcgagacaccgcccagtaggactgtcaccagaggggaaattcaggggggttgcaggcccacaccgctcctcagagagcccttgtcgtatcagatcgattcacatccccaaccaagctcgttgccagaaataaaaccatcttcacggcgttcacctcgcagtcatccacacacacaatctccttggtgagctgagcctctaccagctttgtttcctgcagcaagtgggagacaaaggcaattctgagtgcgagacaccccacatcacccaagcaagagtcaaaccctatcgttgatctggaccaccaccatgaccagtaccagcacctggaagcatgcaatgtccaactccagctcgccgaagaggtctgacagcgagccatacttgagagcaatgttcttgagagtgggtgcctgcatgaaagtcgtatgggttcctggaaacttgccaggatgaagcttttgaatgccacaagaatcaaaggtatcttgaacacttaccagtgcggctacattccagcaaaggagggtcattgaccccatggcaggacctcctcaagnnnnnnnnnntgtatcttgaccacttaccagtgcagctacattccagcaaaggaggttcattgaccccatggcaggacctcctcaaggcgactaccaggactcagcatgcaatgctgttgacctgccatgcaagcaagctagtcgggcctttggttccatcaggtgcttatactcatatgctatagtggtgcaattgggaggnnnnnnnnnncccactttgcgagaccccattcctgtctggggttcctgtcgttcaagctgcataatggggcgcgaggaacccgagtcccccgaagtgaagcatggcctagactcgatctctttcnnnnnnnnnngaccttaaactttacgtgtgccttgctcgtcaattgttgcttgtaggtattcggcaacggaatcagagcgtcatgatggtgcccctacaccgtgacattgcgcctgcagcataaagtatcgatcatctgtgcagtccagtcgacccaccaccactttgcgagaccccattcccgtctggggttcctgtcgttcaagctgcatgatggggcgcgaggaacccgagtcccacgacgtgaagcatggcctagactcgatctctttccatacgtacacctgtatctgcatcaatcgcattcgcactctgatatctttggaactaagcagtcacacaaaactgcccggctacacgggactttgacatcaaccgcttaagcacatgggtgacaggagaggagnnnnnnnnnnggcaatcacataaacctgcccggctacacgggactttgacatcaatcgcttaagcacatgggtgacaggagaggaggtcgcggcggacagcagggtggcagcaggtattctgaagaggatagtatggagaatactggagcgtgcagaggcaccaactgccgagattcggagatcgatccccacgggcgggcttgctgcgcagcatctctgacaccgtccctgctggtgacatcataggggaggaagccaggtctcgcggagccgagatggagatcggacgcctcagggcgggcgcagggactccatgacgccgaagggcggtgtcagcaagtcttctggtggagatggcggacgacgtgggggccgagggcgtggacggggaggctcttccggtaagccatgaggagtggcgctggaattggcggnnnnnnnnnnnnnnnnnnnnnnnnnnnnnnnnnnnnnnnnnnnnnnnnnnnnnnnnnnnnnnnnnnnccaccccgcgcctaaagccatgcacttgtcaaaccatgcaccaggtgggcgtggcggtgccaagcagagcaaggccaccaaggaggagctggatgccgacctggacgcctacttcctcaaggatggcaagacagctgcccaggtgcagccccacagctggggtgtgtggatggtttggtgaagtctggcacgccgatgccctcccactgcatccctctcggctctcgcacgcagaaattgaactcagacctcgacgactactggtccaagaagccggctaccgccacggaggaggaggccgcccccgctgctgcagaggaggccctccccgtggaggaggataaggtccccgccgaataggagctgggaacctctgcatgcagaacaggggggacctcggggctacgcccttcccaccttccagcgcctcactcacatgactctgcccggccatcggcatgcctgcatgcctctgcaaggcagtccttctcagcaggcaattgcacatgacgctttccactctgttcagcaagtgcttcatgccacttcatggtagtagggaaaacatgaggaggggccagacctagcctagggaacaggttggcgggtgcatgcactcgttttgccctgcactcagcgacgggcacgctttgcccgtcccccggcaaccgctggctcggccgcaggggccacctcagaagccattgccttgtccccgccggctgaggcacccaccagctgtgcctgcttctgctgcttcttggcctccgccgccatctgggcccgcatcctccgcaggcagtagcgcaccgccgctgtgtgagtggcgtgcggggagcggttgactactcctggccctactttgcaggttgtttgcacagaaaaagccagcaaggaaggtggcaccccgccccgggcgccgctctagtgcccctacccgattgnnnnnnnnnnctgactcctcctggccctgctttgcaggttgtttgcacagaagaagccagcaagggaggtggcaccccgccctgggcgccgctctagtgcccctacccgattggtcagcacactatgcctcctgccctcaccctcgtcgttgtcttcctgctccatgagggcctggatgaggcctgcatcaaagtcctcatactcctcgatcagcgccgcggtgaccttgtctgctcacaatgttggatggggggtggaaggtcaggagttggtttctcgagcatgactcttgttggtccacagcatgccccagggcaaagccattgaccgcaggatcccttgcccctgtcccccctcggctgccgcatcacgcttggagcggctgtttggcgttcagtgctggacccccccaccagacacgcaccctgctgggatggaggggccggcacggnnnnnnnnnnatggtttctcgagcacgactcttgttggtccacaacatgctccagggcaaagccattcaccgcaggattccttccccctgtcccccctcggctgccgcatcacgcttagagcggctgtttggcattcagtgctggaccccccccaccagacacacaccctgctgggatggaggggccggcacggaaggcggaatcgggctcagggcctcgacctggtgggcagatatggcaggttcccgaggccccgtctcggccgaggatgccggctgctccggcgccgcagctggcgccgcgtcctcagacacgattgcggcgtcagacgcgccctcgccgtcagacacgcctgcgccctcctcggcctcctcgtcgatgccggccacaccctcctcgcccccctcgtcgacggcggccacaccctcctcgccctcctcaccagccgccccgctggcctcttcacgagcacgtgcgatgctctcctgcagcttggcgacgacctcggccatgtcgcggttgaccgccgcgcccttcaggaactccatcagatccgtctgtgggcgaaggaatagttcaagtgggtcagaagaccctgcgctgtatcaaggggccggctgctgagcagctgggcttagacctccactgccacagagctcacggccgccgtcgcctcgggaaaccccggtgcaatggtggccccggcgctgcatgccgcactccaaatccctaccacagccgccgtcgcaccttgcaggtcgggcagggcttgagctgcttcctgacgcggatggagcggatgcctgcggcgtggccaccccccgccacctcatcggcaatgccggcaaatttcttgtccaggcacgccttgcagaagttgtggcctgattttgtgtgagagaggggcggggattgcggtggtgaaagggnnnnnnnnnngagtgggtcagacgactatgcgctgtatcaagggggccggctgctgagcagctgggctcagacctccaccgccaaagagctcacggccgccgtcgcctcgggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatgggtgggggctggtgtggcaaattaaatcaccggccatccttgcaaactctgccgctgaggccccaagccacgcaggcgtcgactgtgcccgcccatgaatcgtccccgccgcctcgctgcaccacccagcaccacccctctgccgnnnnnnnnnnggatcgggtgggggctggtgtggcagatttaataaccggccatccttgcaaactctgccgctgaggccccgggccacgcagacgtcgaccgtgcccgcccatgaatcgtccccgccgccttgctgcaccacccagcaccacccctctgccgtccttgcctcctcgccacgcaccgcagggcgtggacaccgggtccaccaccgtcttcttgcagatgccgcaggcaaactcccgcagcgcgcgctcctgctccgacaggcgctttcgcacggtcttcgacccgccctcctcgccgccggcgcgctgctggctgaccggggcggcgcgggtccagccccactcctacaaaggcaaagcgggaggggcaggggcggggggggtggaggacgactttggcatacccgcgtgccgccgtttccctctgcccttctgcgctacacgactcccctgccctcccagctgcctgcccacctgcttgtcctccagccagccccaccagggcttgtctgccatggagtagacctgccccttgtcggcctgcttcatctcctccagggcgggggcgggcagcgcggcgtcgtccacgggccggtccccggtgtctggcgaggaaagaggggcggggatcacgaaacggggtcgagggtttcctacagacgcacatcccccgggacgcctggctcgaagcaaacagcgagcgtggcgctggggcatcccaggcctcactgtccgcctctgcaccctcgaggctccgcaggccgggcaccacacccctatggtcccacacgccctcaccctccgaggaccagggggctggctcattgtcgcagnnnnnnnnnnagctccgcaggccggccaccacaccccatggtcccacatgccctcaccctctgaggaccagggggctggctcattgtcgcagcgcatgaagaggtagcggcacatgagggggccctgcgcgcccggcttgcgccagcagcggacgatgcggtacacgccgtcgtaccgcacgggggtctccaccccgggggcgtacgccgagcgcttctcctgcgacagaggagggggaggcgcaggggttgagtctgatggtgagggtaggtttgggagatccagagtctctgcgcgtttcatgcgtcaggtttggccagtcaaaggatcccagaaaacactcccacagcccannnnnnnnnngggttgggagatccagagcctctgcgcgcttcatgcgtcaggtttggccagtcgaaggatcccagaaaacactcccacagcccaacctccacgccccgccagcccaccttgtaggaccgcaccacacggaccggcagaccctttgtgcaggacagcttcagcgccttgttcatgttgtcaaacgtctggtcgaaggattgcacctgggggaagagaatggcnnnnnnnnnnnnnnnnnnnnnnnnnnnnnnnnnnnnnnnnnnnnnnnnnngaagtccgcctgctgcaggcatctacagcaatggatggagccccacactgggactgcgattcctgcccgtgaccagggctcatcgacagcgccctcccgcgtctcagccccacgcctggtggccccctctcgcccaccttgctggtgcgtttgtttccagacaggtcgcgcccgccagagccggtgtagaggaaccactccccttcgtcacggtcgtcctcgtatctggcagcgcagggtgtgaggggaaacgagcacttgagatgagggggcatccccgcatgccacgcccagcctggctctgtcggtaggtgctttcctgcatgccatgcctgcccaggagctgcaccgggcccaacaactgtctctcccttgcacagtttccagccacacaaacctttgcacccttgggcaccctctcaaacccacccaccccgcggcctggacgactcaccctccggagaggaccacagactgggcccccacgttgctctgccccgcaatccccgccacgtgcgggaagtgggcgccccactgccggcagtccaggcggtccttccaccactccccaaccttgatgccctgcagagaaggacaggggcatggggccaggagtgggcggtgcacggcacgacactggaaagtgccacccagatgccgcggcagcctgtccccctcgaccccttcctcagcgccctctctgtgatacccctgagccctggccgccgcctcactgtgccacgtgggtcggcgctggcagggatggggccaaagtggtcgttgggcaccgtcaccatgatgcggccgctgggaagcaaggaagatggggacacgggctgagtgaccaagggagggcgagagaaggggcagcactctgtgagctggtgccttgatggcaccggcatagctagagcggggctagccaaggagcaaatggcagcattctggaannnnnnnnnngtggcaccagcatagctagagcgggaccagccaaggagcaaatggcagcattctggaacactcaaagaggctgcgacgccgccacacaaccccagagctcagcgcccacctggcggcattggcacgcccggccctcacagcacgatccgtggtgaaggcctcgtctgggcggtcggcgtcgttgatgctgcaaggggggagggggagggggaggggttgcgcagtgatgacacgatacaccgacacggtggagcaaggcaagtggacacaagaatccaccgtctccctcaccgctcaaagggcttggaggaggggttgacggtgccgatcttgaaggcacggatggccatcgtgagcgcggtgttgatgcgagggtttgcgcagaacttggcactgaactgcatgggtgaacgtgggggtggtgccttgttgggacgagtaccacaactgtggggtttccaagggttcggaaggagttgtcatacctctcacacaaccacagagaggcagaggctgatcgaagtccagctttttgcacagagaaagcgtgaagagcacctcacagccagctggtgtcctatccggcattgctacctgcgggcccttacacaccactgcgctccagatcaaccggtcagccctgcgtccccatacctctgtacgacaggtggggcagcatttcttcttcgacttgttgacatggtcttggaaacacttgaggcagaagttgtgctggcagggagcctgtgaggattgggggttccagtgggcaagggactgcaggtgatgccttgcaggtaatccagggctaccatcacagaggggtgccttgccatctgagatgacagccaccttgctggccatgcagagctcaccaacccagcgggttgctcacagtgacagggcgattacagagctcgtggcagatggtgcactgaagggtgttggacagcccatgctcgggcttgggctcggacttcactgcttgagatgaaatgcacgatcagaggtgatgatgcacgcagtgcaccacggaggacgtccaccgccccttgaatcagatggcgaggccccgtggcacggcaggttgccccccccgaccctcctccccacctgctccgtcctcctggtccccttcctcctcggcaggcgctgcccactttccggacatcaactgctgccgcctcaccgccttctcggcgtctgtgaggttgggatccctctgtatctccatgatacgcttcatcatcgccgcctggtccatggtgtcgtgatgctggggtgttccaaaacccgcagaggagacaggccaccggccggccgtcgcaaaaaggcacagctagcagctcgattcagggttataaatctctctgctgaaagtctacgctcacgagcttgcacgagtatgggtgcgtgcacccaaggtgcagaaggacaaactttgaattgccccgcgcgcgcagcatgccgaacaggctgcgacaggtcggccaagcccagcaagacgacacacaggattgacgatgaacttgtccataacacatacacttgagcttctgtttgggttttccacatattaatattgggactgtcgtatggccttgacacttacacgccaatgcagatgatttcagtgtgatggtcgtgtactgtactaccacctccacagccccaccctgagggggcacacgtgacaatgannnnnnnnnnacacagctagcagctcgattcagggttattaagctctctgctgaaagtctacgctcatgagcttgcacgagtatgggtgcgtgcagccaaggtgcagaaggacaaactttgaattgnnnnnnnnnnttgtactcttacctccacagtcccaccctgagggggcacacgtgacaatgaacagctgggtcgcagagtaaaaccctgcaaaaattgtttaagaaagcggtatgatgtagcacagacatctcaccatttgagtcaccactcttggcggcgcacagcagcctcgaaggacctgtataattaaggagacggctcataatccggagtatacctgcatctttctaaggtaaccttacacaagtggaaacctctcatcctgttnnnnnnnnnnagcgcacagcagcctcgaaggacctgtgtaattaaggagacggctcataatccggagtttacctgcatctttctaaggtaatcttacacaagtggaaacctctcatcctgttcatgtcaaaagcgccaaagcaaaggcttcctcacctcctccccccgcaatccccttgtccagtggtggggaacagcatcgcgcgcgtgcatgagggaccacccaaaggtcacgtctcctgtcgacgaatagcaaccacaaaatgccttacatcagtagtggcttgatgcgccgttcagtctcttgaatggaggactgcatcatcacggagcgcgaggcgcagcagatccgagagcaactgaagaaccggaggaagtctccggggaagtccaagctcgcgggcagcagcgggcccctcgctcggccaatcgcaccgagggaacccccgccagtgaagaaggcgttcaggaccttcaaggaaaggtggctgtcctgtgcgggagatctggacacgagccagcagctgaaggcggtggagcaggggatcgagatcttctcactcctgcccaaggaatccaagtacgcccagcaccgcctgaagctcctgcgcaaggtccagctgctcctcaccagcactgagtgagaagcattggttttatatgtatggtggcaagggtgccgatggggtcatctggagttaaattccagggaggatgggggccgatcctgtggtgcatgcggctccacgtacgtttgagggtcctgatgcctgcaacccccccccccaacacacacaaaaaaatcccaccagagcggagggtactgaggagcgccaggccgaactcgctgccctgcttcagcagctgcagctctgactcatcccagccatgaggatgctccgtgcactgcgctttgctccaaagcctggcaagctctggcccagaggcgtctccacatcaccatgccccggtctcgatgcagaggtggtgattgcggggggggggcccactggcctcatcaccgctctgctcctggctcgctggggggtgcgcagtgtggtggccgagcgcagcaccgcgctgactcagcacccccaggcccacctcatcaatcaccgctccatggaggtcatgcgcgccgtgccaggtgggccaacgagctgtacatgagttgggttgggagggacagacaattgggcagttgtgtattgatatctggagcccagcattcctcgtggtctggggaggtctggtggctgcagcatgctggacactcgtgggtacagcagtgccctgtcatgtcaaggcctgtgtaccactcgacatcaaagggggcccttttcatgttgaatgcatcgattcccactcccgacaggcctgacggaccaaatatgggctggagtgccccccctggaccagtggcggagcttcgtctactgcggcagcatgctgggcgacctgctgggcagcgtggaccactttccgggccaggcaagcccccacctgcccctgctgtcgcccgagccggtgacccacctgtcccagcacaaactggtgccgctgctgtggcaggcggcgctggccgatcccctggtcggggtgctggcagggtgcagcgtgcgcagcgtnnnnnnnnnntcagcacaaattggtgccgctgctatggcaggcggcgctggccgatcccctggtccaggtgctggcagggtgcagcgtgcgcagcgtgcgccccggcgagggccacgtggaggtggacatccaggagagggccgccggcacgctgcgcacgctgcgcggcgcctacgtggtggcggccgacggcgcgcggggcgggctgcgccaggcggcgggtgtggagctccagggcagcgccggtctgcagcacctcatcaacatccactttgtgtccccagaggtgcgtggattggtggagggttgatgagggaatggatgggtaaggctgtggatcgaatgatgaacagaatgtccggctgccagctcacccctccgccgttgcgccccgtccatcgaagctcttccccttggatccataccctagtcccttcatccccccgttcagcctgcaatccgctctacttaatcccctcacactatccaaaccctcgcagctggggcggcggctgcgtggcagggagggcatgctctattttgtcttctccccggccaccatcgcggtggtggtggcccacaacatcttggagggcgagtttgtggcgcagatcccctacttcccgcccctgcagtccgccgcagacttcacgccgggggcgtgctcgcgcctggtggccgccgccatcggcgaccctgcggtgcctgttgagctgcgcaccgttagaccttgggccatgagtgggctggtggcggccacctaccagccgcacagccgcctgtttttggcgggggacgcagcgcacgtctttcccccctccggtgaggcccgtgggatcgtagatgatggcatgctttttatgggtgggtgttacggggtgccctgctccaatccgtcgttatgtgtgcgactggacatcaacatgcaacgctctcaccgcagcctggccagcttagccagacgtgcaacgccccctcctctccatgcaaccccatgccctccgtcatccacaggcgcgttcgggatgaacaccggcatccaggatgcacacaacctggcctggaagctggctgcggtgctgggcaaggaggcacgcccctccctgctgcactcctactccgcggagaggcggcctgtggcactggccaacatgcagctgagcgtccagaacttttacgaggcgctacgcatcccaaaagtgggattgggattgtgcaggggggcaaaggggttggcgaaccccgactctgagtcagtgtggatgggccccactgggaggtgttgcaccattcaagaaacctccatggcattcgggaaagagggcattgattttgtatgccacggttgttcagagcggtgctaaccagaggacccaatctaaattcatgtgttgcaagctgcgccatgccatcaggaccacctcattcatactttcctccctccccactctccaacagctcatggggctggactaccacaccgccctgcggctaaacgacaccctcacctcccccgcggtcgcctggctgccccccggcctgcgccggtcggcgctggaggccggcctggcgctgggtcaggcggcggcgcccgcgctgggtacgctgcgctcgcgcaacatccgcgctgcgctggagggcggggagacgctgcgcctgcagtaccccaaggaggacctaggcttcgtgtatcgcagcccggacgccgcactggcgccctcggctgccgacctggcggaggtggacctggcggcgcggccgcggccgcggcacgcgccctacacccccgcgaccctggtcggagggcggttgccccatgccgcggtggatgccgtcatctcccgcggttggctggccgggggggcggctgggccggcctcgaccgtggacctgtcctgcctggccgccagccccacgcccctgctcctcctgctgccttccggatacaaggctctggaaaggagggcatggctggccgctgccgaacggcttggcccgcagcgggtgcttcctgtggttctgcatctcggccgtgccccagtgggggccgccgccgagcgaaccaatgccctggagctgcagtgtgacccggcatcaggtgcttgggcgactaccgggggcgcgcgggtgctgctggtccggccggatgggcacatcggggccaagtggagcgagcaggtggccgacgcggggcgggcgcagggagccctggagcaggcgctggctgctgttatgcattgcgcctgaacctgagcgttaacttttcattccctctgcatattgatttggatttgcacttttgcattgtaaagccgatgccacggccatggagggtagggtagggagagatccttcagcaggattttcactttcccgcgccgtcgatcccggcctgtttcagacaactccaccccggaaattgcacccccaccccaaagctcatctgggcaagagggccataggactcagacagtgcactttgcaattaaaaagactaccattctaacaatggcgtccttcgagaacttcgatgacgaccgcgaccagatatacatcagcgggctgccccgggatgtcacagaggatcagctggcttcccacttcgggcagatcggtaccatcaagctggacaagaagaagcgccccccgacgcccaaggcacgcatcggggtcctcgatgtggcgggcaacggggcgcgctggctgcgtgcaagacatccccagccttcccggatagaggtgcaaggcttcgctcatcctcccggcacccatgtccctcccgcagatctggttgtaccgagacaaggccaccgggcagctgaagggcgacgccaccatcacatacgaggaccccttcgcagccagtcaggccccttcgtggtttgacggcaaagaattcttgggcaagtgatggctgccctgggtgtccggtggtgttcgggggttgggtagcacgcctgtggaccgcctggccagccccgcgtccaacccctgctgctcggacaacaacgaaagcagggaagaccctgcacgttagcttggcggagaagcccagagctgcagccggcggggaggcctacggtcgaggtggaggaggtggtgggtatggcgccgcgccgggaggtggctacggcgaccgcggcggctatggtggtggcggcggtggtggagaccggggcggctacggaggcggtggcggcggttatggtggcggtggcggcggctacgggggaggtggcgaacgcggtggatttggtgcgtattttcagggtctcgccatggggtcctctttgttggctctggtctgatgcctgtgatcggtttgcaccttcaagccagctgctctctcccctccgacggtgccacctctgttgaacgcagcccctgcaccccctgacacctggctgtctcacacacttgcaggtggcggtcgtggccgcggcggaggcggcgcgcgcgagggcgactggctctgccccggctgtgggaacaattgcttcggctggcgcgatgtttgcaaccggtgcaacacgcccaagggcgacgccggggccggcggcggcggcggcggcggtcgtggcgactttggcggcggt

SEQ ID NO: 34969 - DNA, 79 bp, Chlorella protothecoides
tggtgactgcagactccgtgcgcgcgcgcagactctttggggggggtcccctttcggtttccgatgacattcgctgggg

SEQ ID NO: 34970 - DNA, 61 bp, Chlorella protothecoides
gacagctttgaagagccgcccgagaccgacctgaccttgctgtgcatagtgggcatcaagg

SEQ ID NO: 34971 - DNA, 118 bp, Chlorella protothecoides
ctgcacgacgctgcggccaggcaagggacacccctaccgaaggctgcgtctgggacgatcacacctggtgatgcggcaccaaggagtccgccaaacctctgctggtccccttttgtga

SEQ ID NO: 34972 - DNA, 133 bp, Chlorella protothecoides
gcccatcccccaaggccagccccagccccaccatctcaccttcaatccttgcacctccgcccaccccttacactccatctccatcagcttcccccaccccaaaccccagccctacagtctctccctccattac

SEQ ID NO: 34973 - DNA, 75 bp, Chlorella protothecoides
tggctgaggcaccagtgagacttctcaaatcgccccccctcccccctccctcccccaccacacacacatgccaaa

SEQ ID NO: 34974 - DNA, 61 bp, Chlorella protothecoides
tcccacgctgcgccaagcgccgcaagcgctagcgtggacgctgctgggcgtatcaatggct

SEQ ID NO: 34975 - DNA, 70 bp, Chlorella protothecoides
ggacgcgaagcaggagccagcttccttacccgctgtcatcgtgcggacagcattgaaccatggtacacgg

SEQ ID NO: 34976 - DNA, 107 bp, Chlorella protothecoides
ggccagcgtgggcagcacgggggcggcgatgggtaatgcggtgccggttgcgaggcgctgcacgcccagcgcgccacagcaggccgcacgcgcggccaacagcgccg

SEQ ID NO: 34977 - DNA, 61 bp, Chlorella protothecoides
caggcccccaaggcggagccgctacctctgattcggctgaggcgggcgggtccactgacgc

SEQ ID NO: 34978 - DNA, 80 bp, Chlorella protothecoides
atctttccctgtgttgcctggtcccaaggcgctgcatccatccatacattaccgcccatgtatcccaatgtcggagcgac

SEQ ID NO: 34979 - DNA, 222 bp, Chlorella protothecoides
cgcgtcgctgggctgggttatcctcaggttattgtagccgtgggcaatggcgacgtcctccaccacgtcacaggctggccaggagaaaaggaaggcagatgggggccagtgtgggaggtgtgaggctcggacaggctagcccagcaggtgggaagtctgttgggttgcaggaaccaacccgggcccccccctctggaccatcttgcgtcaggagccatcgcc

SEQ ID NO: 34980 - DNA, 87 bp, Chlorella protothecoides
ccgcgccctgcgccgaggcatgggatgcacatgttgggtctcttgggtgaagctcaacctgttcagaaggacaacagaggttgcagc

SEQ ID NO: 34981 - DNA, 78 bp, Chlorella protothecoides
cccccccccccccccccccccccccagatctcatcccaaaagggcacacaccgtcggggcggcacagggtgtactcca

SEQ ID NO: 34982 - DNA, 61 bp, Chlorella protothecoides
gtttcttggggtgtttctttggggtgtttgcatgagtgctgcagactgtccacctgttgtg

SEQ ID NO: 34983 - DNA, 65 bp, Chlorella protothecoides
cgtcgccgcgccatcggtggcctccgctttcacacgcgccgccgccgcgccatcggcttcctgct

SEQ ID NO: 34984 - DNA, 268 bp, Chlorella protothecoides
ggtgcgtgtcggggagtgggggtgggtaggtgcgtgtcggggtgctgggggcgcagcacccaagttcgagcgtgcttccccttcggcgattgcccgagaacgcatggccccccttgcacatacggcgtgggcatcgcggcagccagccacctggagtgtctcgttcggcaggagatgcaaagcataggacagggcaccctcagcgtgtgggcagtgcggttcgcacatgggcggctgattttttgcgcccaaaggagctcaccgcttc

SEQ ID NO: 34985 - DNA, 61 bp, Chlorella protothecoides
ggaattctggagcctcagtggttcacgatcccagccgattgccgtagccgacccagtctgg

SEQ ID NO: 34986 - DNA, 61 bp, Chlorella protothecoides
ggccggcctactcatgcagatcttcttcgctgctgtcggcgccagcggcgacgtggcggct

SEQ ID NO: 34987 - DNA, 61 bp, Chlorella protothecoides
tgagaagtttgcagaggcacgggacgagattgagtacgcccaggaggatgcagagacggtg

SEQ ID NO: 34988 - DNA, 125 bp, Chlorella protothecoides
tgcccatcaccttgactccctcccctgatgcctcaagccggcccagcaacagcggcagttcacaggcccacacaccggggtcacgcccacccctgcccccctccctgcctacatgtagtacacat

SEQ ID NO: 34989 - DNA, 8092 bp, Chlorella protothecoides
  modified_base (136)..(145): a, c, t, g, unknown or other
  modified_base (337)..(346): a, c, t, g, unknown or other
  modified_base (587)..(596): a, c, t, g, unknown or other
  modified_base (751)..(760): a, c, t, g, unknown or other
  modified_base (840)..(849): a, c, t, g, unknown or other
  modified_base (1455)..(1538): a, c, t, g, unknown or other
  modified_base (2350)..(2359): a, c, t, g, unknown or other
  modified_base (2909)..(2918): a, c, t, g, unknown or other
  modified_base (3552)..(3561): a, c, t, g, unknown or other
  modified_base (4000)..(4070): a, c, t, g, unknown or other
  modified_base (4235)..(4244): a, c, t, g, unknown or other
  modified_base (4838)..(4847): a, c, t, g, unknown or other
  modified_base (6004)..(6013): a, c, t, g, unknown or other
  modified_base (6450)..(6459): a, c, t, g, unknown or other
  modified_base (7076)..(7085): a, c, t, g, unknown or other
ggtcggcctgctttcgagcgccggctcaacgtgagactctgcgctgcaactcccatggccgacatgctcccccccctcctcctgctctcccccccctccccatgccatcagtcatggagcgcagcgtgctgggcgnnnnnnnnnnccgcctgtttaccatcggccgattaacaaccccagcgtcgggcaggggggcgcatcgggtcggcctgctttcgagcgccggctcaacatgagactctgcgctgcagctcccatggccgacatgctcacccgcctcctcctgcctcccccccccctccatgacatcagtcatggagcgcagcgtgctgggcgnnnnnnnnnntggtggacccaccgagccgtccccgccctgctcgactggctggcgcaggacgccccgacggcgcgcaggaggctgtgaagccacgcatgcgcacccggcggcgtacacggagggcgacggccagcgcggagctctcggtcgcttcccctgcgctgggtccccaggtggtccctcctagaatgtgtcccctgatgtcctggtgcacgcttccgcggcttcaagcatgcagtctgacatgccnnnnnnnnnngtgcgcacccggcggcgtgcacggagggcgacggccagcgcggacctctcgctcccttcccctgcgctgcgtccccagatggtccctcccagaatgtgtcccctgatggcctggtgcacgcttgcgcggcttcaagcatgcagtctgacatgccnnnnnnnnnncgcgggccgcgccctctttgcacgcccaggcacggttcccggtctgggacccacgctgccgccgctgccccgccacgcgnnnnnnnnnntgccgtgtgcacgagaacagccctcacgcggccagacacgggtttgctgtgtggttacaatgggttgcatcggccggcccctgggtttgatcccccgccaaggcacgggccacagagcaggcctcagcgcgtctggctgcgcctgatgaagaatgcgtccaggggacccgcagcgggccgcgccctctttgcccgcccaggcacgcttcccggtctggtccccacgctgccgccgctgccccgccacgcgagctcctcgcgctgcagggccagagccagggccaggctgtccctctccccgggcgccgcactggccagaaggcccgctgcgccgtcaaccagcgcggcgccccccagcgtcagcagctcgcgctccagcgcgggccggggctcgccgggggaggtgccggcgggcgccgaggcgccgcctcccagcgcctggcggatgcccggctgcgccggcggggcgctgggtggggctatgcgggcctcgacgggctcccgctcaccgagctccaggcccagcgccagcctggtgacctcgggagcccggcactgcgtggccagcacgctcgcggcggcctgcgccagcgccaactcggcgcnnnnnnnnnnnnnnnnnnnnnnnnnnnnnnnnnnnnnnnnnnnnnnnnnnnnnnnnnnnnnnnnnnnnnnnnnnnnnnnnnnnnacgccgcggcggaggtgggccaggagcgtgggggccaccgggaacccacgacgcaggcagccgctctcgtagccggcgcgccaggcgaggaaggcccgtcgcggcagacacccggtcttcgccgcgtgggcgcacgctcgcgcggccgcctgcgccgccagctcccgcagcgcggcgcgcgccgcgtctgagcccggggaagccggcgggaagctgcgctccacgaccagggagcgctgcggtcccctgggtaccacggggcgagggtcctgccagcgcacgtggcggcaaagagtttgtaaagggaaaggtatggacacggggttggccgcccatgatacaccacagtgacggtctgggtgtcaaagcgcttgtgaccgcctctggccagtagactcggagcagagtaccagcatgcgccccgccatctgtcgggcacgggatgcgcacccacaccaagccgctgtcatacttgtcccagacactggcacgaatgactcccgagcagccccacctgccccgcgcccagcgcctccaagaaggcgcccctgtcctcgccaaacaggctgacgaggcgtgcgcgaggaatgcttgccaggtcggccacggcgtgcacgcccagctgggagcacacctccgcgccccgctttcctttcaggccgggaatgctggacaggggttgcgaccgcacaaaggccaccgccacattgtctggcacgactgcgaggcagcagcggagagttgggaggggagataccggggggggtcggctgcagtgcccgcaagcgctgcgatggcactgctgtggatgnnnnnnnnnntagcggagagttgggatgggagataccgggggggtccggctgcagtgccggcaagcgctgcgatggcactgctgtggatgtggccggcggtcgaggtgcgaatgcggcaccatgcgcatgtccggagggtccccacccgaatgcaccccgttccaatctattgtgcacagcgtcctatgcaaaaccctcaagcacggccccctccatggctcacctgtgagcccgtgcggcttggccagcggggacgccagtcgcgcggccagcttgctgcgcgccactccgcaggacaccgtcagccccacggcagattggaccgcgagctgcgcatgctgggcctggacgacgccccgccggagatcaggtgccagcgccgtccagaggtcttgggtgaaagaccgcgcctcggctccctgccctgcgaccgccttcaggtggggcgggaagggcgcagcggtggcagcctgggactcgaggtccacagggctgccgacccctttggccgactcgggcacgccagacatgtccaggtagaagtcgtcgtacgatgccnnnnnnnnnnaaccactttggccgactcgggcacacccgagatgtccaggtagaagtcgtcgtacgatgccttctccacagccacccccggccagagcccgcggagggtctccaggacctggtctgccacctgggtggagaggagacagcaagggtacaaggtcaaatactggttgcacagtacctggggcctctcccatgatacggcaagggccgagcgtgtgcaccagcactctgacatgtgaccctggcctccctgcgctcttccccgcacacctgtcggtaccgatccaccctcatgggccggatcacgaggccggggcaccgagcacggcaagtgtcggcgctcgcggcttccatggccttcagccagggcaccccctggcgagcccctggaccggccccatccccgcacgggatgcccgcggccctggcctgcagccatgtggaggggagggtctggatgttcgctccgagtccctgggtcgggagatgcatgcgaccagcagcggctgcagatcagccagcctacgcttgcctccaagaccagtggctgggacacggctgggggacgtccacgaggttgttctgacatctcatctcaagccgagcacccgtaccaagccctgtcacacctcgtagcnnnnnnnnnnacgaccagcagcggctgcagatcagccggactacgcttgcctccaagaccagtggcggggacacggctgggggacgtccacaagcttgttctgacatcccatctcaagccaagcccccgtaccaagccctgtcacacctcgtagctcactgccacaaagccgccgccattgaactgggtgacggccaggggcacggcgcagaggccggggtcgtcaagccgttccaccgcgcagtagaagctgtccacatcgcagtgcaggatcagctggtcccttgcgggtgcagggcaccgggctcctgcggtctcgccgtctgtagctgcgccgggcggcgaaagatcactcgcggcaccgccgcaccgcgccgcgtcaggcggctctcccaaatccctcgcgccgccgcccagcgccgtctcggccgatgcaccagaattcaccnnnnnnnnnnnnnnnnnnnnnnnnnnnnnnnnnnnnnnnnnnnnnnnnnnnnnnnnnnnnnnnnnnnnnnnccctcctcgccccagtcgaggccagcccctcttccagtggcgcctccaggcatgtggcctgctccactccctgccccggcggggatggggacggggtcaaacgcagcagcgccccggcctgcggctcgtgcagccaggtcccgagcgcagcgctcctggctcttnnnnnnnnnntggggccaaacgcagctgcgccccggcctgcggctcgtgcagtcaggtcccgagcgcagcgctcctggctcttgctggtcgggggcggcagggcccgtccccgaccctccatgccgccatagtctcggcggctggccgcggcggccagcgccgctcccctgcccagcgcagacggcgcggcagggccgggctccggcggccgcgcaggtggagagcgtcggaggtatgccgcgatggaggagtggccggtggaggacgcgcgaaaccccgtccccgacaggtttatcagtgtgaggtcaaagggcggggtcaggctgccgcgcagcgtgcgcagcgcggccgcggccagggcccccgcctgcgctgcggcgtccagcccggggtcaaacgcctcgctgggcagcctgcacgactggctggggcgatgggcccaggactcacgtgaccggtacttcactgtcagcgtttccgcaaagcgtccatgctcctgcatacatgtgtagttgggagtgggtgtgggttgggggtggagattgcgcggtgtggagagctcagtactcgctgcgccgactcaaattgagctgcagaggcacnnnnnnnnnngcgtgaccggtacttcaccgtcagtgtttccgcaaagcgtccatgctcctacatatatgtgtggtcgggagcgggtgtgggtcgggggtggagactgcacggtgtggagagctcagtactcgccgcgccgactcaaattgagctgcagaggcacacacagtcacgagatcagaaggtcaactccgggagttttgtttgttgccattcctcaaagcgccctttccagtataaaggcaagagctgccctctcggtcagcacagaacccacatgtgcctcttcgtgcagccgagccagcaggtcgggagtcagcacggccagcactcgctccaccccctgccagctgtcgcaggacttgaaggagtcctccacgctcacggccttggtggggccacgcacggtcaccggggtatcatcctggaagcgagaatgggtgggagacctggcgtcagacgccaatgatgtgagaggaccttcacagcgtaccattaccagcccaccagcacagcccgcgccccgcccaccttgccccagcagagccgggacagcatgcgagccaggcgctccccaaatgtgtccactaagatgtgcagcgggatggagcgcagggcctctgcactgtgcacccccatctcctgaagctgcgcctccattttgtggcctatcagggtgggggtggcggcggcggtgggcagtgccgcatgctgctatgagacctgaaatccccatgcctgtggccgtcacattctgctccttcctctgggtgcacgctacccccccactcccaccatgcatacctatgcctggcagcgctcggaccggcagggggctgacaaacgcggcggcctccggggggagcaggatggtctggtcgtcgggcttgtgcagacccgacacgagcttggcaaggaccttgttgcaggcaacgccagccgaggtccggatgcccgcctccgcctgcatatggggagggcggcgaggcatgggattgcgggtttcttgctgtgtgcctggttcctcagggagaggcggctcgcgcacagaggcccagctggctcttgcgagaaccgggcgatctgggccagtcagatcatacactgcatcaaacaagaatccttaaatcaacaccattctccagcctgccgaccttgatggcggnnnnnnnnnntgaggcatgggattgcgggcttcttctgtgtgcctggtacctcaaggagaggcggctcgcgcacagaggctcagctggctcttgcgggaactgagcgaactgggccagtcagatcatccactgcatcaaacaagaaccctggattaacatcattctccagcctgccgaccttgatggcggctcgaatctccagcgccagcctcgacccggccgccaggcgagcctgccacccggtcccgctttcttcattctcgggcgcggcatcgcccgccggcggcggaatgcacggcacggcacgcaggtcctggacgcgatgccgcgagtcagcctccacccgctggccggcacgatggacatgccccacataagctgcctcactgggtccagcaggaatgactccgagcgtggcggccctggcgtgcaggcccgctgcgcannnnnnnnnnggcctccacccgctggccggcacgatggacgtgccccacataagctgcctcgctgggtccagcaggaatgactccgagcgcggcggccctggcgtgcaggcccgctgcgcagaccgcggcccgcccctccacctctgccccgacgtccacgaagagctcatccagccccagcagctcagctgggccaaagcgggaggccacctccagcatcctccggctggcggcccggtaggggcccaggtcctcaccgctacaagtggggcattttgagtgaatgttttttcaggaggcccccctccggacccttgtcacaggccgggactgtgattcagggcccgttagagagtcaagccagtgcatgcatgctctcccccacacactccccacctggcgaggaccaggttggggcagaggcgctgcgcttcctggattcccatcagtttgcggacgccaaactcgcgcgccacgtagttgcaggtgaccaccaggtacttttgcgtcacacctggaagggtggcggtggtagactgaggggtgatgcttgcgttgcaccatgcatgggcggcagtgacagcagggaagaggccccaagtccacatcctgccaactgcgttccnnnnnnnnnncttgcggacgccaaactcgcgcgccacatagttgcaggtgaccaccaggtacttttgcgtcacacctggaagggtggcggtggtagactgaggggtgatgcttgtgttggaccacgcatgggctgcagtgacagcagggaagaggtcccaagtccacatcctgccaactgcgttcccctcacccaggggtctgccccgcaggctcggatccaggagctcctcgcactgagcatagaagccgtcggcgtccaggtggacgatgacgcggcccgtgtcgggcgggggcggggtaaggcatgcgctcatggctggcaggctcgctcaccacgccatgcccccgtattcagccgcatgggacttcgggaatgttgtcggagcctgtgaacagctgaatggatctgagtaatcttggtgtccctatttaatggaatgtagtgaggacttgggcgtctcgagctcccgcaagatcacttcccgggcacctcctgggagcgcccacccgccgctcgaggaatggagtttggtgataccatgaaaataaggctgggcgcggtatcatcaacgcgcgcgtcgacagattgaggctcccctctcttgcgccgcgagggacggtatggtgccaccccagcgatgtgcggcgatggggtgttgatgatggcataccccaataccgcacctcaacccccccggtaaaaggtctctgcccatgcccagcaggagattttgtgagtcaaacggcccaggtgataaaaggcttgaggatgtggtgacgtcaatgagaaaaatcggttacacgtcgcccaaaccgagcgtgtggcatgaacccttggccatggcgccatcaaaacccaaaaacgagcgtgcaagtaggatcacacggcaaaatttctctcggggaacaggtgcatcaggcacggctcgaccaggcgaggctccccagcatggccacgcctggggcgtgcgcgccgccatccgctcacacccatgcgcctccctccccccccccc

SEQ ID NO: 34990 - DNA, 91 bp, Chlorella protothecoides
ggctcagcacaggacaatatgacggcacaaccttcagtattatattcaaatgcagcctggttcgctgtgtgcgcccgacctaataagcata

SEQ ID NO: 34991 - DNA, 69 bp, Chlorella protothecoides
gcaccgccaccgcagccgcagccgtggcgaatcgccggagaggaagcgccgccaccgcagccgcagccg

SEQ ID NO: 34992 - DNA, 76 bp, Chlorella protothecoides
cgcgggacagcgtctgcttccgctctcaggatcgagcggagatccccgctgtggccctccattccaaaccaaacca

SEQ ID NO: 34993 - DNA, 72 bp, Chlorella protothecoides
tcacaccatgcaggcatgccggggaggaagaatgtgaattctatgggagcggtatcatcttgaaagctcagc

SEQ ID NO: 34994 - DNA, 202 bp, Chlorella protothecoides
tccctggacgcctccctgggtctgcgcatgagaggggggaggtgggcatccatactggaacagctgtgttggctgtgaacagggcggcctacagtacagaaccgcaaagcaacctgccgcatcaatgataaaaggtgagccatagcggtgctctctccctgcaagcttgcaccaagccacccaccttccacacacggctggg

SEQ ID NO: 34995 - DNA, 90 bp, Chlorella protothecoides
gtggtgctgccagcgcctgcacaggaccccctcctaacctgcatttctcctcttcctcgacagacatgccctctggctgatgggggcacc

SEQ ID NO: 34996 - DNA, 74 bp, Chlorella protothecoides
ccgccagttccagcgtgttctggagatggtgcgtggcatccgcagcctgggcatggaggtgtgcaccacgctgg

SEQ ID NO: 34997 - DNA, 61 bp, Chlorella protothecoides
gccatgcctgtcgctggtgtgggatgtttgcgagcgagggaagcaccttccgtccgcactc

SEQ ID NO: 34998 - DNA, 183 bp, Chlorella protothecoides
gggggggggggggttgagggtgtgaaggggggagggagtgagggtatgaaggggcctggaaggcgtacctcgatactatagatgaggactgcacacgtgctcgtgatagggacagtgcaagaatcaggggggccaagaaggggccgggcaaacatcctgacgccaggctggggtcccaacagt

SEQ ID NO: 34999 - DNA, 61 bp, Chlorella protothecoides
ggagccccggctctccgccgagctgcgaatgaaactccggagcagtcgggtgaccaggggg

SEQ ID NO: 35000 - DNA, 211 bp, Chlorella protothecoides
aagcaacgatacgaggcacgcagatggggtcgtgcgcttcttgttgggggggatatggtgtgtgtggactgcatgggggacctggcctcgtgcggccatgccgaaggcagcgccccgccatcgggggcggtgtgcgaccgctttcaccgcggcttcggccgcgagcgctcggtgcccaccgatcgctcagtagccgccgtagccgccgtcg

SEQ ID NO: 35001 - DNA, 85 bp, Chlorella protothecoides
tgcacaggccggtgaccctgcagcgtcagcagcagcagccgccgcagcagcagcagccgcagcagccgccgtcgcagcagccgcc

SEQ ID NO: 35002 - DNA, 77 bp, Chlorella protothecoides
gcgccccgggcgcgaagcccagagccctcaagtgcgaccgtgtgccttgggtgcagcccttacttgtgtcgtctgtc

SEQ ID NO: 35003 - DNA, 70 bp, Chlorella protothecoides
gtgcttggaaccgtgactcatgcctccccctcccccccccacgctgcctctgggtcctgaccctcctaaa

SEQ ID NO: 35004 - DNA, 399 bp, Chlorella protothecoides
  modified_base (89)..(288): a, c, t, g, unknown or other
ccagcaagtggatggacgtgagtcacagaggctagtttgcgctctggtgtcgacgccagagagtcgtgctcttgcagtggacggggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtgagtttggatggcgtgctgcaaggcttgcccggggccctgatatgggagcagagtgcggggttgaatgctctgcctcgaacaaatccctctgcacccctctggtcca

SEQ ID NO: 35005 - DNA, 127 bp, Chlorella protothecoides
gggcggagagctgcccgcagataacctgaccctttaccacagagggtgaggtcttacgtccaaggaccctcgaccacttggagtggagaacccggagtgtcccctcatgtcagcctccctctcaggg

SEQ ID NO: 35006 - DNA, 93 bp, Chlorella protothecoides
ccgccagggagggccagcaccagtgcgacagaagggagctaaaacagactctcctcctcacatattggtatgtcctgggtacagctattggcc

SEQ ID NO: 35007 - DNA, 73 bp, Chlorella protothecoides
caggccggcgtgcagggcggccatgacaaggaagagcggcacggacttggcgcccgcggcctccaccaccgcc

SEQ ID NO: 35008 - DNA, 3375 bp, Chlorella protothecoides
  modified_base (1141)..(1150): a, c, t, g, unknown or other
  modified_base (1806)..(1815): a, c, t, g, unknown or other
  modified_base (2085)..(2094): a, c, t, g, unknown or other
actgctcccaatcctcgccttcgctgtgagagcctggtgggggtggcgcgcgggcttggggacggctgcgccgacgcgagcaggggcagggcgaggcaacaacacctgcgcacctccatcgcgcgccgcgcgcacggccgagttggcctggctcccacgccgctgcgggcagtcgttgccgcggtggcccctgtcgccacagttggggcaggatggcgtcgcggaagtcgtcgcgcccgaggtgtgcgaggcagccgggctggggcgcgcggggcagtggccggtggacgccgagcccgtcgccgcgccgcgcggggcaggcgcgccaccgctggccctgttggaccagggacgcgtctgcccgcgttcgcgggctggccggggtgccggcagcagcgcccccgccgatgcctccgcccagccagccgcctctaccaccgcgtcataagtcgtggcatcgcgcaccgcctccttgttgcgcaggcgcgggtggagcccagcgcggaaggatgcccggagctcgtcgtcgacgagaccctcgatctgcacggcgaggaagcggtgctcacgagcgtagtcggcgacgttgccggccttcgactagcgtaccgcccagaggtcctcgcgccggggagcgcgccccgcaaagggcccgaagtgtcggtagaaccgctgccggagctcctctgtcgtcgtgacggcgggggtgggccccctgatcaacgctcgcgcccagctcccctcggagccccgcaggttgctcgtgatgacgtacaggcgccgcttctcatccacctcgtcatggaagtcgaggtgggcctccatccgctcaaaccagcagatgggagactcctgcgggtccttctcccggaagatgtccacgatggccggcttaggggtgatgtagcccccctggcctgtggcccggagggccagagctcggagcgactcgtaaagctccgcatctcgctcgcgggcggcctggcggtcagccaggagctctgccagcaccctcaaggggtccacggcgctcggcgccgggacgcggggagcgccgggtccggcctcggggtcgccgtgggcaccgaggtgggtggctgtttggctgcaggcgccgtgtcaggcgccgggtctgcgccgnnnnnnnnnncgctagcaccctcaagtagtccacggagctcggcgccgggggcgcggggagcgccgtgtccggcctcggggtcgcggtgggcaccgaggtggttggctgtttggctgcgggcgccgtgtcaggcgccgggtctgcgccgtcttccggcatgaccgtgttggtcgcgtactctcgccggggtgttttcacgatcttgtgaggagggcttggagccctggggccaagatatgaacttgtttccgacaccataatgttgtggggacgggtcagaccctacaacgtggactgctgtatatcacctacaaaagtaggaatgttacacgacaagaccacgagtacggtgaggggcttgggtttcaggcccggtgccgggcggcgtagagggatgcagggcacggatgcaggtggacagggtttacggttacggagagggttacattctgggggaaccccggttttcgtttatgggccctttttgccccctcttgcccactctcgcgacttgtatcagaagaatggtgcatataaagacgaaccaagcttgttagaggccaatcgggtctatagagtcaaaggtaccgagtgtaaaaaaatcacgtgataccgggcaccccttacgtcatcatcccagccgtccccgagactttcggaagtgnnnnnnnnnnttaagcccagagcatatctatcctttctctgaggcaatctgcgcctattatctcaaccaatctcctctgtacacactcccctggaggacgagccccccccttccgtgcgtcacttcaaggaaggtacgcaaaggatccagcctggtacagggttctttctgttcacttgtttttaaacattttgggcccttcttttgcattttcttcaatttgtttatgtcttttttaaattttttggcatgattctcgctttggaggtcgggcaggtgnnnnnnnnnnacttgccgtgctgtgtcccgacatgtgccaaatttggagaccctgtgttgttggggcaggttagaccctacaacggtggaccgctgtacatgaattgaacgagtaggatggtacagaacaagaccaccgatacggtgaggggctagggttttaggtacggtgcgaggcggcgtagagggacgcagggcacggatgcaagtggaaaggaggaaaagggacccaaagagggcgcccccacaagatccgggcacaccagagtgggtggagaaggatgtcgccagctgtcgcatggggaagacaaaccctgcaagcatggcatcaaggtctggcacacgatgtgcccagcccctgccgaccaccacatgaagtgctgtctggggtcgaaggcatgatcaattcaaggtggcttcgaccgcgcgtgcaggcgttggtgcagaaggacaaggatgctgcagcaagcaggggtgaaccacgagatcttcacggtggtgctgttccgtaggactggcccccatcctcttaccccagtgccacacaagcactccaacccctctcacccacaccaaaatgccgaacaaatcgacccacaacacgtcgacgcagagctcgtcacagcatccgaggccggcaccagcaggaggcgcggcaaggagccggtgccagaggcagacccatcgctcgacatcactcccgaccaggctacaacacccacagagcctgacaatcaaggacccgctgtagtgacaccctgtggacggtagcatcggcgcaccaccactgctgagcatccctgacaccccggctccttcactcgggagcgatccagggcttgatggagcactccagaagctggtgaccagggtcaacctgaatgcggagaaggaagtgcatgcgaagcatgaagcactctacaagcaccccatggaagctgatccgcatgtgctgcccgtgtggtcggctgagaccattcctgttgtgagggcgggctggcccccacaatggtggtccgctgtatatgatctccaaaagtaggagtgttacagaacaagaccccgactatggtgagggggcttgggtttcaggctcggtgccaggcggcgtagagggatgcagggcacggaggcaggtggccaggggggaaagggccccgaagagggcgcccccacaacaaccatccccctccccactgcctagcccacccccaagcccacctcctcccaaccctccgcctcccagtactccaccatcccacccgccaccatctccacccccaggccctcc

SEQ ID NO: 35009 - DNA, 87 bp, Chlorella protothecoides
cgggatctgtgggcgggaggggggcagggtaggtttgcgtgtgtacacacatgatgcgacattcatgcctgtgtgtgtccacaagag

SEQ ID NO: 35010 - DNA, 9028 bp, Chlorella protothecoides
  modified_base (169)..(257): a, c, t, g, unknown or other
  modified_base (1115)..(1124): a, c, t, g, unknown or other
  modified_base (2218)..(2304): a, c, t, g, unknown or other
  modified_base (2432)..(2441): a, c, t, g, unknown or other
  modified_base (2535)..(2667): a, c, t, g, unknown or other
  modified_base (2753)..(2762): a, c, t, g, unknown or other
  modified_base (2848)..(2857): a, c, t, g, unknown or other
  modified_base (3055)..(3090): a, c, t, g, unknown or other
  modified_base (3877)..(3886): a, c, t, g, unknown or other
  modified_base (4164)..(4173): a, c, t, g, unknown or other
  modified_base (5130)..(5139): a, c, t, g, unknown or other
  modified_base (5229)..(5238): a, c, t, g, unknown or other
  modified_base (5975)..(5984): a, c, t, g, unknown or other
  modified_base (6539)..(6548): a, c, t, g, unknown or other
  modified_base (6717)..(6726): a, c, t, g, unknown or other
  modified_base (7625)..(7634): a, c, t, g, unknown or other
  modified_base (7830)..(7839): a, c, t, g, unknown or other
gtcgcccgcgcgcccgccggcgcgcccgccgcgcgtgcgcgaccacgttccgcgcagcgtgcggcggttgtaggtgacccaggggtgctcggccagcgctgcggcggaggggcgctcgcgcgggtcgcgcgcgaagcacttgagcaggaagtcgcgcatggaggcggannnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgtcggccacaatgttgtacagcgccgacatgggctgcatgtcgtagtagggcggcgacccggtgaacagctcgatggccaggcagcccacggaccagatgtcgccggcgggggcgaccgcgctgtgctcgatcacttcaggggccatccagtacacggtgcccacgggggaggaggcggcggggccggggccggccagcgcgccgccgccgcccgacgcgcgcgtgtccaggtcggagagctgcgccgccacgccaaagtccgccagcttgaccacgccctccttggtggtcaggatgttggcgcccttgatgtcgcggtggaccacaccctgggcgtgcaggtatgccagcccctgcccggggagtgggttggggtggaggtgtgttggtgggagtgtgggagagacttgagccaggcaaaggggcatgcacagtgtgggtgccgcgcccacatgccttcctgtctagcactcgcctggaggacctgctggacgtacacggccaccagggtctccgggaaagggccaaagctcgaggatttgatcacgccagacagggcgccgttctccatatactccagcacgatgtactgcatgtgggtggagagctggaatgagcagcacccggcaaccactcgcgtgatggcagggtctcttaccccggctgcaaagcaagtgggttgcaaacgccacgggggcccgagaggaatatactttgggcacacgctgcatgctcctcaatcatcaccccttcacacccatgtgcggcgcagcagctctagagcaggctggaagattcacaagtcagtgcaatcatgtaaagtgagagccaccagcactaaccaggtgggtgnnnnnnnnnngttaccccggctgcaaagcaagtggattgcaaacgccacgggggcccaagaggaatatactttgggcacacactgtatgctcctcaaccatcaccccttcacgcccatgcgcggcacagcagctctagagcaggctggcaggttcacaagtcagtgcaacaatgtaaactgagagccaccagcactaaccaggtgggtgtcggtgcgcagagagccatagtacttgacgatgttcgggtggttcagggtcttcagcagctcgacctcccgaacaatgccctacgacaatgacgaatggggccatgaccgtacctccccaggacaggactgccaccatcgcaatcaggatgacaggcgtctgcccaacatccaccccccccacccctcctaccgggaggcctccggcagggatacgctccaatccgatttgcttgatggccacatgctggccggttcgggtgtccaggccgcggaacacgtgtccgtacgcaccccgccccaactcctcgcccaacctggaggggggaacacaaaccccgcggtgggcaccgtgcaacgtgcatcggagaggcttgtcacccctgccacaccttgtctccgacaacatacctgtatttgtcgctcagggtcttgggaaaggcctggcgttgcagacgatggggtgagaggcccacgaaccggtttggaggccgctccgaggaggtgcccgggttggagtccgccacatcagtactcatatctccaccaggaagaggcaagaagtatgattcaggactcaggcgccggggcgagtcctggcctccgacatcccaccagcatcagcagtgaattggggggacaggcctgaccggtgtgggtttctggtcccagcccctcaaacctccgacacgacgaggcagcttggaatattgcgcggcgagcctgttcttgtctgctcggatgttgtttacgtctgctgcatgccagccccagactcgtgcatgttgggcaaccgaggtcgtgccccgtgtgctaccgatcgtgtcagtttcggggctgggaggaaagcagggcacagaacatctgtgttggagggccagatggtgctttcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagcagtgacctccgttctccgcatgacgatcttctccaagcttccccaggcatattcgtagtgcacgaatcacgtaatatcattaggaatgtatcaatccaccttgtgtaaggggtcctgtcagnnnnnnnnnnactaaagtatgacttcctgtgaaggcctaccaaagtaaacctcattaagatgctggatcttcatgcatggagcacagcaaattcaattgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttgccactgaaggttgtttagggctaagagccttcgctgatgttttttgaatgcagggttacgtaagcgatttacccgacggnnnnnnnnnntttttgccactgaggattgttaggggctaagagccttcgcttatgttttttgaacgcagggttacgtaagcgatttacccgacggnnnnnnnnnnctcgtggtgcacgaatcacgtaatatcattaagaataaaccaatccaccttgtgtaaggggtcctgtcagcgcagcacaggtgagtgggaaaaagcagtatcttagaccacatgtacttccttagtgcatgtgcttattgcatgagtgaggcagactggatgcctccagatcctatagacttgtattgcattgtcagnnnnnnnnnnnnnnnnnnnnnnnnnnnnnnnnnnnncacccagcagagagtaaccccgcagccatgcccaacctggcgcgctctcggaagtgcttcctccctggggcagggaatcagagcacgctgtattcctctatggtgaggttcaagctccatctccagccccgccgaccgtgaggaggtgaacaagtttgcgccccttcggtttctgcgccgtctctccgctcttgggtgcgccaggataatcggcagcggacagtccctgcccatacctctagagaatgtctgcacaggatcctgcagcctttgcggcattgctgcaaggcctgctgtcctcggagaacgaagtccgatcccaggcggagcaagccttcacagagctgaagaagtaccccgacacatgcgtgccggggcttgtgcaagggctgaggtcgaatcctgacccagcatctcgctcgctgtgtgccgtgctgttgcgcaaggtgggggtggtgtcgacggtggtcgccgtcacggctgcaggctgctgtggatgtgcatcgcccagctagactgccttggaaagtgggggagggagattgccagtgaccccttcctcacatctccacgcacaggtgctggtcagggatgagccttcgttgtggactggcctgtcgccggcctcaaaggtgagatggggatacattgagcagggaggtgcgctggccgccgtcgagcttgtgtcacaacatgcattactcacagtgctgaaaagtattccaatcgcagcaacttgtgatgaccgagtcgctgaacagcatcaagacggagcaagtacggaatnnnnnnnnnntaagtatccaaattgcagcaacttgtgatgaccgagtcgctaaacagcatcaagacggagcaagtacggaatatagctaacaaggtgacacagtattgtgttagtctgggttgggggtctgggtagtttccttgcctatgatgaggcattgggaaattgtactgtgaatgcatggcatcttggatctcattcaagggagaacaaggcagtcacagcgggttcaagcagttttggtgatgagatgctctctgtgctgaaagtaaacctgttcatccccnnnnnnnnnncaaggaagtcacagcgggttcaagcagttttggtgaggagatgctatctgtgctgaaagtaaacctgttcatccccatcgccaggtctgcgatcttgtgagcgagctggcggctggggtgctggaggagtcgggatggcccgagctcctccccttcatgttccagtgcatccagtctggtgagttgagaaggaggggtttgggagcacgttcctttgagatttaaagaggtgcccgcaggcatttggaggggtcaaatgaatcaagtggttgctcgttcgccaggcattggatgcatgatagcctattacgggcctgcatgccagccgccccaacagaacccgttcacacccacacaaatcgttcccaccccctccttcaacatcctccccatccaggcgaggatcggctgatggagtcggcgctgagcatgtttgcgcagctggccagccacatcatgagcgtgctactgcagtacctgggcacgctgcacggcatcctggctgccgcgctggcccatgcctccactgacgtgcgcctggcggccatgaaggcgacctgcgctttcatccaggagctggagagccccgcggagcgcgagaagttccaggccctggtccccgccctggtgcagaccatcggccacgccatccaggcgggggacgagcccgcggcacaggtcggtctgcggaggcgcgcatggtgttgagtggggtttctgggcgcagtttgggctgttacatgcggagctgggacatggaggggaggatggctctgaggtcggatgtgcagcgctgggataggtttgaggctgccgttggccagcatatcggtcacggaacaacgtgttatcaacttccgtccgcagtcctcccgtacgcaccgactgtccacctccccccccccgtgagatcccacactccataccccctctcaatcaatccccataggaggcgcnnnnnnnnnnagtgtgcatggtgcgtgtagggcacgggaggatggactgttggttgggtgtgagtcaatgtaatgaccgacggcaggcggaccaaggggnnnnnnnnnnctggctctgaggttggatgagcagggctgggatagggttgaggctgccgttggccagcacatcggtcagggaacgtcgtgttatcaacatccgtccgcagtcctcccgtacgcaccaactgtccacctccccctcgtgagatcccacactccaactcccctctcaatcaatccccataggaggcgctggagctgttcatcgagctggcggaggagaacccgcgcttcctgcgcaagcagctggtggacatcgtgagcgccatgctgcaggtggccgagtctgactcgctggagtccggcatccgcacgctggcggtggagttcctcgtgacgctgtgcgaggcacgcgagaaggcgccgggcatgatgcgccgcctgccgcagctgccggagcgcctcttcaactgcctcatgctcttcctcctggacgtggaggtgggtgttttgggtagtggtggagggtcgttcgtggaggaatgggtgttggtgtgcatcgtgcgtgtagggtttgggacgagggactgttggttgggtgagtgtctatgtaatgaccgacgtcaggcggaccaaggggtgcatcgacgtttctgggcgccgggcagcggcggcccggccgcggtggcaagagcttgcgttttgtgcctgcactgcaagtctgagaagtccctcttttcacctccacactcccctcgcgacacatgcaggacgtgcccgagtggcacacggcagaggacgagnnnnnnnnnntgtctgaggaatccctcttttcacctccacactccccacacgacacatgcaggatgtgcccgagtggcacacggcagaggacgagaaggaggagaacgcgggcgagggggagctgttcgagtttggccaggagtgcctggaccgcatcagcttcgcgctgggcggcaagaccctggtgcccgtggcggggaccacgctgacggcctacatggccgacacgggcagctgggagaagcgtcacgccgcgctcatctgcctggcccagatcgcggagggctgtgtcaaggtcatggtggacgaggtggagaagctggtggcgctgtgcctgctgggcgctcgggacggcacccccaaagtgcgctgggccgcgtgccaggccctgggccagctctgcaccgacctgggacccgacctccaggtatggcgagggggtgaagaggggtgatcagagggttgggggaattgtgtgcactgtgtctaggttggcaggggtgggggaggtggaggcagggccaggcacacacagggcaggcaaggggcccgtgggtgggcacnnnnnnnnnnatgggggaggtggaggcagggccaggcacgcatagggcaggcaaggggcccgtgggtgggcaccgcatgctgctggatgtcacgccgagatgcaggcgtgtcctgatcatgttttgcgaggcagcgcatagcccagaaaggcaggatctggcttgaaggttcatgtatnnnnnnnnnnggtgtcctgatcatgttttgcgaggcagtgcattgcccagacaggcaggatctggcttgaaggttcatgtatgtggcctgatgcggatggctgttgcagcccctcctcaccagccatgctcacatgcagcggaatgatcagacatcaccctgaattccacccttgcttcccctccatcaccaccatggtgcaggaggcgtcgcatgccacggtggtcccggccctgctgggcctgatgggcgacttccagaacccgcgcgtgcaggcccacgcctgcaacgccatcgtcaacttcacggagacctgcgaccaggacgtcatctcgccctacctcgacgagctggccacacgcctcatggccctgctccagggctcggggcgaaacgtgcaggaggcggcgctcaccgcgctggccagcctggccgactgcgcgcaggagtactttatcaagtactatgactcctgcatgcccctccttctccacatcctcacccatgccaacgaccgcagccaccacctcctccgcgccaagagcctggagtgcatctccctggtgggcatggcggtgggccgcgagcgcttccgcgcccacgcccacgaggtcatgaagtacatgcaggacgcccaggccgcgggactggaggccgacgaccccctggcctcctacatgacccaggtggggggctgggatgcaggggttggctgagttgtggtgactgaggagggaggagcaggggaccctcgggatttaacggttatgtttgggctgaggaggcttacatggcactgatggaatgaggtgaatgcatggaacattgtatggctcagagcatttttggcggttggaaacgtgtcagggagggatgaattctggggtcaatgtctgtttggtagaatannnnnnnnnntactgtatggctcagagcatttttggcggtgggaaacgtgtcagggagggatgagttctggggtcaatgtctgtttggtagaatagctgccactcggtctttgatgggcatggcttgccgaccgcaaggtcttggcatggctcttccccaatgcttcagtcctgagctgctgcgacatgaccctgtccctccagannnnnnnnnngctgaccgagaggtcttggcatggctcttccccaaagcttcagtcctgggctgctgcgacatgaccctgtccctccagatcgaccaatccctttgccgcgcacctaccgctcccatctcacccttgcacactgcaggcgggggctcgcatctgcaagaccctgggccaggagttcatcccctacctccaggtgtgcagctgagagtttgctcatgctgacttgatcccgttggagcaggcagagatggtgtgcctgtttctcatctgtactttgcatgcaagcccacccaccaccctggtcaagcctgcaggtcgtcatgcccgccctgattgcttcggtggagctgaaaccggatgtcacggtggctgccggcgacgactccgacgtggaggacgaagacgaggacgtgagttgggtgctgaaggggcgcaggggcttggacgctatcggacaggtgccgagcctcctgcctggtgcttgttgaggaagttcagcctttccagcaaacaagtccatcagcgcggctctggacctttcaccttgattgatgcacatgcattgttagggatggatggggtagattctctgcgacaggtccgacctccacaggcccgcagctgtctgccctccctggaattcccacatgttgactcagcccacagactgcacccactccttgcctcattgtcagcaaccagcccccaccaaagctccaccctcacacaccttcaatctcagacggagaccttcatcctgggggaccgcaagatctcgctgcgcacctcgctgctggaggagaaggcgacggcctgctccatgatctgctgctacgccgacgagctgaaggagggcttcctgccctatgtacagcaggtgacgggcattatggtccccctgctcaagttttacttcaacgaggaggtgcgcaccgcggcggtccagtcccttcccgagctgctgcgctgcgccactgcggcccgcgacgcgggcaagggcgttgacgacgcctttgtgcggtccatgctggagttcatgtggacccccctcctcgacgccatggccaaggtgactgggtgtgttgggggtgtaagggggggtgggagggggggtggcatgatggggagtggatggccgatggggtggtcggtgcactcgacgaggcagcttgcccatccactgtggtatcca

SEQ ID NO: 35011 - DNA, 86 bp, Chlorella protothecoides
ttagctgttccaaggtgctgggaggcgtccaagtcgcagtggccccttcgcatgctgttctgccgtgggctcacctaatctcggat

SEQ ID NO: 35012 - DNA, 94 bp, Chlorella protothecoides
ggctgctgaaggccctcaagtaggtgatcagggacagatatcaagagcagcaccgtggcaatgactgagccagaaggtgtactggggggatgac

SEQ ID NO: 35013 - DNA, 77 bp, Chlorella protothecoides
ggtctgccctcgcagtgcatcgcttgatgcgagcattttccagagttgttaggctgggcaggcaggcaggcgggcca

SEQ ID NO: 35014 - DNA, 61 bp, Chlorella protothecoides
gggtcacgaaggcctcgtaggtgctggcggggcaggtcagcgcggccgtgtgcggccccgc

SEQ ID NO: 35015 - DNA, 70 bp, Chlorella protothecoides
tctcagcctggggtggggtggggtggggtgaggtggggtagggcacactgtagactggaggccagccagg

SEQ ID NO: 35016 - DNA, 78 bp, Chlorella protothecoides
gcgactgcctctggcccgcatccatgcctagtatgcggtactcctcccgcccgcaactgtgttcgggtctggaactcc

SEQ ID NO: 35017 - DNA, 84 bp, Chlorella protothecoides
tcgacgcacgaagtgctcccaggcccgcatcccatgttaactctcagaaccaggcccccttgcacacccacctccatgccctca

SEQ ID NO: 35018 - DNA, 72 bp, Chlorella protothecoides
cgtttccgtcattacaaatgtctgtgccataaattccatcaacccccagccgacatcttccagacccagttt

SEQ ID NO: 35019 - DNA, 74 bp, Chlorella protothecoides
tccccggcctgccgcccggccagggccagcactgcaggccccgacattccacccaccagaaccttcctcccacc

SEQ ID NO: 35020 - DNA, 122 bp, Chlorella protothecoides
aaccctgtcgacatggatgttgcagcacaaagcagcagagccatggactgcgttgtctctagaccagcacttctgcatgaaattgtgctaagattttgtcgccagggatgacgtgagggtgc

SEQ ID NO: 35021 - DNA, 61 bp, Chlorella protothecoides
gaggcggcagggccatgcgcgggtcctggcatccatccaggaggccatcgcacaggggtat

SEQ ID NO: 35022 - DNA, 11202 bp, Chlorella protothecoides
  modified_base (271)..(401): a, c, t, g, unknown or other
  modified_base (619)..(785): a, c, t, g, unknown or other
  modified_base (2676)..(2685): a, c, t, g, unknown or other
  modified_base (3838)..(3847): a, c, t, g, unknown or other
  modified_base (5669)..(5678): a, c, t, g, unknown or other
  modified_base (6251)..(6260): a, c, t, g, unknown or other
  modified_base (6391)..(6400): a, c, t, g, unknown or other
  modified_base (6988)..(6997): a, c, t, g, unknown or other
  modified_base (7203)..(7212): a, c, t, g, unknown or other
  modified_base (7685)..(7694): a, c, t, g, unknown or other
  modified_base (8253)..(8262): a, c, t, g, unknown or other
  modified_base (8611)..(8620): a, c, t, g, unknown or other
  modified_base (8803)..(8941): a, c, t, g, unknown or other
  modified_base (9124)..(9133): a, c, t, g, unknown or other
  modified_base (9956)..(9965): a, c, t, g, unknown or other
  modified_base (10954)..(10963): a, c, t, g, unknown or other
cagcagcaggttgatgctgtcctgcttgtcagcgtcggtgtatgcgttgctgtaaaagcggcgcagggaggtgagcaggtcgcgcgaagtggtggctgccgcgccgtcgccgcgcgcgcgctggaagaaggaggcgtgcgcctcgctgccgccgtactgctgcgcggccgcgtgccccgccgcctcgtatgcgtccatcagcgcgcgcgcggcggaggagtcgggggccaggccgcgcgcggagccggacaggcccagcgccgccagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtgcgcagcacgccggactgcagccgcaggctggaagacgaggggggggcggccgcggccccggcgccggagtcccgcccccctgcgccgccctcgccgccgtcgggtgcggccctggcgcaggacccccaccccccggtcgcgccgcccaggacgaagaagcccgtggcgtccagggcgggggcctggacgcggcgcaggcgcgccagcagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccctcccgcgcccacccccggttcagctgggccagcgcggcctcgtaggcgcggcccagcgccgcctcgcgcccgctgcggcgcaccaggtccagcgcgacgaccgggtcgccgtagcgcgcgcgcagcgcgtcaaagtgcgcggcggtggcgcggtacagcgggtcgtactgctgcaccacgatctcgggcttcagcaccgcgctgctggcggcctggtaccagaacaggggcagggagccgcggagctggagccaggaggagatggcggggaggcgggtgcggcggtctagccccgcctccaccacctgctccagctccacctcgttggccacgaagccgtcggcgttgagcccgcgcttgcggtagcgcgtgccggcgaagcgccgcgaccgccgcgccagcagcgtcagcgtgaaggggcggccgaagacggagaggcggcgctgcgtccagaacccatgcaccagcggcgtgagccagcgcgccaggcccagcgcgcgcagcgggcgggagatgtgcgcgttccacacccactggctggcaaaggggtcggggttggggggcggggcggcggcgggtgcgccgggggccagcacgctctgcacgctgcgccacaggggccaggtgcgggagaagaggaagctggagtccaggggcacgccgccgaagatgcggcggtagcgtgcctcgggcaacgcggtgccgccctcacggaaggccgcggcatgcgcctcggggtgcagcagggggaggagcgccgtgctcgccacaccgtacaccttgtgccctggtggagaaagggggaatgtggggggtgcgtggcctcctgggggcgctgtgctggggatgtccagggcgcaaagcacgggacggagggggggtcgaggtgcacgaccatccacccacgcaggcccacctgcaatgaggccctgcatcgacttcttcaggatgagcaggaggtagtagccctgcaggaacctgaagcacccagccataccatgcgccctgcacacgaactggagcccgcccgcggcctggttgcctgcaggtaagcaatcaggaggtgatggggcgggtggggactggggccggggggagcagagccccaacctgggcatatcgggaggcacgaaggcaggctcggatcccagatagctgcatccattccgctcaccgtcacgcaggcatcgcaggagggaggtgagctcctcccgcgtgtacgtggtggggtcctccacgacagtgagctcgacctctcgtcgactgagcttgaggatcctccatgcctgctgatccttgctcccgcccacgacataggtccagccaacggtgcgatacaccagaattcggtgtggcgcattggcagcgctccacgcatccatccctcgacagccagactggcgggggaagggggaagacggagcacgcgagcggagcttcagatccccgcgcgcatatgaatccgctcagcacgacatactgatttgtgaaagtgaatttgaggttgaattctcggtgcatgcgcaatgggtatgcgcgaacctaggtttgggcgcggcccccaacgacgatgtgccacgcaccgggccgcacgctcagcacatcggatcctgataaatcgaaagggtgcttaagtcccgtcgggtggaaacccggcagggcttggactacacgatcttaaaccattaaaacattacccaaatcatgcagatgtcgagtcagctacatcacggcccctgtggtcgaccaaacgccctgcatggggtccacaccaaatgctgtcgacttgctggaccattcctgagcgtgaacggtaggccaactgctccagagcatcgacaaggcgaggaaaagacacaattttcagtctcgctgatcatcctgnnnnnnnnnnttgtcgacttgctggaccattcctgagcgtaaacggtaggccacctgctccagagcatcgaaaggacgaggaaaatacacaattttcagtctcgctgatcatcctggtccgaccctatgcgtgcctggagttaatgtccttcgtgcgaaccccatcttcatgcttcccaagatcctcgccacattctcccgcaggacgtcagcaaaggccagttgcgcggcaggccgaaacaaaagggcctcaggtggtccgaaaattgcctgtctcaggcggtgcacagctgctcttgcagttgctccaggcaaaggacccagcggcatacgcacgtgccaacgtggatttgtaccaggaggagttcttccagtcctcctgggccttcatcgccatggcggagcgggaaggcagcaaggaggttgtacaggagctacacaaggccatgcgcatcgccatggatgccaagcaggcctccctgcggccggagctgcagctgatgaacctgctcatggctgctccagatggaccagccagggcaaaggtgtgtgatcaaagggttcgatagacttgcattgtggtgaatggcagcacatgttgaaccaggagagcttcctctaatttcagcccacatctcccactgcagatctgggcccaatttactgaaggagacaaggcccccctagatggggccttcttcacacgggtcctcgctcggttctcaaaggacgttgccagtggtgcatcagggacgcagaaggacaagaacctgcaggacaggttgagaagaatcctgagtgagtcctctatctatttcccaacatgaacacctgcatcgatcgtttgttttgtaatatgggtcactagcaattactggacgtgtcttgatttatcttttatgctacggacccgagcagttgaaagacacctttcgttctgttgaaaatctgattcctcgattgcgaatgaatccggaagtgcgcgtcctgacctggcaggatgaatgtccctgtgatcatgcacgacccaatcgaaaaacaaagttcccagcccatgtgtacttgatggagggtgcggaggcgagctcaaccacccaaggtatggcgtcgtgggaggggcgcagtggctggacgagggccagactctcgcagacccgaacatnnnnnnnnnntcagcccatgtgtatttgatggagggtgcggaggcgagctcaatcacccaaggtatggcgtcatgggaggggcgcagtggctggtcgagggccagactctcgcagacccaaacatctaggctcgacgtccgccatccacagctgagatgactgcaactccatccatccccctgcaggtccagcgggttccttggaggagggggtcactcgtgtgttcgagcgccagcaaaacattggggtggaactggctgacatccgtcgtcagatcgccgcgttcaacgctacaaccagcaagctagccacggcggcaaacaaggtggagtctacggccttgactttcggagatgtccaggggtttctgaccgcgatagaggcggaggtggccaccattcaggccgccctgcagaagatacaaggtcgcaacaatggtggctgacatcgggtccctgagggaggccccacatggccaggcaatggcagaaagactgctgaccatcatcgtcaaggtgagagaaagctgaggcgcatgcgtggcacctctccatcagggagggtaagaaggtggtggctgcaggggcagcggcatggccaggcgtgcaccatgcatttgcacttgagggtgcagcgcggtcaggcaagttcctgtgcaaaagctggcccctgctctgaatgcaagcgtgcaaatccaggctcaggacccggacataacacccttttgcaccacaggtcgtgaagggccaggtgaggcaccacgccgtccccaagctcgtggcagacttggccgcggtgttgtgtggcctgcgaccctccctcatgttggactatgcgctgctgacacccaaaatagccctggagctggcaaggcaggcgtcgctgctgggagattgtctgctgactgtcgcccagctggccgactgcaccttcttcctccggccggacaggtatctgcctgatgctgcccctcccctcttcatcgattttacctctggaaccgcaacctgggtggagcccggctccgaaaggggcacaagcctggccggagtcgcagcagaggtgagggcgagtgtagcccgccgggctgtggcctctggggcgccatgcctgttgaccctggactgcgaccggtgggcggcccggggggccgctctccccaccctggcaggcatcctgctgggataccctgcagtctacgcgatcggaagccaggaggaaggcgcccaggccgcgcggtgcctgtccagcggcggcctggtcctgcacagcctcaccgccgggctgcaggccgggcgggatccctcgccgccagccatactggcctactcggtgcccgcctccctgctcccagacaccgagatggacgagcgcgcctcggcctgggaggccgaggtgcgcgtggccgccgctgtggcgcagggcgggggttgggcctggggcgacgtcgggcgcagcagggcggcggcgggtccccgtcctgtggtcctgtagcaccggcttggacccaccacatgtccacttttgccggtgtgactgcaagagaaagtgcgagaacacgttggaaagtcgagggttttgttcctcagtcccaaaacgagcaaggagatgggggaatcccgggcgcgggaaaattgctgggcgcgggcagcgcttccggggtgtgcagggatgcagggcaacccaccactggcgcgccttcccgtctaatggacactgcagcattacttttggaatatctaacgtggggagggtgcccgttgcttgaggtggcgtcttgtctgggcaccagtcttcacagtcttggagctcgtctagcgacctgttcctnnnnnnnnnngtggcgcgccttcccgtcgcatggacactgcatctttacttttggaatatctaacgtggggagagtgaccgttgcttgaggtggcgcattgtctgggcaccagtcttcactgtcttggagctcgtctagcgacctgttcctgcctttgagccattccaaggcagctttgagcatactgatacttggaagatattaccattgatatagtgttcttcgcccagacggccccgcagcaagtgaggagggcatggctatccggcggccccgtcggtaccacatttacgactcccttcccaagcgtggccctgactctccctccctcccaccccgctcaccacagtgcggctcgagaagtgctggttctgctccagcacctgctacccaggtcacggggtgacctttgtccgcaatgatgccacagtgagttccagctttggcagggcgctggggtccgaggcacagcatgccagtttctgcctgcaaggctgtgtcggctcttggttggacccacgccccgtcaccatgatgtggatgcggtgatgtgatcaccgcgctccccagcctgcgcactgnnnnnnnnnnagctggggtccgaggcacagcatgccagttcctggctgcaaggctgtgtcggctcttgggcggacccacgccccgtcatcatgatgtggatgcggtgatatgatcaccgcgctccccagcctgcgcactgnnnnnnnnnnccccccaggtcttccgcttttgccgctccaagtgccacaagaacttcaagatgaagcgcaacccgcgcaaggtgaagtggaccaaggcataccgcaagctggcgggcaaggacctggcggaggacgccaccttcgagatggagcgaaagcgcaaccggcccgagaagtacgatcgcgagctggtgcacaaggcggtgggcgcgctgaagaaggtcaccgccatccgcgcgacgcgcgaggcgcgcctgcacacgctgcgcaagtccgccgcgcgcgacgcggagaaggctgccgaccttcgcgagctggagcagtccatccacctgatcaaggcgccgggcgtgctagcgcgcgaggaggaggagcgcctgcgcgagagcgtggaggagctgcagcagacggaggccatgcaggagtgaagggcttggccaggtttggcgcgcctgcggcaatggcgcgcccgctggggagggcccggcgccgtgcaggggtgggtcatggcggaatctctttgccggcattcaagcaccgcatccgcatggggcattcgcatgggccggcgctgggcctcagatcgccctgcactannnnnnnnnncctcgttgccggcattcaggcatcgcatccgcatggggcattcgcatggggcggcgctgggcctcagatcgccctgcactacgctggtgtcctccttgtattatgtctggagaggggtatgcatccgcataccctccctgtatctgcacaccgacacatggagcattacagggtatcgtcgtggttggggatcgcagtgaacacgnnnnnnnnnnatgtgcacccgcacaccctccctgtatttgcacaccgacacatggagcattacagggtttcgtcgtggttggggatcgcagtgaacacggggtgggtcatgggcggtgtcaggggcctggcattgcgccaggggggggtgcggtgggtctttgcatagaatgcaaggcttgaaggttggggctgagggtggtgcaggtcacacctgatggggcatcaggccaccaaggagacctccctggcctcccctgcggtgtcaccttgtgccttcaggaagcccatggcctcctcgtgccggatcaggtccaccctgcaagatgagggcgacgtgggtgagtgttgcagctccgcctgtttgctcttcgatgccgatacctgggtgcaccggcggctgaggcccagaggtacagtgccaggggttccctgaggttcgggtcaccgtaatcgccccctctcctcccaagccctcacctcnnnnnnnnnntcaggggttccctgaggttcgattcaccatagtcgccccctctcctcccaagccctcacctcgacacccggttggagtgggagacggcatacacgcggtcggccaccgccaccagctgcgggtggaaggtggtgacgatgaactgggcgcgctggtgcacatcccgggactgggcgcgcaggaggtccgccaccacggtcctgtggcgatgtggaaagcgaggcaaaggatgacaggatttcgcacgaagccgtgctgcacgaccgcagggaagcccacatcaccgctgccctgcatgtgcaccatcttgccccgcggcagtatgcaacaaggtacctgtactgcgggtcgagcgccgcgtcgatctcatcgaagaggtagaagggcgcggggtcgcacctctgggtacggggggaggggatgtggacgggcgcttggtgaggagaatggcccccgtttgttgatgaaggccactccagtgcgtgcgggcaatccccagttctccgggcatggcgcgcctggcaccatccctttcaccccggcccccaccggcacctgnnnnnnnnnntacgaggggaggggatgtggacgggcgtctggtgaggagaatggccaccgtttgttgatgaaggccactccagtgcgtgcgggcgatccccagttttcccagcatggcgtgcctggcaccccccctttcaccccggcccccaccggcacctggatggcgaagatgagggtgagcgccaccagcgtcttttggccgccggacagctgcctgagggacatggtctccccgccggccccaaaggccacctgggggattgcatgggggcccaagggggcatggagttggttgcgacaaagcacctcggaactggcaagcatgtgctgcgtgaggcgccctgctcccaagcgannnnnnnnnntttgcattggggcccagggggcatggcgttggttgcgacaaagcacctcagaactggcaagcatttgctgcgtgaggcgccctgctcccaagcgatcttgttcttggatcccatgggcagcgaggcatgcaaccaccccacaccctcctccttcaccttgactcgcacgcccacgtatcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggaaggggcagtggaggggggtgtgcggtggtgcagggtgcaatgcccatgcaggccgcgacccacagccgcccagccaccgtgtcttccaagcttctgttcggccttccatctgcagcaaggcaaccaggcgtgctcatctgaaataaggtggccccccgcacacctcctcaaaccacnnnnnnnnnnccttgatccccatgggcagcgaggcgtgcaaccaccccccaccctcctccgtcaccttgactcgcacgcccacgtatcggtccaggccggtggagggtttgccagcctcggggtcgatgttctcctcgttcccgaagcccggcacccgcttctgcatcacaacctcccccctcccgcctggcaccagctgttggggggaatggaaggggcagtggacgggggggtgcggttgtgcagggtgcaacacccatgcaggccacgacccacagccgcccagccaccgtgtctttcaaggttccgttcggccttccatctgcacggaggcatccaggcttgctcatctgaaacagggtggccccccgcacacctcctcaaaccacccaccgtggcgaagatgtcacggaagttcttggccacgcccttgaaggtgcgctccagcgcctcgtccttgcgcatgtccagcgtggagatgagctgcctgatcttgcgctcgccctcgtcgttgtcctgcatgtattgggtcgcggggggggaggaccaaggtcagtgggtgaggctcgcggcaggagatggggggagcgccgtgcgcgccccatgcaggttccgaacctgtacccctcgcccacctccttgcgcctgacaagctcgtctcgctgctctctgaagccctggtgctgctccagcgccaggcggttggcgggccggtacttgctgtgcagctcggcattcatctgagggtgaggtcaagggggccggaagaggttgaggctgcagtacattgggcgggcctctatcctgcccgaccccttccacgcaccttccnnnnnnnnnngagggggccggaggaggttgaggctgcagtacagtggacgggcctccatcctgcccgaccccttccacgcaccttccccagctgcgctcgcagcgcagacaggctggtggtggcgtgcacctccactgcgtccgccgacacggggcgcaggaggcgcatgcggtcgtccaggtcgcccagcttcgcctccagcgcgccgcgcttggcctgcgcctcctgctcgttcagctggacgtcctgtgtgattgcgtggtggaagaggggttgggaaggttgggtctgcgtccatcctcggcctggactgtgtggggtgaggccagcggccaggcgccttgaaccaccaccctggtcgaaccccgcgcgcccacctccagcgccaggagggcgcggctcagcgcctcacgcgccgcctccagcgccgtccccccggcggactccttttcctggcgagacgaggggacgagttgcgccagtggagtgtcgggctggtcctcaggaggggcgaggatgtagcctccgctgcactgcacacgcccgagccatcacccttcatccagcacccccaccctccaacccacgaggagctccagctcgtcggccaccgccttctcatcggcataggtcctggccagctcggcctccacctgcaccggtaggaggggaaggaagggcgtcgccagccgggagcccacggcggcggaccaaccacaggcagccagctgaatccaccgccacccaagcgcccaccgtggcgagcgcggtgcggcgggcctccagcgtcggctcgtcaacggccagtgtgcgccccgccagccggtcctccaggtcctgtggggatgacgtaatggggttgagtcatggtgcactcaatgcaggctggaccacacgcagtcgggcagtcgccctggggcctcaccccacgccaaccacaccaagtccccccctttgcacaaaaacaaaagccctcgcctgctggtggcggaggaggnnnnnnnnnngagtcccccccttcccacacaaacaaagccctcgcctgctggtggcggaggaggtcgcccgcgacggtctggcgcagaccctccgcctcgctctccagtgccaggcgcctgctcctcgccgccgccaggcccttctgcagcgccgcgacctccggcgccagcgccgccagctcggccgcctcggccttgcccaggcgcgccgccagcggctggcccagctccgccgccagcgcggcgca

SEQ ID NO: 35023 - DNA, 75 bp, Chlorella protothecoides
ggcgaagcgcttgcctggggcgcggggcaggtggaaggagggggttgggcttgggctctgaaggggactggcttc

SEQ ID NO: 35024 - DNA, 73 bp, Chlorella protothecoides
aaggccggcgcgggtggggctccaggcccctgccgtgacgtagccgggcgcatacggcgtggccatcacggcg

SEQ ID NO: 35025 - DNA, 121 bp, Chlorella protothecoides
cgggtgggggttgagagggccgggttgtgtgaatcgaaagccgaaaaggaagtccccatgagccctggtatacactcttctctgacatctgtgctgtcctggtactcctctgctgccctac

SEQ ID NO: 35026 - DNA, 61 bp, Chlorella protothecoides
ggatgcagcttgccctgctcaggccagccctttcccttcctcacaatgttctggatgatga

SEQ ID NO: 35027 - DNA, 61 bp, Chlorella protothecoides
tgcggctggagagggactgatggccggcggaggattcgctggggcaggcgaagggcccaca

SEQ ID NO: 35028 - DNA, 61 bp, Chlorella protothecoides
ataaggtatgcattaggtgcgagcctggccaagtgaccaaagaaatccacccttgtgcagg

SEQ ID NO: 35029 - DNA, 102 bp, Chlorella protothecoides
ggttacattgtcagtcaagtggcgctgttcatacgttaagggggagctggggtgagaaaagagctccagtcctccgctaagactcccgggctagaacgcaag

SEQ ID NO: 35030 - DNA, 65 bp, Chlorella protothecoides
gtaagctagaccatgcctcgttgccataattctccgaaaacttaccccctgtttcttccctgtcg

SEQ ID NO: 35031 - DNA, 68 bp, Chlorella protothecoides
gccatcctctcagaggctaggcccttttcccagcaaacctccgatcacgatccacaatctccgatcat

SEQ ID NO: 35032 - DNA, 135 bp, Chlorella protothecoides
gtgcgctgctgcgatgtgtcctgcacgggccgtggtgtgagcgggggccctgtgcgcccgaccctatcccttgtgccacacgctcatggaccctcattcctcacgaccacaccccggcctgcagtgtgtggcgac

SEQ ID NO: 35033 - DNA, 61 bp, Chlorella protothecoides
ctgccgggccctaagggctctgtgcgatgatctggagaaggagctggggtccaggcagcag

SEQ ID NO: 35034 - DNA, 61 bp, Chlorella protothecoides
aggggctggtcagagagtctgcgcaggcggtttgtaagatccgcgttgtctcactctccct

SEQ ID NO: 35035 - DNA, 82 bp, Chlorella protothecoides
gcacacaggcctgccagcctcctggatgcgtctcgcctaatcagggaagccagatcaggccacaccgatgtacctcagcaag

SEQ ID NO: 35036 - DNA, 143 bp, Chlorella protothecoides
cggtgcaaatcagatcatacaccttcatccgattccccgttatatattcgctatggggtcgatgtgccgcgtcctcttaattctgtcggccatcgcgctgcaggcgtgtggtggttccgatgccgcacgccagggggactcct

SEQ ID NO: 35037 - DNA, 61 bp, Chlorella protothecoides
cgcggagcgagcagcggtcgcgtactgtgcagccacatcgacaactgcatgagtgatggtg

SEQ ID NO: 35038 - DNA, 61 bp, Chlorella protothecoides
gggcgcaggcgccggcggtgagtagaggtggtgaagcggcgcagcaaggagggcaacttca

SEQ ID NO: 35039 - DNA, 61 bp, Chlorella protothecoides
gctttgggctgcgacgaacggcacctctggcgcgaggaaattgggcttgggaggcaggtgg

SEQ ID NO: 35040 - DNA, 193 bp, Chlorella protothecoides
tgagcctgaggcctgcagggaggggagggggtcgggcgggtccgtaagaatcggggggggggatggtcggggggctggccgacatgcacatgcgcctgcgagacaacgccagagcgagtcccccctgacacggacgacattacagacgccaggtttccactaacagcacatcatcccccacctgtccccttac

SEQ ID NO: 35041 - DNA, 78 bp, Chlorella protothecoides
ccgatgtcgtgtgcgaaagaacgcaaggcatcaagcgattacagtatcgaccttcagacctgggtgaaccagacccct

SEQ ID NO: 35042 - DNA, 76 bp, Chlorella protothecoides
gaggaggatgagaatggatacatctgcgcttgtgcgtgtttatttcctctgcccagggccatcaggcagctcctcc

SEQ ID NO: 35043 - DNA, 137 bp, Chlorella protothecoides
ggtgaggggcttggtgggggcggtgaggggcttggtgggggtggtgagggagtgggactaggcggaggagaggggctgattggcggcggcggaggaaccttggagggtaggggtggcgacttcttagatgggggcgg

SEQ ID NO: 35044 - DNA, 116 bp, Chlorella protothecoides
ggcaggggtcgcagagctggcgtgcgctcacgccgacggagcctctggcgtgcgctcgggccggccaagctcccggagtattcaccgggagcgcattctgctgtgcctgctcacag

SEQ ID NO: 35045 - DNA, 61 bp, Chlorella protothecoides
gctatgctcacggtcttctttcccaggggcgccggccgggtcttcacgcgcaggcccaggg

SEQ ID NO: 35046 - DNA, 61 bp, Chlorella protothecoides
gcatgacggctcgcgggcattgattcggggggttgtgaaagcagtaccacgtttacgagcc

SEQ ID NO: 35047 - DNA, 69 bp, Chlorella protothecoides
agccggctggagagtttggttcctcccacatcggatgttgtggtgctcgagcatgcacatgcccgcctg

SEQ ID NO: 35048 - DNA, 135 bp, Chlorella protothecoides
aggtgagcgctggcgatgggaggggacttcgggaagagggaacggggggctggttccggctgcgcaatgctgtgatggagtgagcgacagcttgaaacagaaatttgaccaagatccggccctcgccatccacgc

SEQ ID NO: 35049 - DNA, 61 bp, Chlorella protothecoides
cggcgcatgagaggctggcttgggggggggggctcctcgtcgcgtgactgccgaccccccc

SEQ ID NO: 35050 - DNA, 79 bp, Chlorella protothecoides
ccctcctttgacagctcaggacaaacacttgatgacaataatggtgtcaaggaggactccagtaattctctcccgacac

SEQ ID NO: 35051 - DNA, 61 bp, Chlorella protothecoides
cgcccagcaccacgtcctcgccgatcatgcaccccgccccgactgccgccttggaccccat

SEQ ID NO: 35052 - DNA, 79 bp, Chlorella protothecoides
agagaggcgggagcatgggcagaagggcgcagtacaatggggcacccttaaggggctggcatggctggatggatgtgcc

SEQ ID NO: 35053 - DNA, 102 bp, Chlorella protothecoides
cctgtgccatcatgtagtggccagtgcaggtgggggcgtggtgcctgcgcgccgatcgtccccgcgtgcactctgccatgcgacctcgaggggccgggcgag

SEQ ID NO: 35054 - DNA, 117 bp, Chlorella protothecoides
acaacccaaactcactcctggaagatgtcgtggacgtaaacctggcggcgcgcggatcgggtggggcgcaccgagccgccgccgccgccgccgtaggcctccgcctcggcggccgct

SEQ ID NO: 35055 - DNA, 69 bp, Chlorella protothecoides
gtccagccctgacctttcccatgccccccactccctccacccccccccctcccggctgggcgtccacgg

SEQ ID NO: 35056 - DNA, 61 bp, Chlorella protothecoides
caagcaaagagggcctgtctgccgagcaagaaaataaggcaaccccctcaccgtgaactcc

SEQ ID NO: 35057 - DNA, 110 bp, Chlorella protothecoides
ggtgacggtcgaagccgtgcagggccagtcgagggcccagaggtctgcatcggaggcagctatgacttcagaagcttgccgtgcctcagcgacatcgtgtctgcgaatgg

SEQ ID NO: 35058 - DNA, 87 bp, Chlorella protothecoides
cagcagccgccacaaccgcatgcataggtataggtcgaagggtgtttaaggggggcaggcaggagggagggggtcctcggggatctg

SEQ ID NO: 35059 - DNA, 73 bp, Chlorella protothecoides
tgccgatagatccacggcgatggcggtaccatccagttcggaaagcaaggtgtggtgctgcgacgggtcggag

SEQ ID NO: 35060 - DNA, 61 bp, Chlorella protothecoides
tggggagggccgccgagccatcgagccctcccgctctctgcccttgccagcctggctgatg

SEQ ID NO: 35061 - DNA, 61 bp, Chlorella protothecoides
gtggccgcccctcctcctctgcagctgcgcaacagtggcccccgtcaacacatctgcagga

SEQ ID NO: 35062 - DNA, 109 bp, Chlorella protothecoides
ctgggtggggttgggatgtggctggggtcaagcaccagccagacacttgagtccaggagcttggcaagagcagtacggtcagggggtgcaggccatgccccagcaggca

SEQ ID NO: 35063 - DNA, 61 bp, Chlorella protothecoides
ccccgcccgcaagcctcccgcatgtccggcaaaacaacaagtctctccagcaccctcatga

SEQ ID NO: 35064 - DNA, 78 bp, Chlorella protothecoides
taggggtggcgacttcttagatgggggcgggggcgacttcttagatgagggcggcggagacttctttgcaggcggggg

SEQ ID NO: 35065 - DNA, 115 bp, Chlorella protothecoides
gcgccgcatggaggatgggccggccaacccctccatgcttcgcagcctgcgtgggctccggcccttggccgttctcatcccagatgcgtacacccagattcccaaggtcaggcag

SEQ ID NO: 35066 - DNA, 61 bp, Chlorella protothecoides
ttccaccgcgcctcgtcgccgtctgcgatgtgggtggcaccggcggccttgtgcttgatgg

SEQ ID NO: 35067 - DNA, 61 bp, Chlorella protothecoides
ctcatatgccacagcctgcgccagaatgtcattggtggcatcaaggacatcttcctcgtta

SEQ ID NO: 35068 - DNA, 979 bp, Chlorella protothecoides
  modified_base (496)..(505): a, c, t, g, unknown or other
ccgtcaagccggagccgagcgcggcgcgggacgcccccgcgcctgccccggccgctgcgcgtggcgccgcggtttcctctgcgcaggcccgcacccggccggccacccggcacggtggggcgcagcccacaacgcgcatgcgcgacggcttcagcagcgaagaggaggaggaggaagaggtgaaggtggagagcgatgcggaggaggaggagggtggggagcgtgcgggccccgccgcggggccgagtcggaagcggggtgccgcctccgcccccgcgcccgccagggcggccaagccgctgcgcatccccaagctgcccatggtactgcagggcagggggtcctggtaccgtgcgcgggtggtcaaggacgccggggaccgcgttctcctgggtgagggcccgggggggggagtttctgggggggtggagcaactcgggctcggatggaaagtggttgtggatcgtgatgggaggagggagcgcggtgcggcctnnnnnnnnnnagtttctggggggatggagcaactcgagctcggatagaaagtggtcgtggattgtgatgggaggagggagcgcggtgcggcctctgtagtagcttctgttgagcgactttggccagtttctgaacgcctcttgtgaaaacctattggctcaatcctcatcttgcatgttctacattccaccccacccacttgctcgccaacccatctggagcgcacccattgatgcctcacctccccttcccccctcccaacatcccagagttcaccggcttcgaggaccagttccccgccctgtggctggcgcgcgccacggaccgcatctggcgcggctcctaccgcggcaaggattggaagtacctgggcgggggcgcctgggagcccaagaaggccgccggcgccggggcgcggcacgccaggaaggcggcggccgggcccggcgcccacgcggacgcagccgcgtcgggcgagggcccg

SEQ ID NO: 35069 - DNA, 103 bp, Chlorella protothecoides
gaggcgggcgaggggatgagaacctggcaaatggcagaggtgaaggtctcctctgctcctcctctatgcacgaccccaatgctctcactgatcaccctgggca

SEQ ID NO: 35070 - DNA, 70 bp, Chlorella protothecoides
catggaggggtcccattccgctccgatacctttcggcgaagcgctgcgcacagccggctgctcttcaggg

SEQ ID NO: 35071 - DNA, 77 bp, Chlorella protothecoides
ctcatgcacgcttgcgggaaatgcgggccggagagtcagcccaaaatagctccaaacattcctggcactcaggcagt

SEQ ID NO: 35072 - DNA, 103 bp, Chlorella protothecoides
ccctcgctgttccgttggcaatcgcgagaacttttgatatgttgagaaacctatgttcatcaattgaccgccgtggccctgcgtccttgcctctccgcggtgc

SEQ ID NO: 35073 - DNA, 1820 bp, Chlorella protothecoides
  modified_base (925)..(934): a, c, t, g, unknown or other
agatcccgcttgcgggaagcagctgtgcaatcggcgcaagcccggcagcggcatatcttcggctcgcgcgaggcatacgccggtgtcgaccacggacccccattccaaatttgattgggtgcgaaatatcagtctgtgtgtcaaggtcaagacgaaaaagatacagcgcgtccccaactcactcgctgtcttagatcattgcagcttgctggggggcagcacatcctctaacatcctgagggcaacaggatccggggcgtgcatcgacccagaggttcttggcgcatcacatggtgtccttggaggcctacacacctccgtcatgggctgcacacctgcccaacccgcccacccagcgcctgcgccttgcagtgacgcccagcctcctgcatccctggcccctgccgggcctgccgccaggcctcgagctcttcatcaagcgagacgacctgacgggcatgcagcttagcggcaacaaggtgcgctcgcgtgcgtggattgggcggggtggggcgtggaggaagcgggctggcgctgtgcaacggcgcctgcgctcatctttcctcattccgagcctggccgcaccaggtccgaaagctcgagttcctgctggccaaggccaaggcggagggccacgactctgtcatcaccatcggcggcatccaggtttgactgggcaagaaggcggcgctgtgcaggggtggtgccgagtaacggcacacgggcgctgtgactgctgcgcatgccctgctggaggccgtgacgtcatttgtccacatggcaggggtcggatacctctgccggcaagcatgtgcaccgctgcaatgaatgctgcactcagggggaactgacctatcatccatgccgcgcccccccccccccaaaaaaacccttacactcaccccagagcaaccatgcacgggcnnnnnnnnnncccaccccccccaaaaaaaccctcacactcaccccagagcaaccatgcacgggccacggcggtggcggcgcgctactgcggtctggactcccacctcattctgcgcacctcccgcctggcggcggactccgacccggggctggtggggaacctgctggtggagcggctggtgggcgcccacatccacaccgtgaccaaggaggagtacgcggccgccggctcccgcgccctgaccgcccagctggagcgccagctgcgggggcagggcacgaacccttatgtcatcccggtgggcgggtcaaacggcctgggcacctggggctacctgtcctttgtggaggagctgaggggccaggcggcggacctgggcctcacagacatcgtgctggtgggccttggtgggagtttgtgttcagtatgggcgtggaagggggtgggaaagggatgccgtcggctggcggctggcgtctgcgaatcaggagggagtggcctgccgttccctgcagcacggcagaccgtggcgtgccaggggaggggcgagcccttgccataacccgaccagtgggctaggtcactgacaccagaaattcagacaagtgcgctcccccccccattcccaacctttcaatttataggcgtgcgggagcgggagcaccgccgccggcatcgcgcttggcagccacctggcgggccttggcgtgcgggtacacgggtacgccgtgtgcgacagcgaggactacttctacgccttcatcgacgacctgctagaccaggtcgccccggcagaggcgcgcgggggggcgggcgccagggacctcatcaggtgtcttttgggatggtttgggggtgtgggggtgtggggggtggggagggagagggagcagaa

SEQ ID NO: 35074 - DNA, 601 bp, Chlorella protothecoides
ccagcgcatccgaagaggcggcggcgggggcgggcgccgcggaaggcgcggtggcttcggacgcccccggcggcacgtcgatcgctggtgcctccccaccagacgcgcccgacgacgcccctgcagaatccgtcccggcctccgccgccagcccgagcccctccaccgacgagggcgtggaggcgctggcggcagtgcgcttccgcgcggtggccgagccggcgctgggcccgctgctggcgggcgtggaggcgcgcgcgggctcccggcccgagtacgcgcgcctcctctccgattgccagggctcctactgcggcgcgcgcctggtggtgctggcgccggtggtgtacgctgcgctggcccggggggcgggcctgccaccgggcgagcagattgcagccgccgacgtgctgctgcgccggctgtgccgcgaggaggccgcgctgttccgccgtttcttccccgccagcgcgcagcgcgacgcgctggggaggctggtggagccactggcgcagcgcgcctacgacgcgctgaggccgcgcgtcgtggccgagcaagcgctggacgcgctctgcgcggcggccgacgcggcggcggccgc

SEQ ID NO: 35075 - DNA, 76 bp, Chlorella protothecoides
caagcatcacccctcagtctaccaccgccacccttccaggtgtgacgcaaaagtacctggtggtcacctgcaacta

SEQ ID NO: 35076 - DNA, 104 bp, Chlorella protothecoides
tcagaacgcatcgcatgcgctatgaggatgactggcagtggtcatcatcagatgttcttccctcgttacacatcgtgcatcgcaggcagaaacccaaatacaac

SEQ ID NO: 35077 - DNA, 61 bp, Chlorella protothecoides
atggttcagtccacagaaccttatggcccgggctctcagccactccaaatggtcaccccac

SEQ ID NO: 35078 - DNA, 63 bp, Chlorella protothecoides
tagcgggggcaaaccgcgcattgtttccaactaattgaagattttcagatgtaaataaacagt

SEQ ID NO: 35079 - DNA, 154 bp, Chlorella protothecoides
ggcacttgttctgtgcgcacagatgcaaacaactccgccagccgctggaggcaaggccctgcgccggacttcaatgcaatacatcgtgcagatcggattcactacagagtcggtgcggcttccaaggccacccgactttgccccgctcgacctc

SEQ ID NO: 35080 - DNA, 61 bp, Chlorella protothecoides
ctggaccagggccgagcactgcccgggggccagcaggccatccagtgcctcctgggcggca

SEQ ID NO: 35081 - DNA, 7387 bp, Chlorella protothecoides
  modified_base (345)..(354): a, c, t, g, unknown or other
  modified_base (1223)..(1232): a, c, t, g, unknown or other
  modified_base (2437)..(2446): a, c, t, g, unknown or other
  modified_base (3212)..(3221): a, c, t, g, unknown or other
  modified_base (3278)..(3327): a, c, t, g, unknown or other
  modified_base (4372)..(4381): a, c, t, g, unknown or other
  modified_base (5357)..(5366): a, c, t, g, unknown or other
  modified_base (6956)..(6965): a, c, t, g, unknown or other
  modified_base (7026)..(7035): a, c, t, g, unknown or other
gcgtggcgggcgcctcccccggccccggctccgagcgctgcacgatccaggggccctgcaccaaccccgactgcgaacggccgcatgcctcgccccagtggcgcaaggggccgcccagccaccccatcctgtgcaacgcctgcggcacgcgctggctccggaacggcacgctcaaaccactggtggtgaggtggtgtggaaggtgttggggggaggtcgggggaacagagggtctgctgtgtgataggtagagaaagtatggtgtcacagacctctggggtatgccaggccggggatgcggggggcctccaggtgggccagggccgattgccccgccctgcgctnnnnnnnnnnaataggtagagagagtgtggttccacagacctctggggtatgccaggcaggggatgcgggggggcctccaaacgggccagggccgattgccccgccctgcgctccacccgcccacccctttgcatccaccccgccccatcccctgcgcagccccgacgaggcctgcggtacaaggcggtgcgcagcggcagcagcaaagggctgggcgcctccgtcagccagcaggacctgagccagccggcaggcagcagcgcggcaaggcttgggggcgagacggagcctgcgccgcagcctcgccccgagtccttttcgcacagcgcgacggggacgccggcccccccgaccccggcgacggggcccctgccactgcccctgcccctgctcccgctgggcctcccggcctcgctgctggcaacgctgtgcaagcggggggatgcgccgccccctgcgagagccgtctcgctgcagcacgcggcgctggcgtgacgtccggccacgctcggctctgccccgagccactgcacctgacgctccatgcccgccgagcgggcgcatgtcaaaactccaggggccgacgagccctgcgcgcccccctttcccccccccccgcaccttctggttacctgctcccacccctttttgtgctgagaccgtgcccatcaccatctggcacttgccaaggcagaaggaaaggggtttcagagtgaggggcgtggcagcatgggctcgctggtcgatgaccaaaacatgtcacatggggaatcgatcaggatgggcatgcaaagaaaaggatgggggttcgcgatgagcccagaggtcacgtgcccattcccaggctggctcaggggtgcagcggtggcagcccctcnnnnnnnnnnatcgatgaccaaaacatgtcacattgggaatcgatcaggatgggcatgcgaagaaaaggatgggggttcacaatgagcccagaggtcatgtgcccattcccaggcaggctcaggggtgcagcggtggcagcccctctggccgggccgaaggcgcctcggccccctgcaccgtcagcgcatcgccgcctcgtgctgtgctcgcccccgcctcgccctcgccgctccccacagcctccgtccctgcctccacctggccgctctgccccgcgtccgaccccgcttgcaccccgccgctctgcacagcctccgcccccgcattcagcagcctggcgcgcagcagggagagcaggacgttgggccgggggctttgaccgaggcgcacagccagggcgccgcccgccagctgcacgcaggccatgaatctgacgaggagggggagggagggtgggggcgcgccgctctcctcctcctccgtcaggaagcgggggagcaggggctgcccggcgccggccagcgccagcagcgggggtgacacgggcccctcgccctccacggccgccaggaggctgaagtgcgagcgcgaaaacagaacggccaccggctccttccagcaggcctggccagcgccggccgcgatcagggggaggtatacacccgtcatgcctgcacccatggggaagctggtgatgagggcgggggttgaaggccgcggggcgcccatggaaggcgaggggctggggtgacgcaccccgcgggatcatgacgagacgagcctcgcctcgggcgatgcgcatgcgcgtccgcacaccctttcttctcccctcccctgacctgccatggcggcctgggggccgccgtacaccagcagcggccgtctcaggacgtttgccagcgcaaaggcgtggatgtcggagaggtagtcgttgccgcgcagcgccgagacctcccgctcccactccgcgccgtgggactcctctgggatccccacctggggtgcaaaggaatgtgcgggggtgacacggcaggctgcgtgccggaaggtgcattgctgggccgcgccgggcacgcggttcggtcaagcgacatagattccggcacaaacggccagggtcacaccattctccacaggtccccctccctctccctctccactccccccccgaacccttcgccggtcgctgaccctgcggaggtgccgctggaannnnnnnnnntcggaaggtgcattgccgggccgcgctgggcacgcggtacggtcaagcgacatggattccggcacggacggccagggtcacactgttctccacaggtccctcacactgttctccacaggtcccctccctctccccctccactccccccccgaaccctctgccagtcgctgaccctgcggaggtgccgctggaacctggcctggatctggggtcccgcccgcgcatcctgcatggaggccagcagcgcgctgcgcagctcgccgtcccggtcctgcacgccccagacccccatggaggcggcgtggtccaggcagttgccgtcgcccagcgtgcacagcacgagcaggcgggtgcagagggggaaggcgttgatcacgccggcctcctcggcctccatcgccgccgcggcattcgtgagctcgcccaggacgagggagcgcacggcgggggggtgcgcggcgaagctgggcaggagcagggcggagtccgagcaggtggccgggtccttggggccaaagtggaccagaccggagacctccgatgtccagcgctcctgtggtgtcgagggaggtttggagcccaagggctgtgaaggtcatgtggggtggcccaaggattcactgctctcccagggcaagctcatgcgaggcttgatttccgtgcattgaggtggcgtgctgtcccagacagcttgtgcactcagcctcattcgtttggatccccctgcctccaaggaattaaccaggttagacacttcatgagaatnnnnnnnnnngtcagggagttttggggaccaagggttgtgaaggtcatgtggggtggcccaaggatnnnnnnnnnnnnnnnnnnnnnnnnnnnnnnnnnnnnnnnnnnnnnnnnnngtcccagggcaagctcatgcgtggcttgaactccgtgcattgaggtggtgtgctgtcccagacagcttgtgcactcagcctcatccgtttgggcccccccgcctccaagcaattaaccaggttagacacttcatgagaatcacattcccactcgcccacctgcgcccttttctggcgaagcttgttggcgatgccaggatccactcccgacatgtggcgctgcatgcacggctgggagggggaggggggctccacccctccctgatcgtcaagggaggccgcgatggccgcccagagctccgggtcgtcctctcgagcgataggcgcgttgggcgtcgtcgcccggtcgacactggaatgccggctgatcacacccagcacatcggcatcgcacgacgcccgggctgctgtcaccatgcgagccggtcgaatgaagggcctgcagattccgggcggagctcctcgcggggaccggaaagcctcgacctcctcagccccgcagacgcgggagcctgagtgctgttaaagcagattcgcgacaatgcaagtatcacaatacacatgtgcatgcaagcctggctgcacgcggcatcccgcacgtcacggcggggcccgacacatccggcagaagaaagcagcgcgctgccccttcaccctggcaaaatttgaatcggtatcacatggtggtagaccccggcccgtggcgctgcagccactccaacgccgtgatccactgctcgaactcggtctgcggcgagtccagggcgtggttgtcctccgggaagaccaggatcttggtggcggggccggcctcgccgcgcagcacgcgcagcgcgttcgcgtactgctgcgcgtcccgcagcggcacccgccggtccttgccccccagcaggaagagcatgggcgccgtgacctgagtggcacaggtggtcggcggggggtactcggtgtgcaacgcatgcctgggctgaagggcggccggatgcgcagtgccccaggggaagcctggaccacccccagtgggatgttgggcgtcgtccacgcnnnnnnnnnntgtgtgctacgcatgcctgggctgaagggcgactggatgcgcaatgccccaggggaagcctcgaccatccccagtgggatgttgggcgtcgtccacgcaggatccatctctccagcagcgcactcttctgtggaccgggcaggcatcggccgcctgctgctctcagggaccagcactcacaattccctcactcggcttccatccctctcacccctacacacacacaccttgtcgacgtgtgcgatgggcgagacggcgtggaagcggtccaagtcttccgaaagaggcttgacgcgcgcgcggcgcgccccctccgcgccccacgcctccacgtagcaccagtcggggatgtcgctgagctggaccatgaggcccaggtccagcaccgggttgcgcagcacgcccgcgaagaagtcgcccggcgcctggcccagcaggtgccccgccaggaagccgccgtgcgagccgcccaccaccgccgcgcccgcgccggcgcccgcgcccagcgcgcgcgcgcgccgcagcgctgccaggcagtcgccgacgtccagctcgcccacgcggccgggcagggcctgcagagaagcctccccgaaccccgtggacccgcggtagttgaccagcagcacatcatgccccagcgcgcacagcgcgcccagcacgggcgagaactcggaggagaaggcggagtgcgggccgccgtgcggcatgagcagcaggggccggggggtggagtcagaggagcctgtggagatcatgtggtctgcggtggtggccgcacggcctgcgctggtcggctgatcgtcgttggcagggggctctcccggggtcggggtgcttgccgacacaggggcgccctcgccggccgcatgcagcaggagggcctcccaggtgggacccgagccgtctgcgccatcgtcgccaggctcggggcacacgacagtagtgcgcagcgtgcgcagcgtggctgccagcnnnnnnnnnncgggacccgagccgtctgcgccgtcgtcgccaggctgggggcacacgacggtggtgcgcagcgtgcgcagcgtggctgccagctcgggcggtaccgcgtcgtcctcggcgtcccccaaatccagatgagcccaggaagtggggcccagggcctcgccgcggcccaggtgggcgacgtacggcgaggggggttgatgcagggagctgcgcgttgccaccgcccagcctgtcaggtcatgtgtatggggaagggggatcaaacgtgtcagtggctgtgcgcacctgtctacatgtgtgtgtagcgcactggggaggctgaagccagggaccgcgctgggaagtggcccagtgacgcaagctggcaatcggtggccgggcacccaggcgccagccgcccggcctgcggtgccctgtagatggacgcctggcgctggcgatgggcaggcacaccctcaagcaaccccgcattcccactccccgcgcagtccacccgcgccgcccacccgcgtcggcagccagcaggctccagctggcgtggtcgggccccggcggggggctcacgcgctgcacgctgcgcgcactgagcgacacggccagcactgccgtggtgctgcgccactgggaggtgaggagcagcgtgtcggcgtccacccagggctgggccgggatcaggccggagtagaggcccgggaaggcggcgtaggggtctgggcctgcgggaggggctcccgcctccaccccgaccagcatgtgcgggggctcccgggccggccccgccccgcaccaggtcagcgcgtgcagggacgccgaggcggcgtgcgccccgctctccaccgcggcggcctggctcaggaagaccagcgtcccgccgtccgggctgaaccgcggcgagaaggcgctgctcatccccggcgtcagcagcgtcgcggctgggtatgatccgcccgcgggcgcctcggccgcgccctggaaccccgcctccagcggcgccccctcgatggcagcctcgtccctggcgctggcgtccagctgcagccacggcgccagtgccaggtggcaggggcggttgaagcagtagacaatgcccaggcgctgcgtcaagcccgggaagttgtcgggggcgtgcggccagcgcacaaacacgatgccatcccctggaggagggaagaaaggagggttggggagggggaggggggttgagtagccagatttgcttaatggcgcagcgccgagcgacccgccctcctcagggaacccggccctgcacgggccaggaatctgcggaccccaccggcgcctgggagtttgagagctcttcttcccgaagcccctcttcccagaacccctctcacgtgataaatcgcctactcccaccccttcccatgaacctcacctcgcggcgtccagaccggctgtcccatgctgtacgcatcggcatcccccgccgccacacgcgccacgctccaggacctggtgtccagcacgaagaggctcggcgagcgcctgcccgtgtaccgctcgccccaatcgtcccgggcggggcccacgccgtgccaggccgcggggccggcgctctcgctttctttgcgcnnnnnnnnnntttgggggttgcatagccagatttgctcattggcgcagcgccgagcgacccgccctcctcnnnnnnnnnnttgcccgtgtaccgctcgccccaatcgtcacgggcggggcccacgccatgccaggcagcggggccggcgctctcgctttctttgcgcccatcccgggcgccgccccaggcggggccccggggcggggcgggggcctggcgttttgttttttttgggggggggaggaggagatgggttctggggctactggggggcgcgggtgccaggtgcggtggcagtcaagcagcctggcggagggcagggctgggtggcacacacagccacagcagcgacctcccgcagtgcctcaggcctggttcccgagtcacgtccacacccacatccacagcctccacccacccaccccctgcca

SEQ ID NO: 35082 - DNA, 156 bp, Chlorella protothecoides
ccttcaggcccccacaggtatacttcctgcctccagccctctcccagccaacccagccgcaccggcgtcattcaggacggcaacacagacggcctccagcgtcttctcgatgtccagcacgttcaccttccagagcgctgccagggtcttctcggc

SEQ ID NO: 35083 - DNA, 121 bp, Chlorella protothecoides
cctttgcgtgagagacatgccgtactgatttaaaaagcctttcccagtctgcggtccagccctggactatgccagaacgacaacccggtcctcgctcacatactcccgttcttcggccccg

SEQ ID NO: 35084 - DNA, 112 bp, Chlorella protothecoides
tcatgggcacccagctcagacaactcaatcacctggcgcgggcaaagcagggcacggtggcaatcgagtcaagcactctcctcacccacccacaagcacacaccagagatgt

SEQ ID NO: 35085 - DNA, 71 bp, Chlorella protothecoides
catgacacccagtccagagtgcatttcccctgaaacgaccgcgcaccaaaggggatgaaggcaaagtcgga

SEQ ID NO: 35086 - DNA, 216 bp, Chlorella protothecoides
taaaggacaggcgttggatagacttgagaacttgccaacgatgctggtgtgtagaggggcatggaggtacccaggactaccgcacggcggcacagggatgcctggcctgctgcacgatctgccgcatcaatctccaactcctctactcgctcttctgcagggctgccagccacggtggttgcgtttgtgtcgccccacgctctgcgtgctgtgctc

SEQ ID NO: 35087 - DNA, 115 bp, Chlorella protothecoides
gcagtatccatggggcgatggggtggggtggggtggtgcagcacgacacaatccctctcgcctggcagcgcctcgggggggcgccggggggtgcggctcacaggaagcccgtgcc

SEQ ID NO: 35088 - DNA, 89 bp, Chlorella protothecoides
aagagagctgattccctcgtgtcctcaaagttggcctcctccccatgattaacaccaggctcaaccaacatcacgccatgcaggaggct

SEQ ID NO: 35089 - DNA, 81 bp, Chlorella protothecoides
cagccctgcaccgggcgtgggttggtggagtggcagatgcgtggctggaccggcatgctagtcagactctggtgaaagggt

SEQ ID NO: 35090 - DNA, 61 bp, Chlorella protothecoides
attaaagcagcagcaggaggcggacaagggtgctagacgagaagctgaagccactaaagcc

SEQ ID NO: 35091 - DNA, 77 bp, Chlorella protothecoides
ttcccgacgttgttggtgccaaagttgttcgtgcctctgttgccggcgccaatgttgccattgctgtctgccgcgca

SEQ ID NO: 35092 - DNA, 61 bp, Chlorella protothecoides
ttaccgtgctcccctccagcggcaggcagggcagcccctcctggcagggccacccctcctc

SEQ ID NO: 35093 - DNA, 73 bp, Chlorella protothecoides
ctcctcccctgcccctcccctcctgacctctgcagctccagctcacctcgcagccgaggcggaggccctggcg

SEQ ID NO: 35094 - DNA, 130 bp, Chlorella protothecoides
agctgcagggagagttcaccgccagcacatcccggggcccagtccccaggaatagagactggtgtgcccagggctgccacatcaagagagccctcctgcgcggcagccctttggaaggcttcctcgtccg

SEQ ID NO: 35095 - DNA, 61 bp, Chlorella protothecoides
gcgccatcggatgcggcgcctggcgcagcgagggatcctgcgtggcgctcgccgtgcagac

SEQ ID NO: 35096 - DNA, 75 bp, Chlorella protothecoides
cacaccctgactctgtaggcacttgcctacattgtcgcaagggcaactcaacatctctacatgcttcagcagaca

SEQ ID NO: 35097 - DNA, 62 bp, Chlorella protothecoides
gaggcatcctcggggctgggaggaggaggagacttcttcttgggagaggggggtggcggcga

SEQ ID NO: 35098 - DNA, 64 bp, Chlorella protothecoides
ttgttggaagtggaggagctcttcggcgcctgacgcaagctgttagggaagtgggaaaggagag

SEQ ID NO: 35099 - DNA, 130 bp, Chlorella protothecoides
gctggtgatccccccccgccgcactcggtaccgcgcctcgatggcggcccagatttctgcctcgcgcggcaggacgctgacctggtccagaaaggaggctgcgatgcgcgaggcggtgtatgccgcctcg

SEQ ID NO: 35100 - DNA, 116 bp, Chlorella protothecoides
caggtaggcacaagaggcgcctcagcagactggaggtggcctcctggcccgtagtccttgctggccctgaccccgctccccagcccatgccaggtggtacctggatgtcatacggg

SEQ ID NO: 35101 - DNA, 210 bp, Chlorella protothecoides
ctgggcaccagcgcaggcagagcaccagcacaggcggggaaattctgactgctgccgcccgccacatccaccccgaccaagccactcaccaagcatgcatgcatccccccccccaaaaaaaaataaaacacccacccacctttcttggaactccggggactctgccaggaactccaggcccggatgactgatcaggatgccggccagcac

SEQ ID NO: 35102 - DNA, 72 bp, Chlorella protothecoides
aggtcaacggttcgagcccgtttggggccaggcacaatgtttccggccccatagctcagttggttagagcgg

SEQ ID NO: 35103 - DNA, 61 bp, Chlorella protothecoides
agggataccgggcgctcgttttgacggactcggtgccagagggtggactttgaacggcttg

SEQ ID NO: 35104 - DNA, 113 bp, Chlorella protothecoides
ggcactgagcctgggcggtcattggatccccaccgcaagtaaatcatcgattgaagtgcacaggtccatactttggatcggtgtggggaagcagtggacgctgggcacacgcg

SEQ ID NO: 35105 - DNA, 85 bp, Chlorella protothecoides
tagaccaagatccggtgacggctgacgagatgtcctacatactccaagccccacgggcctcaccttgttggggttccgggcctgc

SEQ ID NO: 35106 - DNA, 61 bp, Chlorella protothecoides
aaagcttagtccttgcagaaattcctttgggatatcgctagcgtgataccatccgacgcag

SEQ ID NO: 35107 - DNA, 493 bp, Chlorella protothecoides
  modified_base (210)..(414): a, c, t, g, unknown or other
cagcatgtttggcagggcctgcatggtctccgcaccagtccccgctagggcggcctgaggggggtttgcagtgggtgctggaccgcaagcgtgggagtgtgatcgccagtgactcccgcgaggaaatgacccccctcccacaatccactcccgggcgaccagcgccgccacaccctgcacacctcccagtgcggcttcagctgggtgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctggggggtgttggataagtttggaaggtggggggggttaggggactgcgtcttggtggtcttccctctgacccagg

SEQ ID NO: 35108 - DNA, 90 bp, Chlorella protothecoides
acctaagcgcacggcccccggcgcggtcggggcccgcagacccagcatgttgaggcaatattgtcactgagaggacccctatgtcatact

SEQ ID NO: 35109 - DNA, 61 bp, Chlorella protothecoides
tgtcatcccaggtgtcttcctcctgacattagcgttctcagaggactatcccaacaaggcc

SEQ ID NO: 35110 - DNA, 61 bp, Chlorella protothecoides
acctgtgggccccgccgctcctgccctggttctgcccgacagccagtcaagcagcgcagag

SEQ ID NO: 35111 - DNA, 78 bp, Chlorella protothecoides
tcaaggagctgcacaagtgagtggtgattgctttgtggaatgtgtgtagtgccatccctctggggcctgtgtcacgac

SEQ ID NO: 35112 - DNA, 65 bp, Chlorella protothecoides
ggttagacgagcccaggcggggccaagtgcagggcacatatgcgccagtgccgcacaaggcctcc

SEQ ID NO: 35113 - DNA, 135 bp, Chlorella protothecoides
cccatctgacgattgcttagatgcacccgtcgtgatcctgaccggttgttctccgggcctttacccaaatatctgcgtacgagcaggtgttccaactgctgtctgcattgcaacagtaccaataggtgtctcggc

SEQ ID NO: 35114 - DNA, 62 bp, Chlorella protothecoides
gcccggggatttctaggggagggacctgcgcccccctcagtaccgcagccagtatgtcctcc

SEQ ID NO: 35115 - DNA, 150 bp, Chlorella protothecoides
ggctgcagagacctatgagtgagactgtggctgggttgttgttttgttgcttgtacacgggtaagcacctgccaaggctcccctgcaagggcagcacatgtcgatctccgctcgaccctactcagtggccgttgcagctcggctgccgcc

SEQ ID NO: 35116 - DNA, 61 bp, Chlorella protothecoides
ggggcgtgatcaggggtttactgagacctgggaggactaaagtatgatatgtagcatccgg

SEQ ID NO: 35117 - DNA, 135 bp, Chlorella protothecoides
ggcggggagtgtcccgtggatgtactcgagcgagttcccggcagctgccctgcccacccaccaagggccacacaacactgcattccccccaccatgctaggcaccagggcgtgttccaccacaccccagagaacg

SEQ ID NO: 35118 - DNA, 108 bp, Chlorella protothecoides
cgccaccaattgccaggcttggagtaagcacgatgcatcatattgagttgctgttggtcgcgagacagcagtcaatctgctggaatcaggcgctcggtcagcactcgc

SEQ ID NO: 35119 - DNA, 78 bp, Chlorella protothecoides
cccccccccccccccccccccttctccccatgcgatgcagcacacgtacatgtgctcttcccccccactcctactgtg

SEQ ID NO: 35120 - DNA, 76 bp, Chlorella protothecoides
ctttgtgtgccccggcaaccacagtccagcaggcggccccaatgtggcgcgacctattcgattggaggcggtgctc

SEQ ID NO: 35121 - DNA, 618 bp, Chlorella protothecoides
ccgccgcagcggcggccgcgccaggcctgccggccaaggaggcccgtgccgcgctgctggacgcggccgtgcgcgctttcctcgcccagcgcggcgagctccccgcgcccgagcggccgcggtaccccaccccttcctcccacctcaagggcgccgacctggggctgctcaacggcgtgctggcccgcctggcagacgtgcacggcacggcgctggaccacgctgggctgacgcgcgcggcgctggcgctggagctgcgccgagcgctgcgcctggcctgggaccgggtccgggaccggcccaggagggcaggggtggagggtgggccggaggagggcggcggggatggtggcggtggagacaccgctgccagcgtggacaggagcccccaggaatccactgcaccccaggtgggggcccggtccagggttcgcggcgggcggggttcgcacaggtcctacgaggcggaggcctcctcctcgtcaggcgaagatcccccctcgtcccccagctccgatggagggccccccagcccctccccctccaccagcagcctggacggcgaggcgggcgggccgcgcggccgccgggcggcggcgcgcagaggccgcggcgccg

SEQ ID NO: 35122 - DNA, 75 bp, Chlorella protothecoides
tttcaagaagcgccctccccctgtgagattagttttgcaggaaacatcggttaaatcaaacatgcgctgacttgg

SEQ ID NO: 35123 - DNA, 82 bp, Chlorella protothecoides
ttggcggctgacggcgcatgccgtgcagtcgtgtacttgggagctcgcggctcccccccccccccaaaaaaagcctcctacc

SEQ ID NO: 35124 - DNA, 61 bp, Chlorella protothecoides
acagctgcttcccgcaagcgggatctgacttgcgcagttggttgcctctaatggcgaaccg

SEQ ID NO: 35125 - DNA, 126 bp, Chlorella protothecoides
catctgggggaatggcgccgccctgcagtgattggccggctcggcagtgaggtgcggtgagcgccgtcttgacatcccacacaactccccgtcacgagccgccaggtggcgcgaaggctgttgcgg

SEQ ID NO: 35126 - DNA, 381 bp, Chlorella protothecoides
  modified_base (125)..(312): a, c, t, g, unknown or other
acatgtacatcgccgagctggataggtaggagtgagggtggggggagagccggcaggcgaaaatcatcgtgcaagttcaggaaagtaatcaacagcagtcaaggggcccctgctctgctatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaagcgcccccccccttctctccccactaccctcatgcaggaagacggtgcggcacaagatggacca

SEQ ID NO: 35127 - DNA, 127 bp, Chlorella protothecoides
tcggaacgcaccaatcgcacgtatcctccatgagagatcccagagaaattttgcgggtaacaaataacacactgagatactcctcaagtgtatctgctgccgatgtgggtcctctccaggcagccct

SEQ ID NO: 35128 - DNA, 80 bp, Chlorella protothecoides
gccgcctgctgctggatgtctgagatcgggcgccaccggccccgacgctcatgcagcccttcagcaccactggctgaact

SEQ ID NO: 35129 - DNA, 122 bp, Chlorella protothecoides
ggggagggggggcaataacatggtggccaggggaatcggccacctgtcatgtagccgggctcgtcgggctcgatgctgacggcgcagcctcgccccctttctccctgcgcaggcccgctccc

SEQ ID NO: 35130 - DNA, 74 bp, Chlorella protothecoides
gaaatctcgatgttcaggctccaggacgggggccccatgctcccactcgacaacagcacatgtgcaaagcaaac

SEQ ID NO: 35131 - DNA, 61 bp, Chlorella protothecoides
gatgggtggtggtggtgtacaggggaggggcagggaagggaaggtgccccgaagaaggtgc

SEQ ID NO: 35132 - DNA, 140 bp, Chlorella protothecoides
gtccttatatcccgagctcgccgctcacaggaggaaacgagggagagtgctctctcagctcaatgatcgagtcttatacgtaaggttctcatcagcgtggacaccagaatggatactaggaagtgtgatggtaatcaaat

SEQ ID NO: 35133 - DNA, 75 bp, Chlorella protothecoides
cctgccgctctggcatctgcaagcaaccatgctacccctcccaccaataacctcacctgcggtgtggtgtgtgag

SEQ ID NO: 35134 - DNA, 61 bp, Chlorella protothecoides
tcggcggtggacctggaggagatgggcttcctgcccggttggggcaacaccgtggggcgag

SEQ ID NO: 35135 - DNA, 61 bp, Chlorella protothecoides
cagcagatgttgatcgcttagaggcagccctccaccagcctctgtcacccgaccctccacc

SEQ ID NO: 35136 - DNA, 111 bp, Chlorella protothecoides
cagctcgtgcacagctgagtggcattggagacccctcacctggtccctgtatggaggactctctcacccacctccccagcacacacacacagaagcaatttttgatgacag

SEQ ID NO: 35137 - DNA, 80 bp, Chlorella protothecoides
ccatgccccctcctcccctttcccaggatggggcccaggcggggatgtcccccccacggcactcacttgtatcgcgcggt

SEQ ID NO: 35138 - DNA, 61 bp, Chlorella protothecoides
tgtctgcacccccccccccccccccccccctcttgtctcaggctgcctctcaacgacccgc

SEQ ID NO: 35139 - DNA, 67 bp, Chlorella protothecoides
atctgagtccctcatcgccatcctcatccccacacaactgccacccccgtcacggacctgggttgtg

SEQ ID NO: 35140 - DNA, 72 bp, Chlorella protothecoides
gtgatggcgagacattggggcgggaggtgaatggatgagtggcatgggcactggagggcgagaggacaggtt

SEQ ID NO: 35141 - DNA, 426 bp, Chlorella protothecoides
  modified_base (130)..(351): a, c, t, g, unknown or other
tctggctacaggtgtggaggagggagggccttgggtgtgatgccatgttttccccgcacgcctgtgcagagctgttgtggaggatgtgagtgcacgcgtggccctgggagtcctgctgatctgcgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctgacctttacccgggatcccccgatcactcccccctttcctcccaggcagcacgacgtggagcgctttgcc

SEQ ID NO: 35142 - DNA, 80 bp, Chlorella protothecoides
ggggtctggggaaggaggttgtgcgtggggttcatacagcgagacatctcggtgagcgccacacgctgggttgcatgcat

SEQ ID NO: 35143 - DNA, 78 bp, Chlorella protothecoides
tgatcaggagaacgcggcctgctcagacctcgtatgaaatgcaaggccggccaggatgcaggcatatgatgctgggca

SEQ ID NO: 35144 - DNA, 168 bp, Chlorella protothecoides
cgccgcgcagcgccccaagcttggcggggtgaggatgatggcccatttgtgcccggttgcgcccccgttgggctttgtctcgctgccatgctctgataccctccccctttcccgtcggggcttgcgcatcatttggtctcatcacagctcaagttttcccggcctgcg

SEQ ID NO: 35145 - DNA, 61 bp, Chlorella protothecoides
ggattggataaggccagcactggcagggggaggaataatgtgccagggagcttccctcaga

SEQ ID NO: 35146 - DNA, 61 bp, Chlorella protothecoides
cgtctcccttgccgcctctcatgcactcctcccccccatcccggagtagttggagctcata

SEQ ID NO: 35147 - DNA, 301 bp, Chlorella protothecoides
atggggggctggggaggggtatgcaggaagcgagggggccgatgctggggtccgatgcgctcctgaacagggagggagcaggcgggagctcgagctcgatggaaggtccagtgaggtgccgcctggcgccacgagcagggtgccactcgagctcctgagcgtgaacatgtccaggatcgatggtctgccctgcatccctggcaaccgcctcgcgccctctccttcccaccctcttccaccgtctcacctgcaacccccgctcccttccccccggcccccagcgcttcgaactacatgctgg

SEQ ID NO: 35148 - DNA, 72 bp, Chlorella protothecoides
ttgctcagagggggcttggagggaagcatgggccttgatcattgcactgtgccttccccacgtattaaagcg

SEQ ID NO: 35149 - DNA, 116 bp, Chlorella protothecoides
ggacttgaccatcgtcatccagaacatcgtgcggaaggaaatgggctggcctgagcgaaagaagctgcagcctgcggaattcttgggcctcctacgtgacttcccggaccgcttcc

SEQ ID NO: 35150 - DNA, 73 bp, Chlorella protothecoides
gcctccatcacgattgatcgtctggtcaaatgggttggcaagaaatgtgtatggtgtggtgcatggcggggcc

SEQ ID NO: 35151 - DNA, 77 bp, Chlorella protothecoides
tgttgttcgaccccacattgtagtcgccgcagttcccgttccctgcacagcagtggggtgggtggttgggtgtggga

SEQ ID NO: 35152 - DNA, 77 bp, Chlorella protothecoides
cggcacagtggggaagacagggtccaggtgtgaatgggccaagagtccatggtcctccaacaaacacacctctgttg

SEQ ID NO: 35153 - DNA, 61 bp, Chlorella protothecoides
gccgccctcctgcgcctcgggggtgacatgtccgatcacgaagccgtgggagccgccggag

SEQ ID NO: 35154 - DNA, 61 bp, Chlorella protothecoides
ccaggatccaatgccgcaatcggggcagggtgacgatcagactcatgcagccgctctgtgt

SEQ ID NO: 35155 - DNA, 78 bp, Chlorella protothecoides
gtgacccagctgcgcaccggatggcaactggaggcctccggaccaatctgtggatccaatgaacgtagcaatctgctg

SEQ ID NO: 35156 - DNA, 75 bp, Chlorella protothecoides
caccggaatgttcatgacgaacgcctcatgcactcactcgcactcgtccgggcgacttcatgcagctgccaatcg

SEQ ID NO: 35157 - DNA, 74 bp, Chlorella protothecoides
gtcccaggagctggcgaaggaggggcagcctacctccgagccggcggcacccgagggcggcgagcccgccgccc

SEQ ID NO: 35158 - DNA, 23246 bp, Chlorella protothecoides
  modified_base (1593)..(1602): a, c, t, g, unknown or other
  modified_base (1855)..(1864): a, c, t, g, unknown or other
  modified_base (2061)..(2070): a, c, t, g, unknown or other
  modified_base (2245)..(2254): a, c, t, g, unknown or other
  modified_base (2668)..(2677): a, c, t, g, unknown or other
  modified_base (3040)..(3049): a, c, t, g, unknown or other
  modified_base (6446)..(6455): a, c, t, g, unknown or other
  modified_base (7173)..(7182): a, c, t, g, unknown or other
  modified_base (7751)..(7760): a, c, t, g, unknown or other
  modified_base (8029)..(8038): a, c, t, g, unknown or other
  modified_base (9038)..(9059): a, c, t, g, unknown or other
  modified_base (9118)..(9127): a, c, t, g, unknown or other
  modified_base (11774)..(11783): a, c, t, g, unknown or other
  modified_base (12251)..(12260): a, c, t, g, unknown or other
  modified_base (12780)..(12789): a, c, t, g, unknown or other
  modified_base (12895)..(12904): a, c, t, g, unknown or other
  modified_base (15160)..(15169): a, c, t, g, unknown or other
  modified_base (15555)..(15564): a, c, t, g, unknown or other
  modified_base (21044)..(21154): a, c, t, g, unknown or other
  modified_base (22459)..(22518): a, c, t, g, unknown or other
ggccgagaaggccgcggccgagcaggccgcctcgcccgaggccgtccgcacggcgacgctgcgctcggccgccggcgcggcggtgggcctgggcgcggtggtcggcctgggcgtgctgtccccctcccccgccttctcctccatgctgaccaagtttggcctggcctcggtgtgcggctaccagacggtgtggggcgtgactcccgccctgcactcccccctcatgtccgtcaccaacgccatctctggcctcacggcggtgggcggcatggccgtggccaccggcggcctggtccccgccggcgcggcgggcggcctggccgccaccgccgtgctggcctccgcggtcaacatcggcggcgggttcaccatcacccagcgcatgctgggcatgttccgcaggcccggcgacccgcccgagttcaccggcctgtacggcctggccggcgcaggcgcgctggcggcctacgcggccggcgcggcggcggggtacgccgaggccacccccgccgcctacctggcggcctcggggttgtgcatcgcctccatcggcgcgctggcctcccagcgcaccgcccgcctgggcaacgtgctgggcgccacgggcgtgggcctgggcctggctgcgacgctgggcgccgtggtggccaccccggggtccgacgcgctgctccccgtccagatcgtcggcgcgctgggcgtcggcgcgggcgcgggcgcgctggtcgcccgccgcatggccatcacctccctgccccagatggtggccggcttccactccctggtgggcctggccgcggtgaccacctccatcgccagctacatggccgccgacccggcccacctggacgccgtgcacgccgccagcacctactttggcaccttcatcggcgcggtgaccctcaccggctccgccgtcgcctttggcaaactgcacggcgtcctgccctccaagccgctggcgctgccgggcaagaacgtgctcaacctgggcctgctggccggcaacgccgcggccggcgccgccttcctgaccacaggcgacccgggcgtggcgctggccgccctgggcgccaccaccgccctggccggcggcctgggcgcgcacatgaccgcctccattggcggcgccgacatgcccgtcgtcatcacactgctcaactcctactccggctacgcgctctgcgccgagggcttcatgctgggcaacgacctgctcaccaccgtcggcgcgctcatcggctcctccggcgccatcctgtcctacatcatgtgccgcgccatgaatcgctccctggccaacgtcatcctgggcgggtacgccaccgccgcggccgggcccgccgccgaggtgggtgggacgcacgccgaggtggacgcgcacggtgctgccgaggtgctgacgtcagcgcgcagcgtgctgattgtgccggggtatggcctggctgtggcgggagcgcagtacgccatcgccgacctggtcaagcgcctgcgctccaagaacatcgccgtcaagtgggtcggtggggttgagggggttgagagggggttgacgggggatcggggggcgaaagggggatggtgcttgaaggnnnnnnnnnngtcgccgtcaagtgggtcggtggcgttgaggggattgagggggggttgaggggattgagggggggttgacaggggattggggggcgaaagggggatggtgcttgaagggctttcagaggtacgatgtgccggggcttggtggggaagcagagagaaggagggatcttggcgtgtcgggcgtgcccggaattgctctcgtcgaggctgcattctgggtactcaggcagccgccttgtgccatggaaagtcgatnnnnnnnnnngatggcctggacacaagcatggctctgcaccgctgcgaccctctcatcgcagccgcagacgcacagaacgccctctttccccctacatctcaggtttggaatccacccggtggccgggcgcatgccgggccagctcaatgtgctcctggccgaagctggagtgccctacgacattgtggaggaggtgggcggggccnnnnnnnnnnttgccaacccgcatctcgccagtggagcgaatccgatcccctacaccagtccagctcttcccagcgaatggcttggacacaatcatggctctgcaccgctgcgaccctctcgtcacagccgcagacgcgcagaacgccctcttcccccctacatctcaggtttggaatccacccnnnnnnnnnnagagaaaggaactgtcagtgtgtgtgtgttttgtgggggggggagtccttggtcgtgcaagtcgggaggaggctggcatggcgactgcggcgtctggggtttgtacggggcatccactggccgtctggcgcccattccaaagcttgccgacgctctgcaaggtttggtcgctcctgtcccttgcctcgcccgtgtatcatgcctctccacgacaccctgcagatggacgaggtcaaccctcacatggaggactttgacgtggcgctggtcatcggggccaacgacaccatcaactcggccgccatcgaggaccccaactctgttattgcaggtgagggcatgtgcatggtacgggtcgaaggtctggtcccgatcagggtgttatcgcatgggcgtctgcctgcactcggcccnnnnnnnnnncattgcaggtgagggcatgtgcatgctacggctagaaggtctggtcccgatcagggtgtcatcgcatgggcgtctgcctgcactcggccctgctgcctgagcatgtaccaagtacaagggcatgagcacaccaagacctatccacccacccaggcatgccggtcgtggaggtctggaaggccaagcaggtcatcgtgctcaagcgtaccatgggcacaggtgggtcaaggccttttggtggtttgagagtgtgacaggaggcgacgatggcgagttctctcagatccctgcaccgtcataggcaaagtctcaggtacctcactcaatcccccctccgccaggctatgccggcgccgacaaccnnnnnnnnnnggatccctgcaccatcacaggcaaagtctcaggtacctcactcgatccccgctccgccaggctatgccggcgccgacaaccccgttttctacaagcccaacacccaggtggggtctgcaggaaggctaaaaggcttggatggcattcgctgtgtgtctggccttggaggttgaatacgccatgctctgccgacacccacctttctcgctcacccacctgtcccagatgcttctgggggatgccaagaccgtgtgcgaccagctcaaccagaaggtcaccgaggcgctggggctctcaggtgcctgatcagtggcagaagtgttgtgaccgctacgttcctgctggttgtggcggatctgacaggggggtcctgtgggacttgggcccaatcctgttgctgttcatacacacacaatcaattgtactagaaagaaggtggtctgcaatcctacatattggcatgctgcagcaagagtcatgtggactgcgtccattacgaagagtttctgggcaggggggagttgggttatttgaacccaccaccctcctgcatccccgtcggactgaacgcgcgggataatgaccgagcagcgatcaaggccgggagggaccctccccgcaacctcattgtggggctcgggacgcaaccgggctaccagtgctacgttttgacccgcaaagagaacattaggcttgctcatcggggcccactgcgccgtgcggcctgaccaggcgaggagtggtcgccgcccatggtgtggctgggggagactctgcagaagctgggctctgcagctgtgaagatggcgcagaacacgagcagaaataacaagtctaccatatttgaggtgggatcgcgggggccctcactccaggattgagcgactgccggtgtggtgcgggggatggctcggcctgtacactacgcccgccctgcaggcccaatgcccggcgcgtgatgcatgccaaactcgtgcccgccaggtgtcgtacctgggattgagcctgttggggtcctggctgatcctacgctgggcgctcaaacaaatggaccccaccaagaagaatgtcgagacggtgaggcgggcactgggctggggaggtggggactgcccatggcactaggcggcagtgaagtgtcccacctgcgcatacgatctttgattgcagcgccgatgccgggccctgggcctggtggtgggtctgggagcacgagctgggacttgcttctgcgcgctggatttcggccagccagcgtctcgaccctgcagcagccgaacggtactctcacggccaccccctctgcacctggtccaaacaggcaaaacagcggaagaaggcgttgtccaagcgcctgggtcgcccggtaaacaccgatgggcagtacgaggatgtgagtaaacgggtgtgtctgcggttggactcttgctggggccattggtggacaggagagacagccacgagcgcgccaagcatcgtggtgcaccactgctggagagcgtgatgtagaattgcctggcaccttcacatgggctctgttatggactgcgtgtgccagatggtctggtcccctcgctccttacagtatttgtgtgccgcccctgcctccgtcccaccatggtcccactgcgcggctcagccctgttccccttccccctcccacgcacaaaatccgccaggtgatcgcccaggaggtggtcaacccggctcacatcaacatcaccctgcaggatgtgggtggcctggaccacatcattgaggacctggtgggtgtgccaagtcttggtactaggatgggagctgtgcctgctgagatctcacattctacagtagggctgtgaagcttctcatcacatgttgctgctgccgaggccctggatctgccatacaccgcgctctcctagcagtatgcatcacccccacccccggctctcctggaggccaaagccgatccgcccttggccctgcttccctttggaccaccccccccgttcctcacaaacctttatatcctagctgaaactcgaatcttcccccccctttctctcacacacacagcaacgcaacgtcatcacgcccatgcgccggccggagctgttccgcacaagcctgctgcgccagaagcgcggggtcctgctctacggcccccccggcacaggcaagacgatgctggccaaggcgcttgcgtcggagtgcaacgcctgcttcatcaacctcaaggccagcacgctgctgtccaagtggtacggcgacaccaacaagctcatcgcggcggtatggtcgctggcggccaagatcgcgcccaccatcctgttcatcgacgaggtggactcgctgctgggccaccgccgcgcggtggagcacgaggccaccacggccatgaagaccgagttcatgcaactctgggacgggttcgagtcggcatcggactccaacatcgtcgtcctgggtgccaccaacaagcgcgacgacctggacgacgcggtgctgcgccgcttctcgctgcagtacgaggtgcgcctgccgcagcgcgcgcagcgcgagaccatcctgggcctgctgctggcacggcacgcgcgcgagctgggcgcgcagtacctggaccccacgctcatggccgaggtggagggccgggtacgtggtactgcggggcctggcgtggcggcggcgggcgcgggagcggcggcgggcgcgggtgccggcggcgcgagcaatccaggcgccgccaacggcaccgcggcgccgacggggggcagcgcgctgcgcgcgctggcggagaggaccgaggggtacagcggttcggacctgacggagctgtgcagcatggccgctgccatccccttccacgatgccgcgcccacgcagtgagacagcaagaatgggggggtgggggtctggagtggatgggggacaccggcggcgcaggggcaggaggaaggggggcctcctgaatctgtgcggccatggcttcgcagcggttgcggcgcaccggtgggtgttacgaccgtatgacccaggtgctgctgtatgtgccgtcctccaccgttgccattccaacctgcaaactcccccttcctcacgacgtgcagatcgtcgccggcacccttgtcgctgcggcactttgaggcggtgctggcggcgtacacaccgccctcccgcgccgcgcaggagacgcaggcggccaagcggcggggggggaggggggttgcggaccttcctgcgcgagaggactccatgcgcgtcctggcggccatgttcaacagcatgctgggcagccagcagcaggagagcgaggaggagggcagcgtatagagactgggctgtcggcgcggccggccggccgcatgagtgcggagggcgggtgcagggctggaggggcaggcaaggtggcctggcnnnnnnnnnngctgggctgccggcgcggccggccggccgcatgagtgtggagggcgggtgcggggctggaggggcaggcaaggtggcctggctaccgcccagcatcccatcgccccttcggaggggcagggtccgtcgtgatcggaatggatccccgacgagggccccacaaatccgcaagccactcgctctgtcgacgtttttacactcctttagcggcctagtttctgcacgtacgcatgaccatggtgccagtagcgcagctgtcaaacatgaacctatgcaagggtgccgggccacacatgctggggcccagggtggtggcaccgaggagggccgttcgggtcagtgcccagcaaacgctcgtcaatcccagcatcaagaaggttggcgttgtggttcacgacgatcttggtggggcatgggtatggtctggcgtcgtcgacatccactcgtcctccagccactccaaatgccggccctcgccctccccctgaaggatgaagccaaggtggtggacaccgtgtcccccagcgacctcgaaaagcctcaggtatgagcttgaagtcattcatttcatgttgtgctgcatgggtttcagtgctgatggccttgcccagcccgacatgatgggatggttgactgtgccctttaacatcacaaaccactcctatagatacccacattccacttcttcccaaaatgcccatcagacctcttactgtcgnnnnnnnnnngtttaacatcacaaaccactcctatagatacacacattccacttccctccaaaatgcccatcagacctcttactgtcgctgctggcgttcgggcaccttcccactctgcgacgggagccatgtcaagtataacaaggagtcaggtgacaacgtcggtcccctcctcgtcaaaaaggcctgaagcttggggttgagcctgcaagccggcatgggctcacagcaacttctttgagagtcccagtcaacagcaagaaggccaagaggggagtagcccccttaccctacctcatgacaccatcgaagaatctgcatcatgagttgtctgagtctatcttcgtcgatcatgtctgaagacagaggtgaggtcttcacagcccgccgaaaggctgtgccattcccactcataggaagatcaatcgctgtaactttgaagccagatagggttgagagcagattcgagcagtctttgccagtgcttcatcggcccgaacgtgcatggatggctgtgaggtttgcatatctttccctgagaagcgcgaccctttgctggctgacacttggacgcccannnnnnnnnngagtgctttatcggcccgaacatgcatggatggctgtgaggtttacatatctttccctgagaagcgcaaccctttgctggctgacacttggacgcccagtccttttcaactggccccctcatattcgggacctccttcacagggatgctgggaccatgcaggggacagcctgagactgatagagtttccacgatttcagagggaggaaggggggaagggcaacatgagacctcacccgcacttcccacggctgtggctgccagcagccnnnnnnnnnngagggcaacacgagacctcgcccacacttcccacggctgtggctgccagcagccaccaggtttggacaggcagggcaggcggccgggcagagccgacacctcgcagcccggcacgcgtggaagagcagtctcctgatggtcatgcatcggcctgtttacatgcattgttctcactccaccagctcctcgttatcaatcaggtcgccatccatgtagtcctcctcgttaaaccctcgtaccggtgcctgcggattgttgcgatgggcgtatggggtggatacgtgtgtgttaaggggggagggggaccgggcctcatgtcaatccatgctgcatgatggccagggagtcctcagcacaaccctggtggtggggtggccccacccctccccacgcacccgtggctacaccacgccgcaacagcacaaacttccaaaccatacaaccctcccaccgctcaccaccaggactgggctcttctcccgcgccaaattcacgatcttcttgatctcctccaccgtctgggaggggcggggcgcggcctccgtgctggccacaccgccgtcccgcagctcctctggcaggttgcgcaggaaccaggggtgcgccttgatctggcggatgcggatgcgctgcgcggggttggccacgaagatgcgctgaagcaggtccgcgcactcgcgactgagccggatgttggcgggaaaggtgtatcgcacgctcatgatgcgctgaatggtcttgcggaagttgcgcgggtcggccgcgtcctcaaaggggtaggcgcctaccagcatgacatagagggtcacaccacagctccacacgtccgccgcctcgccatcgtagttctggcgggacaggacctctggcgcgatgtaggccggtgtgcccaccgtggacttgggctgggagtccagcagcgcagactgggggaggggagggaggggaatgggggagaacggttgtaggtgtggggaatgggacagggaggggccgggcnnnnnnnnnnnnnnnnnnnnnnagtactgcgtcccgtgaagggcgagagtcccccccccgcaccttgctgtacccaaagtnnnnnnnnnntcccagatggggtcattgcaatgtcaaggatggtgtgacagaagcattcagaccaggctgcgccactctgcatctgtatgcactgcgtcccgtgaagggcgagaatccccccccccgcaccttgctgtacccaaagtcgcagatcttcaggcgcggggcttgtcggccatccagcagggtgttctccagcttcaggtcacggtggcatacgccctggcatggaaggagcgggtgaggggtgagaggtctgacgcagagtgcggccccagccgccaagtcataattgtgaccagggacatttgggggaatcttcagcagaggacatgggcaccggaaggagcacccgtttggaggaggattgtgccgttcagagtcttggaaggaccccgcccctggtgagcaaggcaatcctgcctcgagagctcgatcgttcccccgccaagatacccaagggatcatttcaagggaagggcacagcatgcccctgtctcaggcagcatgcctgacaccacccttggcagcccgttcccgtacccatttgtgacaccaggagaccccggagatgagctgctggaagaaataccgtgcctcgtcctccttgaaccgccccgcggccacgatgcgctcgaagagttccccccccgccgcatactccatggcgatgccaaggtgggtggacgtcacaaacacctgcggtgatggcgagggggcgcgcccgaagatggaggagtgcagtggggcaggggtggatggtggtgcctctgccgcgcctttgagcaggtcggtcttcccaggggggtcaggctatgcggctgtctgggggcaccgatcccgcccgtgcacacctcccgaaagcggatgatgttgggatgaccggacagctccctgtggttgatgatctcccgctccacattcctgtcgatctgtgatgtgcatggaggccaggggatgccggggatgaggacgccccgccgatcacacgccggtgatacctgcccgaaatcccggcacgcccggctcaccttctcgcctctttcaataaacttgatcgcgatcagctcccctgtagacctttctcgcatcagcttggccacgccaaagttaccggatcctatgtccttgatctggaggggtgtacggcagggactcgggtacacgaccgaggtttctgcacacccagaaggaatggacctccaaccagacaccgcgcccccgggccccgatcccaccagctcgtatttggtgttattgatgtccatgttggcacgtggacctgcgcggtcctaaccctccccgagcagcgtgcccactcctagaacatctcgcgcccgagggagacggggggtctgggcctggtccagggggtgtgtacagcggcaatgcgggaccgagcaagggggcagcgcaagggtgtgcatgcctcctgctccacctcgcaggcctcttgggcttgcctctgctgccggggtcccgccttccagctcgccgagacctaccacgcgtagtggcgccttcccgcctcgggcacgtcccttcaaaatcagctgatcgcagggtgtgacatagccttccctctgcgagacatagaccgactaaaacatcatgtagctcctggaattgcgttgtaatgcctggttctgtcgcctgcagtgtttgattcccaaaaccgtctccacttatcagacccatgggtgaccctcagcccttttcgcttcctcctactatcacgcaagaatgggtgcgggaacttgaacgggttttactggacctctcgaggcagccgcctaggtccctgacgggggcggtttccagcgacctgctcctctccatactcacacaagcagagtgcaccctgcgagcagaacccacgctcctcgaggtgagcgggcgcaaatgctcttgatcagatgccaggaaatacaaggtcgagacttcatcattgtcactgtattggccctgcacaggttgacccccaaggagcctctgtcactgtggtgggagacactcatggccaattccacgacgtctgccacatgtgggtgctggtcggtggagaatggggctcagccccaggagtgccacagggggtggaaggtgcacagtagagtttgcatcagcgcatgtgatcacgtattctcttcacttggcccgttctcaacaatccattgccacagattcaaggttgctgggtacccatcaccaacatcactcttcatcttcaacggtgactttgtagacaggggttcctggggcctagaaaccctgctcctcctcctggcatggaagctggcagcaccgcagcatgtgcatctgttgcgagggaatcacgagacagctctctgcaccatggtgtacggcttcaagggcgagctggttgccaagctgggccgagggaagtggaaggtgagaggcagccttgagtgtgctgctttcttgttcaagacgacatttttgcgcagcaaaggctcctcagcttcttgaaagtgttgctgctggggtgaaatgtgtgcttgttgagccctgtcaggcccactcatggtcaggaggcgcaaccttgggggtctggttgtgaggttggacatcgtcgagaacggccaccgcatggccttgctcctcgttctgtaacatcgattgacccctctgcacnnnnnnnnnnacgcaaccttggcggtctggttgtgaggttagacatcgttgagaacggccaccgcatggccttgctccttgttctgtaacatcgattgacccctctgcaccaaactgccctcatcacccgcgcaggaggtgtatggcggttgcaagcgcgtcttctcggtgctacccctggccgcccgcgtggcgaaaacgacgctcatcctccacggcggcctctttcggaagcccaacccgcccaaccgggctcggcagaagcgacgcagtgagtggaatgtccagtgctgctgctgtggagaggaggcatgtgtggttcctaagggacgggttggggctgacagaagttccttcctcgttcaaagagctacactctgcgatcttttccgcattaccttccccccccccgcgggagatttccgcgtttgcatcccaaccccagggcagtctcccaacatccaaaacaccaaacccnnnnnnnnnnttgtggagaggaggcatgtgtggttcctgagggacgggttggggctgacagaagtttcttcctcgttcaaagagctgcactctgcgatcttttccgcattacctcccccccccccgcgggagatttccgtgtttgcatcccaaccccaggccagtctcccaacatccaaaacaccaaaccccgcccccatctgccgcagaaatcaacgcgctggaactgggttccctggaggacctcagggcggctcacaaaggcggcatggaccccaacggcacgggcgctgcgcggctggccaccgacgtcctgtggtccgaccccctgttggaccccggattccagttcaacaccacgcgcaacatcggcatggtgtttgggccagacgtgacgcaggcgaggcctggtgatgaagcgtggtggtggggcgtgggtgtgggtgtggtggtgacgcacggcactggggcgtgttgagagccgacccgcacgtacctgcagcacctcgaccccccccccccccccccannnnnnnnnngggtggggcgtgggggtggggtggggtggtgaagcacggcactggggcgtgttgagagccgacacgcacgtaactgcagcacctcgatcccccccccccccccccnnnnnnnnnnaaacaccctgcgcatccacagaggttcctggaggaaaacgggctgaggctgatcctgaggagccacgagggccccgatgcccgtgaggggcgggaggacctgtcgccgatgacggagggccacaccctggaccacgacacacctgctgggcggctcatgacggtcttcagcgccccggactacccgcagttcgtgcccgagtcgcacgcgcggtacaacaacaaagcggcactggcggtgctcactgcgccagactacgcggctcccactttcttgcagttcgaggcggttcgcccgcgcccgatggtgggctcgggggatgggtaccagagcgaaagggtttcgtgggccagggggaggaggtgtcgggctgcctgcgccgtttccatgccaagtgcatgttgggaggagcagggaaggctggatccaggtcgaccacccctccacgggcgccattccggtccgcgccagcccgacctttcctgatgtgttccctgtaccgcacaggcccacccgtactacgacctgggtgtgcctgactcggacgaggagctggagccgctggcctcggatgccagcggcatgacggacgtggagcaggacaccagcaccacctcggaggccagcgtctctgtggccctgccggccgggaggggcggcgaggaggtggccagcgtcggcgcggatgcgccatgagcggcctgggcccggagacgcgtggcccggcccacgcggcgcgtgcgagtctccagccatcgcagcgacgtggctgtcaccacgccatggcggtgtggggggacgtgcagagtgtggatcgttgcactgcagcacactgggtggcagagttcgattcacagggcagatgagctgttgacagggagggggcgagatggtgcagggtgaggcaggcatcgggggttgagggcgagggagagaagctagcgcgttcctgccaagcatcacaggaatcactcaggtatcaacagctcgatgaggatgaccacaacagtgcactgctgcatcccgaaggctagcatcctcagacggggaaggagatctccgggggcgcgccctggccgggttggagctcaggggtgcggggcggggcgggggcctccatgggtggcggggttggcatctcgcttggcggccgggtgccggggaagtcaggtggcggctgcggatgggggacctgttttgtaggggtggagggggaggaaggctgtgggcaagggctcgaaaggaagtgggatgggtgaaacactgcacgcctgcagggaaggccgtgcatacgcaggacctactgcatggagagcccagcttgcagtgcactgggcggtggttcccattcttgacccaggcgatctgacgcagacatgccagccgcagggaggcaagctactgcagcttcgaccacaatcacctcaagcgggggtcgcttgggctggctaggcgtctcaggctctggcgtctcggtgggctgcgcaggctcctcctgaatttttggaatggcggaaaggttgatcgctgttgcacgcggatggggaccaaccagaaagcagtgagcatgatcccccgtcagctactgttctacggtctgtcgcattggcacctttttggggtggttgggtggcacctcgggcatggggttgtcgggctccggtggctgagtggagggctttgcaggctcggcctccccaggaacagagaaatcagggaagggcagacggtcagggtcactggcaggcacctgtgaatcggtttcgtggagattgtgaacgtgctgctgattaaggcgtgctggtcatcatttggcgtcccgcgtgtgctcttacaccagcttgcctttgtgactgcctggccatgggtgcgcccccggccccaccagcttgcccggctgttccggttgagctgcgggcagctatcgcatctcaaggcggagcacatgctgacctttggcagcacatacctgcacatggtcgggagtctggggtcattgggggcgccaaggtgggtcccgctggcatccaaactccgcacatcctgatgaagcacccccattgcaggggcacgcacccgggcctacccattgatggatgtcagcatgaatgcgctcattatgactagaggcggtgttatgggaagctgaaaatggtttgtctgttcagcggtggtgggtcgcgtcacatttgtccatgccgacacccgtgtgcgggattagtattaaccatgggcagctacgcagcagctaccccnnnnnnnnnncttgtccatgccgacacccgtgtgcggaattaatataaaccatgggcagctacgcagcagctaccccgattccagcgcaaagacagctcggtcggacatctccctctgcctccagacacagtatggttacaaggcctcggcagacaatcaagcaggattgccctgccgtacgacaggaatggtacatgtcagtcctcccccgcccccaccgagggccggcgctgcttggccaggctgccgcccagctgcagctcgacgtcggccgcggcgggggcggcgccctcgacccggcccgcccgccggtcgaacggcgcgggcgggccgtcgtcggagtcgtcgccggcggcgggtggcgggatggggctggccttcgccttggcgtcccnnnnnnnnnnggggcgggccatcgtcggagtcgtcgccggcggcggggggcaggatggggctggccttcgccttggcgtcccggcgcagcgtgaatgaggcctgtgggccgggcagctgcaggcgcgcgggcgcaggcctggcccccggcgcggagacggggggcaggccgccggagccggagggccccaccgcccccagctcaaaggcgtgcgccgatggcacgcgcgggctggcgcccagctccacatcccagcgccccgcgtcgtgcaggggcgaggggctgcgcagggttaggctgcccgacagccgccgaccgggcggcgagtcgagctccaggcgtgagccggagggagtgcgccccgccgcgccagcccctgcgccagggcctgcgccgtgctggctggcggccgcgtgctcgtcggcgcggcgcaccgcagacttgatgctgtaggacacgaacaccgcgccgaagacgcacatgaccaggctcaggcccagcagcacccactccaccgcgctgcccttggcgtcgccggagacgatggaggtgatgctgctggccacgctgccgatgtagcagaaaatgccgcactcgaagatgatgcccaccgccgacaccagcgtgaactgggtggagggggagaggggcggggtggtgtgggttggtgtggctggcgtgttaaaggctgatcgctggctggggttggtgaggtgtcatgcaggtatggtttgtcgattgtcctgctcgaccatatcccttccccccttcccccccgggggtcccccacccaccacaacaccccccttctttctgccgcacctgccagaagggcatgctggtggtggccatggcgatgttgagcaggttgtaggggatgatgggggacatgcgcatgatgagcaccagcttccagccgtcgtgctcgatggcgcggtccagcacctcccacttgcgccaccgtccgcgcagcgtcgcctccacccagtcccgcagcaggtagcgcgccaggaggaaggcgagcgcctggccgatggcgccgccgatccacactgccagcagacccttccagaaactgcatgtatcgggttgggttggcagggttgaggttgatggtgcgggttgtaccaggctgccatcgcacaggcatcgagcttcacatcagggggggccaagacactgacaccgaagcgtgtggcatggcccagcattgttttcctgcaagacttgccaggtcccctaccgagcccaccccaccacctttcccctgcccagctcacccaaatacaaagccagcgcccatgatgaaaacgacgcctgggaggaagacggcgaccagggcagtgtacatgcccaggaagatgccccaccccccccagttgttcctggactggaaccagcgcaggaggtcgccaaaaatggagaagccctgcggcttgcgtcggcggagggcatttgaatcctcttgcacaggtcatgagctagcaaaattgagcatagaacaaggcatcctcctaaaatcacaacaaatgcttgtctcagcacatgatgcatccatcacttccccccgaatcccgccgtccactgcaccttgacagctgtcaacacgatgagagcaatgatgaggccgaggatgacaaacttgtaccagttcacaaggaggaaacggagaacgcctagggcatattgccggaagccccgaggggcagccagtccctcaggcaggccggcccctgctctttctagcggctgttgatggttaagaaagcaggggcacaaagttgagcacttgggcgctgcgcaatccagaaagaaagccctttcagctagattgcaaatgctccaaagccatcccaaatcctgcgaccctagagactctggacgatcgcatgccctgtgccccaccagcgtgctcacctcatcatctgagagcattccaggggccctggacttgatgagacgggcattgtcgtcatcgtcggcagatgcaggggagtggtccttcatgtcaaagtctgtccccgcaacacccgtggcgtccccgccggagcgtgtgccccagcgaaatagtcgcctgaatctcccttgaggaacctgctgtgcgcgggcagtgtggacgaacctgagcacggaagcagggacgggaagcacggtgtatgcagggctgggtgctcgcgtcccacgtcaccagcgcgactcacaggctgcgaaggaccagcctccgcccagtcgtcccttgcgggcaggccggagcgcagatgttgagcatcgattccagtatcccccagggagctcgctgtctcgccgtctccgctctgcttggcagcttcgtcgatcaggttcagctccatatcgctcagggatttagggagacccgggccggcgtacatggcctctactacagacaatatacgctaaggagcaaaactcaagcagttcgaggccggtcatgagggctcagtgcgagtcgtcgtctgcccccccccttcccgtcccgtgggcagcaaggctggagggtgagctgtcgacgccctgaaggcgtctaccttggtctgataggtcctctgaaatggggggctgtgtggggtgtgtcgagggtgggctcctgacagaagctcaccatcccagggcgcgattcccgctcgaaacgtgctccgcgacgatccttgtaattggatgctgacaggcgcactcggtgtgggaagacgtcttaccctcgtgcgcttgcaccgtccacacaatcccaatcctctcttccaatctcgatgatgccatgcagctgtaggcttcacaactcgacagacgtgggccgaagcccgagtattcaaacctgacttgcagtcggagacatggcgcatttgaaggttttcaagcagcgcctcttacaacaatttcaagacgagagcgatgcgaaactcagggctgccaccagcgttgccagcgagacgccagcacaaggtgctcgggatgcgcgagatcatagtagtcctcctgggcctgcatggctcaggtcaacgggccatcatcctgtgtccctgtcctgcactagatcctgccctctcgccacgacatgcagagagtgggagagtgactgcaaagcattcgccagcctccagctcccaacctcagctggaacccaccaccagcggcagagcgctcagcaccggcgtgccccccgacttgccggcctccgacaggtgggtgggaacccgagttgtgcgctttggacggcgtgtggggtgtgggaccgacttctttgacgaatacatgcgatgtgtcctaggtgccagaccctgcacctcgtgcgaagcagggcgcgcgcctcttgtctgaaggcgcgggaccgggaaccgccagacggcgacgacgggctgcccacctcccctcggtcccgccagcgcccaggcgccggccagcccgggccaagacctgggagtggcgcgatggcaggcggccgagggacccccgcgctaaggaccgggtcggtggggaaggccgcgaagaggggccctgggcgcgagggaacccctcccgccgcggcggcggccggggcgccggcgcagcccaggcacgccaagcgcggtgtgggcgaccggctcgacgccctgagcgcgggcagcagcctgtccccggccgccacctccctagcccaggcaccgtcgaccgcagaagcccaccgcgcccccgccgtggaagccgccccggcgtcggccacaggcccctcccctctcggggtgcgggcggtgggcacgcgccccgtcccgctcccggtagacctgcagccgacgcccacggcgcagccccaggccctcaggccgctgtcgctggcgggggtgggcagcctggccgagtgttgggcggccctccgcgacgccaacccggggactgacctggagcccaccccccacctggtcttcctcgatgccgaggaggactggctcgtgctggacgacagcgtcccctgggacctggtgactgaaaccgcccaaaaactcatgctggtcagctccctgtaaccgcccaggctcctttcatgcccgcaaagctggcggagtacgagcatccagagggggaaaggggtcgtgatggcagtggcacaataatagccgcgcggacggggttggcttgcagtcgtacggcagacgataggcatactggcttgatttacacgttgtggacgaccagtgtcgcctgatccgttcccccgcggtggcattcctccttgccgcagccgagacagccctctcacccattcgaacactcatttccctccccccactcttggccgctcctgatctgctgttacaggcaggggtcgcaaatcgcaattctgggggtactgtctcggtgcaggcaagcctacgccgcactctgcagcgccagttccagtcgtttgttcaggaacgcaaagctgggttgatcacgcagggcggccgggatgcccatctcccccagcaagtcctgggggtgaaagttgggttggaggatttcgagttggtcaaggggtagggatcagtggtcaccatacgttccttcaatgtttacatcccagcgaccaaacagaggattcagggcctgccctcctctcctcatcctcatccttcccactgtgcctcctcaacaaggcccctgcgcaccttgtcgtccatgaaggccgccacgtcgtcctgggtgaagggcagggccgagtcctcgtccaggaggaacgagtgggaggcggccgaggcggccgactccaccatcagcgccttcatcctgctcagcacctcatggctcacagtctcggtgccatacctgtgggaggaaagggggggaaacccgggatcgggcgtcggcagagcgtggtggcagaccttggagtgttgatgtggagaccagcggccctctgctcatcacaccctcccttccaccctgacatccgcccccactcacggtgtccattcgcccccccccccggcacccacctgtcgtcccagtacatggtgctgatgcggtacagctgctgcaccgtcagcacggggcagaggtcggtggtgatctcctgcaggctcttcttgtgcttctggtggatgaccaggaaggtgacggcctggcggatgtgggccagggcctcccagccctcgcccacccaggtgcgcccggcgctgccggcccagatctccacctcggccagccctgtcttgacgtactcgccgttggagaaggagcagcattcgcggcgcaggagcagctggttgaacagctggacgttgatgaaggaaaagagctgctcgtacagcttgcgcaccaggaaggcggggacgtggtggtcgcgcagcgtgcccagcgccgactccagcacgcccaggatggccgcccagtgcgccgacccagcgtcttgccctgtggaggaacgcgtcacccctgtcagacgcgcggcgtgtgttttgggaggggagaggaggtttaaggtgggcggcgtggtgagcgggagggaggtggtgagcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggccgggtgcaggcagaggagctgggtggggggaaagtgccacccaggcctcgcacacttgcacgcagggagggggagcagtggtcgtcggctggccgagtcctgcatggtctctcgtacgcccagtacggacgcggctccagacatcaggcagggtcccggcattcctgctggcattgcctcagccacgatcctgtaaatccaacagccccgttctctgcccaagccccccccccaaaaaacaaaaccttgaaaacaagatcgtgacgtacccaggggcgagcgggcgggtggcgcctccacgccgtggctggacccccggccggggcgggaggtccgccccacgccgctgcggggggcgtggatgcaggccgccaggtgaggcatgatgtccttcttgatgttgtcgcgcagggaggggaagatcttctgcacaaacgcgtccagctgctgcttgaacagcagggcagggtacttggcctccacctgtggtccaaggtggcgtggcagcagtatctcggaggcagctcttcgagaatcgatggtcatccaggggagcgcatgggcaggcacccacggccctgccccgacgcgcaggggtgcgttctgcgctggatgtgtgcgacggaccacgacgaggggccgagagcccagccgggcacccccctccgacccactgccaaacaccatcggcacgacccctgccctcccacctggcgcaagccgccggcagccccgccgtggatggaggcctccccgccgggagagccaccgtacccggcgcggctgaagaaggacccaaacccggcggtcttgctggtgcctccaaacaggcccctgcatgaggaacggagagctgacagcatgaaggggcggtttctcaagggcttgccgcggcgcaagcaggagatgagctcgaaggggccggattgcgaggccgccgagccctgtaccacgttccacccgcccactccctctcgccgtcgcctgagcatgcacaggatgcccaagcaggttccacaggtggctcctgctgctccagagaaccctccctgcagaggagcagagatcaggtgtaccacctcctcagccccccctcacaggccacacccaaccccctacacacacacctggtgacactctggctctgggacctgaggcgctgcgtgtagctgccgccgctggcgggcttgatgttgcgctgcaagaggtagagcagggtgaccgtgttgctgagccagtaggacagcacggcgttgtcctcctggtgcgcctccacctgtggaggagagcggggggggnnnnnnnnnnnnnnnnnnnnnnnnnnnnnnnnnnnnnnnnnnnnnnnnnnnnnnnnnnnntggtatgtggagaatcctgcgcagtggatagagtgaacgcccagctgaccctcggtcccaccggcccccacctgggaccccatggtggcgatgatgcggtcgaagaggggtgtccggtcggcctggaaggtcttccactgcaggcagcagcggaagaccagcaccgccgccaccggccggccgcgctggtaccccaggttctctgcagcgggcggggtttgggtgcatcttgggaaggggtgtctgagatgcagagatcgcagcagaccggcctcccttccgcgcctcaccccactcctcaaagtcttcctccatccaaagcccacctgcctccccccatacttaaccaggcgcatccccccaaacccctctccccccctcgctcacccgccaggcagccgaggaggcggtcctggtccgcggagcgctgctcccgcagcagctgctgctgcttggcgtacagctcccgctggcgccgatccatctccgacagcccctcccccggggtttcggcgccgtacccgccgcggacgctgcccggcgtggccggcgtgcccggctctcggctgggcgaggtcatgtagcgccgcacgcggtcgaacacgccgccctcctcggccggcgcggcacgcgcgggagcggttcccggcgtggcctccggccccggcccgaggttcacgggcgtgccgcccggcacggcgacggcgagcgcgccgctggcgctgcgc

SEQ ID NO: 35159 - DNA, 104 bp, Chlorella protothecoides
gatgcggatgcatactggtagatgagcacttctgcctcagatgaggccatgcacaacaagaagcatgcatcccgaaggatgagcaccccctgcccaccagtttc

SEQ ID NO: 35160 - DNA, 61 bp, Chlorella protothecoides
actccaactccctcatgcaggcggcaatgtacctggctgcccgccgcgcggcagtgctgcc

SEQ ID NO: 35161 - DNA, 74 bp, Chlorella protothecoides
gtcccgcagtctgtagccagccgcctcgccgcggtccacggccgcacggagctcggtcagctcggggtcggcgg

SEQ ID NO: 35162 - DNA, 70 bp, Chlorella protothecoides
ctaggcttgtcccaagcatggcccccaattcctgtgatggcaaactattctcctccacatcacccccccc

SEQ ID NO: 35163 - DNA, 73 bp, Chlorella protothecoides
tcttgtaagctgctgggccaggttttgcaaatgggatgcaataaaaagagattagacacgccgggtgcatggc

SEQ ID NO: 35164 - DNA, 109 bp, Chlorella protothecoides
gcacaagtgaggggaactggatacagagctgggggtgggcaggcacccgaaacatggtgatgggcaagcttgtgacgggcatcttgtcagccgctcttgaacaggagga

SEQ ID NO: 35165 - DNA, 80 bp, Chlorella protothecoides
cagacgcctcgcctccaaggagaagagcagtgaggcatgatagcccagatgcttctcctccgaggagagcagcagggagg

SEQ ID NO: 35166 - DNA, 61 bp, Chlorella protothecoides
aaggtccaacctcacaaaagccaccctgtcacccaatcctggcagccgcacctgtggtaca

SEQ ID NO: 35167 - DNA, 105 bp, Chlorella protothecoides
gtcggcggctggccagccctgaagtggggaatggggagggtttacagcgcagggtgcatgggtcagcgcaggggaatgggccgacccttagcaactatctccaga

SEQ ID NO: 35168 - DNA, 94 bp, Chlorella protothecoides
caggtgcgtcgatgaggaaggccggcagagggtttgggctggcgggggatgctgtaccctcgtagaccctgcgtgggtccatacagatccccct

SEQ ID NO: 35169 - DNA, 61 bp, Chlorella protothecoides
tgttatgcttaggacatgggatgcaatgtttccagcgagccactgacttgtagtcccgatt

SEQ ID NO: 35170 - DNA, 99 bp, Chlorella protothecoides
ctttcactgaggtggcaaggaaggggatggatgtcgtcgccgccgtgggtgggaccgccaagggtggcaacggggctgcgcacttgtgctgctgcaatg

SEQ ID NO: 35171 - DNA, 472 bp, Chlorella protothecoides
ccccggccccgccgcgcggtgcggcggcgccccccccgccggcgccacgctctacgcctggggcgacggcgccaactttgcgctgggcacggggtgtgtgggcgtgcagcccgaccccggcgcggtggacgggctgggcggcggccaggtggcccgcgtcggcgcgggcaagttccacagcgtggcgctgggctgcgacggcgcggtctggacctggggctgggggcggggtgggcggctgggccaccccgaggcccacatccacggcgggtccagcgccgtgctggccccgcgccgcgtggcgctgccggccacgctgcgcgtgctgggcctggcggcggggaagcaccacaccctgctgcgcggcgagggcggggaggtgtgggcgctgggcagcaaccggcacggccagctgggcatccccggggtggacaccgcgccgacgccgcggcgcgtgcccgcgctgcgtggc

SEQ ID NO: 35172 - DNA, 61 bp, Chlorella protothecoides
agaccctccctccacccgctgcccgcgccttcctcgcacccaacaaaccaaagcccacctc

SEQ ID NO: 35173 - DNA, 61 bp, Chlorella protothecoides
cagggggttgaggtcgtccatgactctggcaaggttgccacgcagctggtcgttgtactgg

SEQ ID NO: 35174 - DNA, 61 bp, Chlorella protothecoides
ccgcgcctcggccgcgggcgtggccggcactttcctggtgctgatgaccaacctgagccac

SEQ ID NO: 35175 - DNA, 24757 bp, Chlorella protothecoides
  modified_base (102)..(153): a, c, t, g, unknown or other
  modified_base (1290)..(1299): a, c, t, g, unknown or other
  modified_base (2159)..(2168): a, c, t, g, unknown or other
  modified_base (2762)..(2771): a, c, t, g, unknown or other
  modified_base (2843)..(2863): a, c, t, g, unknown or other
  modified_base (2985)..(2994): a, c, t, g, unknown or other
  modified_base (3417)..(3426): a, c, t, g, unknown or other
  modified_base (3781)..(3790): a, c, t, g, unknown or other
  modified_base (4341)..(4439): a, c, t, g, unknown or other
  modified_base (4509)..(4518): a, c, t, g, unknown or other
  modified_base (4926)..(4935): a, c, t, g, unknown or other
  modified_base (5232)..(5241): a, c, t, g, unknown or other
  modified_base (7406)..(7415): a, c, t, g, unknown or other
  modified_base (7608)..(7617): a, c, t, g, unknown or other
  modified_base (8847)..(8856): a, c, t, g, unknown or other
  modified_base (9560)..(9569): a, c, t, g, unknown or other
  modified_base (10395)..(10478): a, c, t, g, unknown or other
  modified_base (10852)..(10861): a, c, t, g, unknown or other
  modified_base (11231)..(11240): a, c, t, g, unknown or other
  modified_base (12283)..(12292): a, c, t, g, unknown or other
  modified_base (12490)..(12499): a, c, t, g, unknown or other
  modified_base (12721)..(12730): a, c, t, g, unknown or other
  modified_base (13449)..(13496): a, c, t, g, unknown or other
  modified_base (13699)..(13708): a, c, t, g, unknown or other
  modified_base (15081)..(15090): a, c, t, g, unknown or other
  modified_base (16062)..(16071): a, c, t, g, unknown or other
  modified_base (16163)..(16172): a, c, t, g, unknown or other
  modified_base (16692)..(16701): a, c, t, g, unknown or other
  modified_base (17224)..(17233): a, c, t, g, unknown or other
  modified_base (18063)..(18072): a, c, t, g, unknown or other
  modified_base (18664)..(18784): a, c, t, g, unknown or other
  modified_base (18957)..(18966): a, c, t, g, unknown or other
  modified_base (19123)..(19132): a, c, t, g, unknown or other
  modified_base (19872)..(19881): a, c, t, g, unknown or other
  modified_base (20117)..(20126): a, c, t, g, unknown or other
  modified_base (20465)..(20474): a, c, t, g, unknown or other
  modified_base (21009)..(21018): a, c, t, g, unknown or other
  modified_base (21144)..(21153): a, c, t, g, unknown or other
  modified_base (21232)..(21241): a, c, t, g, unknown or other
  modified_base (21678)..(21687): a, c, t, g, unknown or other
  modified_base (22747)..(22756): a, c, t, g, unknown or other
  modified_base (23153)..(23162): a, c, t, g, unknown or other
  modified_base (23999)..(24008): a, c, t, g, unknown or other
gccaccacggcgcgcgccttgcggcccgcccgccgcctgacccctttggcgcgctggtccccgcacacctcccgccctctgctgcggcggctgccgccgccnnnnnnnnnnnnnnnnnnnnnnnnnnnnnnnnnnnnnnnnnnnnnnnnnnnngggtcacccgccgccgcgcgcctcgctggagcgcctggcctccaaccactccgcggcgcagctgtcgcgcgtgctggaggacgacgaggagctctgggaaaccttccgcgtgtccatggacgtggaggcggtgctggcgctgaagctggacgtgctggcggggccgtgtcgcgacgcgtcctacgtcaccgaggacgacacgctggaggtgacggtggggcgcacgcccggcaactcgctggccttgcgcgacggggaggtgtcggggcgccacctggcggtcacctggagctccctggaccgctgctggcaggccgcagacctgggcagcctcaacggcacgctgctcaacggcgagcccatcagcgtgggcgcccgccagcgcgggcctgactaccgcctcagctccgacgacatcctgcaggtttgaggaagggggggagacttcgggttttgaagggggagggggggtgtgtgtgtggctggagggggggtggagccagaggagctgcctgcactgatgcgcaagctttgggctgagaggccgacggccgatggagacagtctaagatttacagcgatttgcatgatcttgtgcccccaagaaactcactcaacagcaaacaagcaaacaatcaagaagcaacacccacacgcagctggggagctacacgaagatcaaggtgtccaccttcccgcgcgacctgctcaaccccaaggacacccacggcagcctgcccattgggtcgctgcccaagtccctgagcatgcccaagcaccgtgtgatgagctttgggtcgctgacctcgcccaagcccaccgccaacacaccctcgcgccagccggcggccaccaccgcctgcgacgagctgcggatggaggcctgcgtgctgtgccgcgtggggcgggagcacacgcggaaggggcagccgggggaggtgagggggaggtgatgatgggagggcatggggggtggggggatgggtgtgggcagggactttgttcctcagaggcagggactggaggagtggagggccagggagacgggtgccaggcatctgggagggtaggagttggagaattaccttgaaaggaggcttgggagaatgcccgccccgcagcgccgtgcatcgcggnnnnnnnnnntccaggcatctgggagggtagaggctggagaattgccttggaaggtggcttgggaggatgcccgccccgcagcgccgtgcatcgcgggaggactgccaccagttgtggctttctggggtcgtgcggcgagccagggcaggcccggcctgtcctgccgcggccttgcctcatagcggggctgcatcaggtcccatgcttgcgcaacttcctctgcaacccagcctcacccccctcaatacggaaaaggacgtggcgtgtgcgcagtgcccgctgccggaccctggccgcctgggcgaggcctccgtctccctcttctgcgtcttcgatgggcactgcgggcgcggcgcggcagaggccgcggcggtggcactcccggaggagatcggcgtgcggctccccgcctgcgaggcggacatgctggagcagcgtggcgctgtgtcggccctgcgtcccgccttcctggccaccgacgcacggatccgggccgaggaggggtgcaccgccacggccgtgctggcctggtcgccgcgcaagggcaccgtctgcctccaggtggctggagggcagtgggggtttgtttgtttgcagtgaggctccacatggcatgggcagggaaactggctcgtggagggggagggggtgatgccctgatgacctcgcgtgcctccctccctcaccgtctgtggtcggccgagcatgctgaccagaagcctgcgcgcttctcccacacgtgcctgcgcccaccaaccactgccacctgcccaccccccaggctgggaatgtgggcgactcaaccgcgctctggatcgaccccaggacggtggaggtcgtggagctgacggaggaccaccgcttgagcnnnnnnnnnntgttgtttgtttggagtgaggctctacatggcatgggcaggcaaactggctcgtggagggggagggggtgacgccctgatgacctcgcgtgcctccctcccttaccgtttgtggtcggccgagcatgctgaccagaaggctgcgcgcttctcccacacgtgcctcgccccaccaaccactgccacccgcccacgccccaggctgggaatgtgggcgactcgaccgcgctctggatcgaccccgggacagtggaggtggtggagctgacggaggaccaccgcttgagcaacgagcgggagcggcggcgcctcgctgacatgggcatccagctgagcaagaacagccggcggctgtacggcctcaacctttcgcgtggcctgggcgacaagtttttgaaagacgaagatttgggtgagttggcgaatggtatccatgtgtgtctgtgtgtgtgtgtggaggggtggtttggtgggcccatgcatctgtgggcagcatgctagagctgtgctggacaggggtaccatgcagaccttgcaggccagcctgctgcacggcatggactgccgtgagactacgacgcccctcgccgcctcnnnnnnnnnntcatgtgtgtgtgtgtgtgtggaggggtggttttgtgggctcatgcatctgtgggcagcatgctagagctgnnnnnnnnnnnnnnnnnnnnnttggcatgggcgcaggctcccccgctcaccgcgacgctttcccaatgaatgaccatctgtcctgatctttaaccccattgacccagctccccagtgccagattctgccgctgctccatcacnnnnnnnnnnctggcatgggcgcaggctcccctgctcaccgcgatgcttgccccacgaacgaccatctgtcctaatctttaaccccattgactcagcttcacagtgccagattctgccgctgctccatcacttcaactccactgttcctcccctgaatccacaggtctctccgctgagccctatgtgggtcccgtcgtaacctgctccgcctccgagggcgggctcctgctcattgcctccgacgggctctgggatgtcgccgactttgccaccgtcgcgcgcgtcctgtgccagtcattgaggtgggtttggggggccctggccttgggattgtttccatgggcttccagggggttgaggggcggccgaaagttatgcatgctcaagatccatggacagatgaggccgagcgtcggcatgccctgcgccccnnnnnnnnnnattaggggcggccaaaagtcatgcatgctcaagatccatggacagacgaggccgagcgtcggcatgccctgcgccccagtaccagcctcgcacctgtgcctacaccacctacccactccccactccaccacgcccagggcgtccgggggggatctggtggacggcgcgcgggcggtgctggcccacgccctcaagcaccgcaccaaggatgacgtcagcatcgtgctggcccgggtgctccccgaggcagagtgggaggcacgcagcccgccgcgttcgttctcctcggggcccatcttcggcgacccgtgacctccgatcggcgccaggcgcttggcgcctgggcctgagcgcnnnnnnnnnnctccttctcctcggggcccatctttggcgacccgtgacctccaatcggggccaggcgcttggcgcctgggcctgagcgccgctgccgacctttgcccagcccatgccggacgaatggggcggcccagcccatgccggacgaatggggcggcccagcccgtgccgatcccgccggctggccccgccagggcgctcgccccccgacgcagtcgaagccaaacccaagcgcatctcttcttttcactcgcccgcgtgcaccatgcccgcgcttcccctggctcgccagctgcttggtgtgttgttacagtgcatggcagagcggacatgagcaaacagtggtgcatggtacaatgggacggaagccaggaggaaaacggagtgtaggctacatgcttccgtgcaaaatcctacatacatgatggcgctgcgcagggcggggacggcgcacgtcctttgacaccttcacccgcttctgatggtggtcctccggtcaggtgctacaggatctcgtcgaacgccgtctggcggccgcagaaggggcaggtctgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagctgtcacgacaaggccacaacttctccaatgcagctcacagtctcctttcccctccttctgtccctnnnnnnnnnntcgccttctccaagagaaaaacactttgcttcccgcccacaagcgatgcagtttgaagctgtcgcgacaaggccacaaattctccaatgcagcgcacagtctcctttcccctccttctgtccctcacttctaccacgaactgcctgtccacccaccctttgtgtaaccctccagacaggtggggcacatgtcgtcgtcgtccagcagggacagctctgggaaagcaggaatgcagtcggtggccctgagcaagaagagctatcatcaccatgcagcagaacacttctgaggcaggcagagacaacaggccagcgcacctcgcatgtcctataccttctgtgtagtgccccaggcaagcatgcagcttcccagaccccaccatcccatgctcactggaatcggacttgnnnnnnnnnntgcatgtcctataccttccgtgtagtggcctaggcaagcatgcagcttcccagacccaaccatcccatgctcactggaatcggacttggcatgcttgggatctgcatcagattgcatggaggatacagaggcgttcctcattttcctcagtggcgacagcagctgttcgcgggcctgcgtggtctgcatggcagtgggatcgatcgtctgaggttgatggtgcctggtgatgccaacacagcattcagcatggggctggcatcccgaggaccacaggcacaaccttgcaatcaccannnnnnnnnncgccaacacggcattcagcaaggtgctggcatctcaaggaccacaggcacaaccttgcaatcaccaaccttggtgtcgaggtgctgctgggagggagcccaggtggatggggaggcagcgacatcgtgctgggcctcttgaggcgaggaaagggtggcgcgggggtcaagcagattctgggcggagattgaccttggtgtcccactgcaaggggggagaggggaacaggtgtcgaggtcgacacggggtgcccatgctgcaacctctacgcatccacatctaccctttacccgctcacaatccatcgttggggtgtctggaggaccagcagcagcacaggcaacctcgcagactgtcccagcacccaggaggaccggcatggaagagtgggatgtcgggctgcgaaacgccggtggcctggtgtgctatgctcatcatgccactttgcgcaccactgggccgtaaacggccttcgatctccacttccgggggagggacccgtgcctgtggtcccgcccgggaagggtgatccccgagagcttcgaggggagcagggaggtatcgactgtatccccaaatcaaagcttgaattgattggttgtcagggctggatcagaatctcaccttgtcaccaatcaacacggtgaaacgtggacatcgatcacagggcgccatgtcgtcatgaatagaaaccgagggagagacaagacatacgagatggacagtgtccctcctcatggggatgggatcacccgtagacaatcaggttactttctacactgcgcacgattgcgagaatgtagtggcgtgcatgcctcagtgacagcggaccctctgtcggggcgctcctggtgtgtggcctgccaggcgcggcgaggatggagggcgtgagggtctgggcgcggcagcacccgtccacaatggggtttgccctgagcggggccagcgtggcgacaggtgtcgtgctcaccaactgggtcggtgagcaggcgcgtgtgcctgagtcctggggttgcagggcctggctggctgtagctggagatcactgctatactttgggagggcgcccagtcacaatatatgctcgacgaaccctcctcttccctacccctccctccgtgcagacgtcatcaaggtgcggcagcagacggcggggtacaacaaccggaacttcctggcgacggggttcaacgtcgtgcggcacgagggcgtgctgtccctgtatcgcggctgcaccgccgccgtagcccggggcgtcctttacggcggtgcgctgagtgcctgatgggaggggttgcctgcggcagggccctgccggctggttgctgcatgctttgccgggcgcgacggctgccagtcgacgctcccgcatgcctgcttccccctcctccgaccgatcacggaccctcccctcaccccccaacccccaggcctgcgcatcgggctgtactccccggtgaagacggcgctgggcgcggatgagcccggcaccggcgtgcaccgcaagatcgcggccggcatgctgagcggggcggtggccgccgcggcgtgcaaccccacggacctggtgaaaacccgcatgcagacggcgggggcgcgccagggcgtggcgcaggtcgtgcgctgcgtggtggccgccgagggctgggcgggcctgtggcgaggtaccacccccagcatggtgagtcgtcggatgaggggagcttcagccgtgcttacctcctagatgccttgctgctagcgaatctgctccccagcactggctcaccctgctctcactccccaccccctccatccaaactgccaggcccgagcggcgctgctcacggcggggcagtgcgcgacgtacgatgaggtgaagctcctcttcactcgcgacctggggtgggaggacacgctgggcacacactttgcggtcagcggcgtcaccggcctggtcaccacgacgctcatctccccggtggacatggtcaagacgagcatgtttgtgggcgagcgcatgcgaccctgggcctgcgccaagggggtcgtggagcgacacggcttgcgggggcttttcagagggtgagaaaaggttggggggaaagggaggggtggcgtgtgtgggtgtttgtgggggaaggtagtggtgatctggtgggttgccagggtgttctcagcaccannnnnnnnnnaggggtggcgtgtgtgggtgtttgtgggtgaagtaaatggtgatttggtgggttgccagggtgttctcagcaccagcgccaggccatgccggggcgtgatacggtgggaaggggatgtgtgttgttacatgtgtgcgcacccagtctccccccccaaaaaatcatcatgccaggtggacggccaactgggcgnnnnnnnnnngggccatgccggggcgtgatacggcgggaaggggatgtgtgttgttaaatgtatgcgtacccacactgccccccccaaaaaaacatcatgccaggtggacggccaactgggcgcggcagggccccatgaccaccgtcatctttgtcactctggaggggctcaggcacggctttggcatggacggcatctgacgcgctggcttgtcgacatgcacagcgcggttgggcgctggcaccatgtcacgcatccgcaccacaccagcctgcacccgcagtcggcacgcggaagggcagatgtgtcatccctgtgggatcgggattgaaaggatgctacctgattcgtatgcctgcaagttgtgcattctgccttgggtatctgtttccctggaggacagagtcccttctcacgctcctcacggtgcccgcgcgcgcggtagcagtcctcgctccaagtcccgcacatcaacatctacgaatcatcgttgccatgcacaatgcgctgatgatgctcgcgccacataaaatactctgtacatagaatcgatcctacattctatgctgaggtgcgctcctggccagctcgtcgccgcagtgaggcacttgcagccatgcacgcatgtggttcagaggttggtgcataatgccgaggagtcgtcgaacgaagaggaaatggaaatcaggacggtgccgcggcccgacgtcctgcacaggtgaacgggagatcgacgaggggacaagttcaggcaagtaccaactctgctggcggccaacggggccctacacccatacccaccggctttccacccatgcagatcagcgacagagatcgtgtggcccgccagctcccgacaagaaaagtgtaagggggatttaggacgtggtgtgcccacattcagcaagcatggcacagcccatcatgccaccaggccctcgtccatccccatcactcgctcccaccgtcccagttgcggccaaggtgcatcgagtcctgggcaacgtcctcatgcacgacgccgtgctgcggcagtccctcgtggagcgctatggctttgccgtcgaagaggcgcgtagcattggtgccagaggcgggcccttgtgagcaaggggggttgtcgccgctccccatgactgcccttgacgggagcagggtcaaggtcccttcaacacacccacctcctccttgcttgcacacccctccctgcaggttcggacgtctccagacaacctcaannnnnnnnnngggtgccagaggcgggcccttgagagcgtagggggttgtcgccgctccccattactgcccttgacgggggcagggtcaagggcccttcaacacacccacctcctcctcgcttgcacacccctcccagcaggttcggacgtctccagacaacctcaaggcgttcctcctctgggacagttattcagggcacgagcgggaggcagccaaagaactcgcacgcaggtgaggctttggaatgtgtcggaatcctgtgtggcaggtcctcctagagagacaggaccaggcgcggcccgtctgctcgcagcgagacaaatccagcgcccctctgcgctgtaccccgtccgcaggaaggggaggctgcggtcggcggtcgccggtgggctgggcgtgcgcaacgccccgctcctcgtattcagaaagagcggcatgagctccgaggaggcgcgcctggagtctgtgctggagggcctggcgatcgaggacctccccagccagcgggggttttgagcagaatttggccgggggcgtccaggacgatccctgcgcagttcccagcactgctgccttcctgacttgcctttacacctggacagtcctttacgccgcttggacagctgcctttagtgcctccaccgccccgctgcccctgccgtcgtgccgtttgaagcacgagtaatgggccagccgcccatctgggaaggccnnnnnnnnnnatttggacgggggcgtccagaacaaaccctgcgcacttcccacgactgctgccttcctgacttgcctttacacccggacagtcctttacgccgcctgaacagctgtctttagtgcctccaccgccccgccgcccctgccgtcgtgccgtttgaagcacgaataatgggccagccgcccatctgggaaggccacaaaggcgctgagccccacgcgcttgtagcacagcgtacacaggcgctctgggaccagcgcgatcgacctgacagggttgatgagaggtggggggaaagggcatggtgggtggtttgctttagaaagtggggagtgggaaccttgtctcaggaaataagggtggttcgtcaaggtcacgcaaagaaggcagacatgatgtacagcgaccaggatttgggaggaagtacctcccctgcagccctcccaacccccacccccgtccacattccactgcaccgcacccggctccccccttcctaccctccacacccccccccataacacctcttgtgcgcccccgccagctgcgcggccaggcccacggcctcagcctggcgcaggctgcgccgcacggcggcgccccgccgctcctcctgcgcgccccacagcgcgctgcgcaggaagcgcagcccggcgcgcagcggcagctcccgcggcagcagctccagcgcgtgcacgggttggatggcgccccgcttgcggcccagcagctctgccacctccgcccaccgctccagcgacacggcgcccgtcgcaggggcctggccctgtgcgggggcggcgctcccgctcccgccgtcgccgccgtcgccnnnnnnnnnnnnnnnnnnnnnnnnnnnnnnnnnnnnnnnnnnnnnnnnnnnnnnnnnnnnnnnnnnnnnnnnnnnnnnnnnnnntccagtagcacctggatgaggaggaggtagatgtcggagggctgggggtcactccacccgtcctggcgctgcccggtccggtccagccacagccgcagcatgggcaggtgcagcgcctcgatgtgcgaggctggctccgggggggcgccgccgctcggcttgcgccgcgccgccgcggccgccgccacctgccggccgtacacgcggtcgcagtatgcctcggcggctgccggctggcccagctggtggacgtacagccgcagggcctcgtggtgcctgggagcccaaagggaggaaggggtgtcggaggggtggggctggggcagattgagggtctggaaatggacaagaggggccagattctggggagaaannnnnnnnnncggaggaaagggtgtcggaggggttgggctggggcagattgagggtctggaaacggacaagaggggccagattctggggagaaaaggagctgtgtcgggataatcaggtcattggccgtggcttgaccccaagacgcagtcgagacggtgcatgccctacttgtgttattcaagtgacatgctctaggggcatggcctggaactgggcccttgggcgccacgccactgacaagcggcgccgcgcctcgagcggatcacaggaccgccaatgggtaccctgcgtggccgcagcagcagccgttgtcccgcccgcctcgcaaggtaccctgcagggaccccaaaccagtcacctccacccacctgcccattnnnnnnnnnnattctcccacccgcctcgcaaggtaccctgcagcgacccaaaaccagtcacctccacccacctgcccattcgctccagaatcgcggcccgcagctccagcagctggtgcgagggcaggagggccaggagggagtccagcctcaggtggctggcatgcaggatctggggtgaggcatggttgttggtggaggggtcatgtggaggagagggcaatggtggcaaggggtccttgaaaggaggtgcctcggtatcgaccagcatcacattgctcaagtgggtgcacacgggaaggtgtgccggggctccgcgccagcctgccggccctattcatctcccccacccaagaatcccccccaccccaccagctgcttcagcttggcggtctccgccaggccccgcgcctccgggtcgccggggtcctcgctggcatgctgaaccacgtggcgaaggtacagcgccgccagctgctgctggtacacggcgggcgcggccctgccgctggccagcacctcctccaggtaggaacctgccaaggaggtgggagggagggcgcggggcagtcaagggcgcggccacggcatggtagcggctttggcatgggtgcgaaggcaggcatggggcaggggcgtggcagcagcgccgcatcagcacgtcctgtgcaaggaacaaagccggccaaaccgccccgccacccaccggcgagggcgggggcgtgcgagttgaggatgggcaggagtgcgccggggtcgacgggcaggctggtgaacatctgcaggccggcgtccgggtcggcctccaggatccacctggcgtgagtggcgagcggagcagggcagggttgtaaggccccccgaggtgggagccatcgctgtgggcatggtcctgccccgggcagcatgcatgcaagcttgcttgcttgaaataaatctgcggagcccaaacactccgtcgcctgcttggcattctcctcgtcaaaccaaggccggcacccccccagcccatgaccatccggagggacccacctggagtgggtggagatgagnnnnnnnnnngagggtcccccaggtgggagccatcgcggtgggcatggccctgccccgggcagcatgcatgcaagcttgcttgaaataaagctgcggagcccacacactccgtcgcctgcttggcattcccctcgtcaaaccaaggccggcaccccccccagcccatgaccatccgcagggacccacctggagtgggtggagatgagnnnnnnnnnntgccggggcagggcgcgagcaggaggggaggagcggggcgggatgcgtccacggcacgactccctgcaatgcccttcaattgaccaggaatctgacggcaggcacccctgccaggctgctgtcgagctgtaaagcacgacatgaacccatgatcacgccagctatgccccccaacaccgcggtcctcaccaggcaacccccccaacacacacctggtagagnnnnnnnnnngctgagctggtcggcgcccaagcccagcaggtagcgcacggccgcccacacccccggcaggccgcgcagctctgccgaggcgccctgagcgggcacctccagctgctctgggcgcaccgacaggctctctaaaagggccagcgcagaggagtggcgaccgcgcccctgtcgggggcacggtgtgtgtgtggggtggggttggtgggcgccgggccagggcgcgagcgggaggggaggagcgggacgggatgcgtccacggcaagactccctgcactgcccttcaattgaccatgaattcgacggcaggcacccctgccaggctgctatcgagctgtaaagcacggcatgaacccctgatcacgccggctatggcccccagccccgcggtcctcaccagggcaacccccccaacacacacctggtagagcgcgacgagctcggagtagcgtccggcagcgcgcagggcggctcgcccttcctccaggtccacatggttgggccgctggatgaagtgcaggagcgcgccgctgtcgggcagggccagcagcgcccggagcacggccgtgtcgaccgcgacggcggcggggctgggcacgccgccgggcgaggcgccggcctcgcggttgcgctggctcagcaggtgcggcagcaccaccgccacggcacgcgcaaactcctcgccttggggctccgccgccggggacgcgtctggggagcnnnnnnnnnnnnnnnnnnnnnnnnnnnnnnnnnnnnnnnnnnnnnnnnttggggcacagcggcgtcctcggctcctcaacaagatggcagatgaccagacaggcagacagcgcacccagagcacaggccccatgtggctgtcatggtcctttcagtgattgcgcctggcactggaacgaaggcagctcagcctccccactcccgtgtaaccacaagctgccagctgcgcattccactccccccgccccccnnnnnnnnnngcaggctccacgtggctgtcatggtcctttcagcgattgcgcctggcactggaacgacggcagctcagcctccccactcccgtgtgaccacaagctgccagctgcgcactccactcaccccacccccaccgcgccccacctggagcgcccagctcctcccccgcctgcgctgccagggcctccaggtggccggggctggccagcgaggggaggaggcggaggagggccagcgtgcttgcggcgccgctggcgccaaagtgcagcatgctcccctcgaactcccccgcccagaacagcgcggccgcgtagcgcaggtgcgcgacgtcctccagccgccgccgtgcctccaggtccgctgctggggcggcggccgccacggccaggcactcctcatactcgcccagctccagcagcgccgcggcctgcgccagcgcggggcgctgggacaggcgcaccagccgtccgccggcgcgcgcgaccaggcaggagccgtccgccaacggccaggggcagagcagggccgggccgctcgtgccctcggaggcggcgctcgtttccttgccagcgtcggcgccggcaggctccgcgccccctgccccgccctccagggccagggtctgcaccagggcggcgccggagagagcctggatggggcgcgcctcgaccgcgtcggggcccagcgcacccagcgcaaagggcgccgcgacggccaccgacgccggcggcgaggaccaggccagcgacgcggtctggtggggcgggcggggcccatcaggcagccggaacagcccactctcggcccccaggctgagcaggacctgggaggcggagaccggggtcacgcaggggctggcgctggcgtgctgggcgaggtgggccacgccgctctgggccggggcaatgcagcagtactccctggaacggggcgcacgggagggggcgcttgaagaaccgggccctctgcagcgaggcaccacggcggcagcaagctccaggtgtgagcccatgacgctcagcgtgttcagaaaagcactgaaagcctcggggtgcttgattccagcggcgaggcattcccattcagccggcacgagcgagcatcagtcgtgcgctccacccccccttcgggcccaaagccaggcccggcccatcctacccgctgaggcccacgacgagctgggcgcccacaaaggcgaggcagaccacggtgtcgctcatgggcacctccctgcttggtacaaactccagcccctcgtaggtgaagaagtagaccctgggcagggaatggacaccggggaaggctgaggggggaagaagcaagggtgctgggccagacacacataaggcagcagttgcaaccaagatcccctcccgcnnnnnnnnnnggggcacctccctgctcggcacaaactccaggccctcgtaggtgaagaagtagaccctgggcagggaagggacaccggggaaggctggggaggggaaggaagggtgctgggccaggcacacataacgcagcagttgcaaccaagatcccctcccgcaccaagacgctcccccaccccagccgttcccgacctcccctcctccccacctcttcctgtaggctgttgccagggtcctggtctcggagtgccaggcaaaggcccggcagcccctggtcccggcgacctcggccttcagcagcaggcggggcagcctgtatacgcgcaccccctgcttccccatgcagaacagcatggaccgtgtctcgtcggtctgcagctgcagcacggggccgctggtcaggccccgcctggtctgggtggtgaaacccgctgccgtcaaggccgcagcatgctcctctggctttagaatctgcagatccccgttcttcaagcctgcggacatgcgtggagtgtcgagtgtccgtgtcgaaagagtgctgacaccatagacacggtgttggaagaattgctagccgcttgatgccatgaacccaagccaggtatgtgcacccacccacctacgagcacactgtggccccacacccccagacacgagcagtctggggcggtgtggatcggtactgcatcgaatgcatgcagtgccttgacctccatgagccacagggggcaaggctacacagccagaggcatggctcgggaagcgatcgaggacgtgggggtgcgtcctacgtcatcgatcgcagccacattcaagacgatcaatcatgctgaattcaaatcagaaagctgatgaatcgtgcattcttggtccagagatctctcagatcagcccccccctccccgcatgctggagcgcgcggcagcccggatgccccatctacgatttcgacacgaggcgacgtggatgcgtgnnnnnnnnnnccagaatgacggtgcttggagcgagcctgactcgcatggtaccatgccactcccatccctccaagtccctggcaccccctccacgccccatnnnnnnnnnnaacttcgaatcggaaacctgatgaatcgtgcattcctgatccagagatctctcagatcagccacccccccgcttgctggagcgcgcagcagcccggatgccccatctatgatttcgacacgaggcgacgtggatgcgtggtgtctgtaaagcccattgccccgcgccatgttgctcacagtctactatacaggtcaatagtgcatgtcatgactcgatcatccaaataatttacagctatctattcgaatgacggtgcttgcagcgagcctgactcgcatggtaccgtgccactcccatcccttcaagtccctggcaccccctccacgccccatgcgccgctctaggacgccttctaccgcacccgcacgcgaaattaatgtgattgggccacaggaactgggagatttgctacagcaatggcggaatgggcttaatctcttccctgccctgcctccctcacctgcctccctcatctgcacccctccccccctgaatcatgcagaggaaggatgcaggtnnnnnnnnnntgcacgcgaaatcaatgtgattgggtcaccggaactgggaattttgctacagcaatggcggaatgggcttgatctcttccctgccctgcgtccctcacctgcacccctccctccctgaatcatgcagaggaaggatgcaggtccagggttacagaacggagcccagatcctgcaggacgaggagagcgaagtgtacgacttggagcgtcccatggaggatgcagggaagttcatcgacacaaagggagcaggactgtccctcttcagccctgggtggctgacgcagctaggccggctctggggcggctcctctgtaggcctcggagggttgattcaaatggcctgggaaacatgatgactcattttccagcacgacattgcccgcgtgagggctattttggatattgcttgttgccagtgtggtttatgaaaccgcaaatcctgttgggttacacattgaacatcctgctccatctcaccccgcaggatacaccggttgcggcggcaaagccagcagacatcnnnnnnnnnntatgatgactcattttccagcacaacattgcccgcgtgagggctattctggatattgcttgttgccagtgtggtttaatgaaaccgcaaatcctgtcgggccacacattgaacatcctgctccagctcacccccgcaggatacgccggttgcggcggcaaagccagcagacatccaggacctgctcggtggcgcactgttccgtgccctctacaagtggatggaggagagtgggccggtgtacctgctgccgacaggtgagaggaggggtgggggccgctagggcaatgatggtgacagttctgagatgaggtggcggacgttcagagccattgacctatgtggaagggcatacctgagaacgtcgcattggcatgcacagtattgagcaaaagaacgtctgtcacagctcttcctatacctgtggagaccggccattcccacctgcctcacaccctccttgccctccgcccaggccctgcctccagcttcctggtgatctccgacccgcaagccgccaagcacgtcctgcgggccacggacaacccggcccgccccctgtacgagaagggcctggtggcggaggtctcccgcttcctcttcggcgacgggtttgccatctctggcggcgacgcctggcgcgtgcggcgccgcgccgtcagcccctccctacacaaggcctacctgtcggccatgctggacgcggtgttcggcccctccgcgcagcacatgacgcagaagctggaggtaggtgtcaggggccatggggtgtgtgggtccgaggagttgctgaggccatacccccaccctgcagctcccacctcgccatgnnnnnnnnnngggggccttggggtgtgtggggtggaagagttgctgaggccatccccccaccctgcagctcccacctcgccatgcatgccccgcgccagcccagccctcacatcccgtcatcacacccaccccctgctgtcgttcaggaggcggcgcgcaccggcgccttcctggacatggaggcctgcttctcccagctcaccctggacgtcatcggcaaggcggtgttcaactacgacttcgaggcgctgacgcgcagctcccccctcatccaggccgtgtacacgagcctgaaggagacggagtcgcgcgccaccgacctggtccccatctggaagctgccgctggcgggcctcgtggtgccccgccagcgccgcgcggcggccgccgtgaagctgatccgggacaccacggagcggctgatcgcgcagtgcaagcgcatcgtggacgaggaggaggcgcgggggctggagacggggggggaggaggggctgctgcccgtcaagggcgacccctccgtcctgcgcttcctcatcgcctcgcgcgaggaggtcaccagcacccaggtctgagggcgccgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggccggccacgagacgacgggctcggcgctgacgtggacgctgcacctgctggtccagaacccagacacgctggccagggtggggaccgagggtgcgggcatgggatgggacggccattgacccagcgagacccgatgtccagccgcaggattggggatctcgatcggcnnnnnnnnnnacgagcagcaggcggctcgacttcttcctgtgaggggcccgtcagggcgctgtgccctccagtcccctcgctggctggccctcccccgacctgatcaccccccgttcccgccccgccctccaaaatgcagctgagggacgacctgctgagcatgctnnnnnnnnnnagctcaaccgcaggcctggagcacggagtggtctcgcctgagtcccttttcccgccctcccccacccctgcacaggcccaggaggagatcgaccgggtgctgggggcctcgccctacccagacctcgcgcagtaccagcagctgcagtacctgcagcgctgcgtcgcggagagcatgcggctctacccccacccgccggtgctgctgaggagggccctcgtcccggatgagctcccaggcacgtggttggcaggggagtgtggggcgagcgacgtctccagggcgggttgagggtccaaggctcgcatgtgctcacggtgcctgacgcacaatgctccctgacccctcgacctccacgactgtcctcgaacaggcggctacaaggtgcccaaggggcaggatgtcatgatctcggtgtacaacatccaccactcccccgccgtctgggacgagccagaggccttccgccccgaccgattccccctggacgcgccgccgcccacggagcagaacacagactaccgatacattcccttcaggtacattgggggggtgcgtcgacgctttttttttgggggggggggggcaaacttggtgccctggtcgccaggcatgggaggccgggatgcgtgtgcttgaggtgcttgtggctgcaagggagggcgcggatgacgcgccgcttcttgctcacggcatcgctttcaacccaatccctgcacacctgcagcggcgggccgcgnnnnnnnnnnattgatgctttggcggggggggtggggggcaaacttggcgccctggtcgccaggcatgggaggccgggttgcgtgtgcacgaggtgcttgtggctgcaagggagggcgcagatgacgcgccgctccttgctcacgccttcgctttcaacccgatccctgcacacctgcagcggcgggccgcgaaaatgcgtgggcgaccagtttgcaatgatggaggcggtgagcgcgctggcggnnnnnnnnnngtgctccggcgcttcactttctaccccaagcccgggcacgaggtggggatgaccaccggcgccaccatccacacccagaacggactctacatgggcgtgggcctgcgccagggatgagtgccgggttgcgatgggacactgccgtgctgtagttattccaacgtattggagcgaccaatgggtcttcatcagtatgaaaggaagcagcgatctcagtgagactttgatgattgtcgggattgatgggaagacccaagcctgggatggcagatttacagcagtctatgtacagcccattcccgatcctcaccatggttcgttcataccatccagaacacnnnnnnnnnncgatgggaagacccaagcccaggatggcagaattacagcagtgtatgtacagcccattcccacccccaaccatggttcgttcataccatccagaacacatccgatcccattagacctcggcaattaagctggattgggcgggaatagtactgcggtgggtgaccacgtgggaagtccccgtgacgaactgttttttgctcctgcattttgcccggccgcccagtgacaatgggcagatggtccactcttcaccagtctcacccttctccatcggcatgggtagcagacacgcacaagccccgtgcatggctgccatggtttcctcacggcaacgtgtatttgttgggacctcgtcctctatcaatacacgcatccgcaagctgaccatattgacgcccacatctctggtatgtccccattcatacctaataaccaacggcttcgacagtttggtacgtcgctgaccgcaccatgccggggcaggcaccggtcaactcatagaccggctccggctgtagcatgttcgacaagaggnnnnnnnnnnccggcttgggtagcagacacgcgcaagccccgtgcatggcggccatggtttcctcatggcaacgtgtatttgttgagacctcgtcctctatcaacacacgcatccgcaagctgaccatattgacgnnnnnnnnnntattgtaaaatgacgagtgaagtcctcatagcggagcatcaccgcggcatggacggcatgtccgacagtgacgtcctgnnnnnnnnnngattgtaaaatgccgagtgaagtcctcatagtggagcatcaccgcggaatggacggcatgtccgacagtgacgtcctgcaggcgtccgacatcgagccactgatccggaacgggatacaggccaccgtccatggcgattggaacgaggaggaggccctggtctggcaggaggggatcggtaccgcctgcctgaagctgctcgcgggcctagcccggccctacaagtttgccgtcaccacccacctcagccagcgagcgggggcggggctctgctctgccacggcagcccactggaaccccaacacagacggacacatcgctgtgatctggacctcggacaccgtctttgtttgcgtgacggtcttctggtcggctgtgtgaacgcttctatcgtcatgctgctgggcatagagttctggtgggcaggacgcaccgannnnnnnnnngcggctgtgtgaacgtcatgctgctggtcatagagttctggtgggcaggacgcaccgacacatgcttgtgcacaggattacaccacccttgaaagcgccgccgagatcaacaagcatttgcctcaaagaagttgatttgaaggatcagggcccctcagacctctagcttgcgccggccttggcctccttcttcttcactgcccgcgacttcctctgcttgggcgccgtgccggccgcctcgccggccgccttggcccaggcggccgccccccgcctccacttggtcttctgcggctcgatgatggcctggcccccagccgcctcaatgctggcacgtgcagactcgctgaaggccgccgcgcggtatgtcctcggctccgtcaatttcccatttccgaggatctgatgttcggaggattggaggggggcaagcacctgaatggtaccacttctcgggccagcgaggattgacccgtcctgtcaaatccacactgcccatccagggtgggagcagcgggatctacctcacaatgctccccagcacaccttgaggggcagccgcgcttcccggcctgaggggttgatgatgcgggcgctgcagagggtctgcaggctgacctccatgtccgggggcagggggacgggccccacgttgaagatgacatagtcgggcagccccgcgcccatgcctgggggacacgggatcgatggtcacatgtgggccagccatccaccactcggagccgggaagagtgggcaggcatgatttcctcacaacaggttgctcacagccacaacacatgccggctgccctcacctcctgcgatgcccttcagctttggcagcctgcggtacaggggggtctgcccaccctcgaagccgggcctcatgccgcttccagacctggacttctggccacgcatgccgaacccagccgaccctccctgtgttatgtgtgtgatgtagactgattaccgtacaatgccatccaaggaagaaaaacataccgaaaggtcatcgcatgtcaccagttctccatgctcccacaccttcacacccnnnnnnnnnngcgtaccgcaaggtcatcgcattttacgagttctccatgctcccacaccttcacacccagctcacctgaccagcaccgtagcctcggcccttcctgttccgggccttcctggatccaggctggggggacaggttatgcagccgcaggcgctctcccatgctctcctcgggccattccgaagcggttgccatggggcggaggcgaagcaggggtgcacgggctgcgaatggctgatggaccagtcggcatcccgcaaagctccgtatcaagctgctctgagactgcagtttagttgggtggggagggaagatacatcacgccaggatactgaggggagctggcgcaagccatggtccatgcacctcacgtcactcaccagggcaggcgcctgagctcnnnnnnnnnngagttgggtggagagggaagatacatcacgccaggatattgaggagagctggcgcaagctatggtccatgcacctcgcgtcactcaccagggcaggcgcctgagctcccaatcccacgcgcattgctctcaagcccagtcagagacgtccaaatggtcaataaggctgaactggccaaagtgtggcgtcgtcagatgtgtgtgctctgcatcgccgggggaacggagtggatagcgttgtcgcgggaacgggtgcgcccgggccgtgttgacggaaatcgaaggttggagggggagtggcccagcttccccaggtcccgctctgacacgggctgctgggacgcatggctggactactaaccagcacttgtacctttttacttttattcaaggaatcagctcgacccttcaaaaggcgtcgaaatcgaaaccctgcccagtcaggaccagggaggaccctgaaggtcgtgaacgcagccagagaatctgcgtgacgctgtcgacaaggcaaagaggaaaactactacacacctgaccgttttctagcctttcaccggttccccaatggggaacagcgggagcagacaccggccccctcttcccacatccactcccccagctgcgccgagtatcaccaccgggcccccccctccccccgaggccgcagtctcggcacagtacccaccacaggtaagattgcagggcctgcacaaaggctcgacttgcttgcgcgcaactcgtgccggccaaccccgccctccaatagcccacccctcctctctttcccctgtgctgcagtcgccctacccctaccctcccgccggacaggccggggccnnnnnnnnnntccccctccccccgaggctgcagtctcggcgcagtacccaccacaggtaaaattgaagggcctgcacaaagactctacttgcttgcgcgcaactcgtgccggccaaccccgccctccactagcccacccctcctctctctcctgtgctgcagtcgccctatccctaccctcccgccggacaggccggggcccctccctatgccaataacggaaggacgtacggtggttggcaaccttccccatacctgccgcccagggtgaggacagtgtgtgcgagtctgtgctagtttcctgccggtagctgagggtgtgggcccaggcttgtcaccgtcgatctttcaaattctggagtcgcccacaaaggctatattcttgccacattgagtgtcgtgagcatccgcagatgaagctttgagtctcatagcagtctcccaccaccctttccatcctatcacacggacccagaacccactgccagctcagcatgtgccgcggcactatggcggcccccccgcccccgccccgcccacacccgccccagccagccaggagctgacccagaccgccaccatccgcaacgccgtgaacctgaagaaggccagcctgcgtgtggcgcccggccccacccccgacacgctgtcgatctccttcacctttgacgcctccagtccctgcgtggtcagcgtcttcctgggcgcgcgcgaggacgtggcgcacggctgccgcctgaccgccggccgcgcgcccgc

SEQ ID NO: 35176 - DNA, 82 bp, Chlorella protothecoides
gcagtttttggcaaagagtaacccctgcatctactcccaatgtgtagtgtttgaggaccatcaccagcccaagaagtgagtg

SEQ ID NO: 35177 - DNA, 108 bp, Chlorella protothecoides
tgatgaccacgcgcgtgagcccctgtccgcagcaattcgatcaggccatcccggcattacagcacattgatgcatagcttacctgtaacgactgaactcctggtgctt

SEQ ID NO: 35178 - DNA, 6992 bp, Chlorella protothecoides
  modified_base (898)..(907): a, c, t, g, unknown or other
  modified_base (1035)..(1044): a, c, t, g, unknown or other
  modified_base (1319)..(1328): a, c, t, g, unknown or other
  modified_base (1734)..(1743): a, c, t, g, unknown or other
  modified_base (2593)..(2602): a, c, t, g, unknown or other
  modified_base (4017)..(4026): a, c, t, g, unknown or other
  modified_base (4322)..(4331): a, c, t, g, unknown or other
  modified_base (5575)..(5584): a, c, t, g, unknown or other
  modified_base (6837)..(6846): a, c, t, g, unknown or other
cgccgtggcgcgcagcgccgccggatcgacgtgctgcgtggtggccaggctggcgccgcgcgccagcggcacgcccccgcccgagctgtgcccgctggcgtcggtgaaggcgggcaggcaggccacggccgccgtggctacgctggggcccggcgccgcccaggcctctggatcggccgcgtactcctccatcagctgcaagattgtgtgatggggcaggtgagtatggtagggaggggggggggcctgtggaggtcatggattaccgaggagattgcctgcacatgctcctgcatgcgtcgtgagcccgcgtctctgttgccgcagtgatcatcccgcccgggaccacccccccaaaaaaaaaacaacccccaaccacaccaacctgagcctcgttgccaaagtggctggcgaacgacagcaaagaccgcgccagcgcgccgacctcctcggcggagatgccctccgcggtggccaccagcgcctcgtgcgcctcgcgcggccccagcacggtgtgtcccagggccaggctctccatcacaaagtccaggtgctccgcgctgggcgtgctgtgcgccgcctcagccagctgctcgctgtcgcgcaggagggcggtgcggtagcgcgccagctcgctggggctgacgccgtggcgctgcaggcggcgcagctccgccaccgccacgcccaccgcgccgcgccagtccccgggctccgaggtgatggtcagcgtggacaccgcgcagccctcccgccccgagtccgagtggtccagctcgatggaaacgaagggcgggtcggcctccacgtaccgcgcgttcacgcggaactgcagcacgctcagcaggatgcgcaccatgaacgcacgcctggggggggggggggggggggggggggnnnnnnnnnnttggggatgggtcgacagcgggtgagcacgggcgcaaaggtcatgagtgcgaggacccgggcaccgaagcggccgactgcagcgcctcctggaccacatgcagagcccgcacgtcgctgcaggcccgnnnnnnnnnngatgggtcgacagcgggtgagcgcgggcgcaaaggttatgagtgcgagggcccgggcagcgcagcggccgactgcagcgcctcctggaccaaacgcagagcccgcacgccgctgcaggcccgcatgtgcacgcaaacgggcctgcgactcacgccagcaacaacgctccccttgcgtgcccctacatcgacccacgccacatccccccccccaccccccaccccaaaaagaaaattaaacaattaacccacctgaggtcctgcatggtggtcagnnnnnnnnnnccacgccagcaacaatgctccccttgcctgcacccacatcgacccacgccacatccccacccaccccacccccaaaaggaggaaaataaaacaaacaacccacctgaggtcctgcatggtggtcaggggctggatgggcagcttgcagaagagagacagctggaacagctggagcaggcggtgccggaatacggaaatctggggcggcggcttggcgggcgccgccgcgccgcagccccaggcgtgctgcactggcgggcgcagggaggtggggagcagcgacaggtgggtcgcggcgccgccggtgccggcgcccgtcgcgctcgcactcgcgtgtgcctccttgggcagctccaccgcggccacgccctgcgcatcgcggcgcaccgagcgccggcccgccggnnnnnnnnnnagtgccggcgcctgtcgcgctcgcactcgcgtgagcctcctcgggcagctccaccgcggccacgccctggggatcgcggcgcaccgagcgccggcccgccggcacgcggtcaaaggcctggcgcaccgcggcgcgcgccgcagccggctccaggtcgccgaccaggtagagcgtggcgttggccgggtggtacccgcgcgcccagaagtccatgatggcggcgcggtcccagcccgccacctgctccatcttgccgatggggaagcggtagcccagcgcgttctcggcgtgcaggtactgcagcagctggcagtccacgcggtactcgatggtgttcatcatctgggcctcggccgtcaccgccttgcgctccttctcaatgcgggagggcaggaactcgggctcgaacgcgatctccgccagcgcgtccagcacctgcgccagcatcggcgcgcccgtgccggcattcacgcgcggcgcgtgcacgtggaagacggtgtggtggaagtcggtgtaggcattggaccgcgcgccggtgcccagcagcgtctcgcgcttcttggaccccaggaaggtcacgtgctccaccaggtgggcgatgccctgctcctccgccgactcgtccaccgaacctggcaggggatggttgcgtgctccatgggatcaagtggctgggtgccgggctccggcagggttgcaggtacccacgcatgctgggcacgcacattctcatgcagacaggggccagccaggggcctctgtgtagacatgggcgagcggttccccatatcaagacagagggtcgaggggggtaccaaagaggatgtgggagcatgcagcgtcgccctgnnnnnnnnnngagtggctgggagccgggctccaacagggttgcaggtacccacgcatgctgggcacgcacattctcgtgcaggcaggggccaggtacgggcctctgtgttgacatgggccagcggttcccccataccaagacagagggtcgaggggggtaccaatgaggatgtgggagcatgcagcgtcgccctgcgctccgtccactgctccctctccctccccctcctccaccatcaccgccaccccaccgcctgcaccacacacacctgtgtggacctccaggtgcgcctcaaacctatccacaggggaggggttgggtaggaacacaacccgcaggccgttgtcaaggtaataaatgtccagcgcctgatggggctcgagggcttgggacgggccgccctccgagggagcgaccacggcatcctctgcctgcgggaagggggagagcccagcgacaagagggaagcatcagcgacaggaagctacatgggaaatgggcatcgcccagccccgtggatgcgcccacacgggtcgaccacaggatgtttccagacgctctttcccatgccactgaatcagcgtggatgggcccgtcactctccccgccatgcgcaccagcaaggcggcaagcagggatgtgccatgcctcctgctcctgttgtgcagtcgggagccgctctggcgcccgagcggagcccgcaggggttgaagctgcctagacctggagggcgagggatgggggcagatgtggggcccagtcccacgaaatcatgcaccatggatgggcatgtcatgcaggaaccgatggacccacgcaccccacggacgagactcccacacagcgtctggcgggcagggagcttcgggatgttgtggggttcacgaggcgccgagcactgggcttgggtgcctggcttgcagcaggcccctggaagggcgccacgcggagcaccgcatgtctgttcaccagggaggagcgggcttgcatgaggcccacgcggtgtagccttggcacttgcactgatcgaggtcccgcaagggaggagggtgtcacctcacgacagcatgcacaactttccaatcacggaattatgtttcgaggtatgtgactggaagcccacatgcggctctggtcgcccaaaactccagcctggacgggtcgctgtgctggacctgataacattggaaagcatgattctttcggatgggctggctcctttataaatgtgcacgatgctcctcaagttgacacaagggggactgttctcgatattcccatgtgttcattgggatatgtttgttttgtctttcccgattagatagggtgttccacgcttgctggctgcagcatgcgtcagggctggcaggactctcagggcatcacatccgacagcatcggccacaccacatatgcacagctcnnnnnnnnnncctcagggcatcacatccgagagcatcggccacaccacatatgcacagctcctacaacccagcatgcaacgatggtctggaacaggactcgcatgccccggcggatggacgggtggttactgcggttatacatacctacgattctgtcacccggggtgaagcggtgatgagattagagacgcgggcttgtgcaacgtctcgattcgcttcgttggattaagcaaccagagaagatagtatactcgtctcggggatgcaggcgtggctgttcactaccgcgttgggcacccggttgnnnnnnnnnnggttggattaagcaaccagagaagatattatactcgtctcggggatacaggcgtgcctgttcactaccgcgttgggcacccggttgagatcatggcgcgccgacagatttccacggtcgacgcaagatgtaggtggtcatcaaactggcaaacccggttctcgagcacggaaggacgtcgaagtgaacgtacgttacctagaatagagtcgattttgcttgggatacccctcagtagtgtccttcgaggtgtagcgatggcgtctacgacactgaatatggctcaggtgggctggtgatcgtgggcgccaacctgcccacatgccgtgtcggtgatcatgcgccgacataatgcgtccctccatgccgtcccgcaggcgagccgagtagccagcgctaagtttggcaggcccaccccgaccccgtgcccaccccgcgcccacctgggccgtgctgccgcctgggccggcacccacccaaggcccacaccctgcgcagccggcccccggcccagcctgcggtccacggccagggtgacggtgcgggcggaggccggcaccaatgggtctgctgccgaccatggggtgcccatcaccaaggtgctcatcgccaaccggggggagattgcggtgcgcgtcatcagggcctgccgcgagatggggatcaagagcgtcgccgtctactctgtggccgacaaggactgcctgcacgtgcaggtgggtgggtggcctgcagatggtgttggtgcacatgagggggatgcattgattgtgcagccatcaagtagcgtctgtccttgtttgggagctgtgcgtgcattgaggggggacccagaatgttgtcagtcagaccagctctgagcacactctccccacctgccccttcacccaatcagcttgctgacgaggccgtgtgcatcggggaggcttccagctccgagtcctacctcaacatccccaccatcatcgcggcggccgtcagccgcggcgccgacgccatccaccccgtacgttgcaacagctttgaggagggtggggttccagaggtcttgggtactgcacccttgtagatgagggcggaggactccactcaggcgcccaccactgcgacaccctggtgtgatcctgagtcttcaccctcttccggcccctgattggagtcatcacactcaccaccttcaccaatacctaacacccccccccccttttacgacacccagggctacggcttcctgtctgagaacgnnnnnnnnnntgtcaccctcttccggcccccgattggagtcatcacactcaccacattcaccaatacccaaccccccatcccattacgacccccagggctacggcttcctgtctgagaacgcgtcgttcgtggacatctgcaaggaccacggcatcgagttcatcggcccgcgctcggagcacatccgcgtgatgggggacaaggccacggcgcgcgagacgatgaagaacgcgggcgtgcccactgtccctggctccgacggcctggtcaactcgccagaggaggcggtggaggtggccgacgccgtcggcttccccatcatgatcaaggccacggcggggggtggcgggcgcggcatgcgccttgcaatgacgcgcgaggagttcctgcccctcctccgcgccgcgcagggcgaggcggaggccgcctttggcaacggcgcggtgtacctggagcggtatgtcaaggatccgcgccacatcgagttccaggtgctggccgacaagcacgggaacgtggtgcacctgggggagcgcgactgctccatccagcgccgcaaccagaagctgctggaggaggcgccaagccccgtgctcacgccggaggttcgggaggccatgggcgccgcggccaccgccgccgccaggagcatcggctacatcggcgtaggcactatcgagttcctgtgggagcccgcgggcttctactttatggaaatgaacacccgcatccaggtgggtgggtttggtggagaggcggattgagactctcttcacatctttctccgtcatggtttctcccattttgtacaggcgctctcaaccaggtaaacacttcaacacggtctccccccttctcctctctaaaaaacatcaacaggtggagcaccctgtgacggagatgatcacgggcgtggacttgatccaggagcagatccgggcggccatgggcgagcccctgcgcctgggccaggaggacatcaagatcaagggccactccattgagtgccgcatcaacgccgaggaccccttcaagaacttcaggccggggccaggtgtgtgggtggagtgagaggggtcgggtgatggtgggggccagggcgggcatcctggggtggcatggacaaagcctggacatggattcgattggatggacttgcaccctgtcgagtgcgctggcacacccatcgtgccgccgccctgcgctcatacctgcaggcgccgagtcatcacatctgccccaccccgtccccccccaacccnnnnnnnnnngaagcctggacatggattcgataggatggacctccactctgtcgagtacgatggcacacccctcgtgccgccgccttgcgctcatacctgcaggcgccgggtcatcacacctgcccctccccgtcccccccaaaacccccctccca

SEQ ID NO: 35179 - DNA, 61 bp, Chlorella protothecoides
gcccaataagctggtggagagtccgcgtcaagggatttccccgctgctgtgactgctgggc

SEQ ID NO: 35180 - DNA, 107 bp, Chlorella protothecoides
ggaggtcgtcgtatggggtttgggaggagggtgtccgctgggaagcgggggagctcggcagcgtgctgctgctgcccgacagtgtgtcgtccgccgcccagcccagc

SEQ ID NO: 35181 - DNA, 77 bp, Chlorella protothecoides
tgcctgtggccgtcacattctgctccttcctctgggtgcacgctacccccccactcccaccatgcatacctatgcct

SEQ ID NO: 35182 - DNA, 62 bp, Chlorella protothecoides
gatggctcttcacctcagggacctgtcaaaggacagagtccccaccctcacccctcgtcatg

SEQ ID NO: 35183 - DNA, 9315 bp, Chlorella protothecoides
  modified_base (511)..(520): a, c, t, g, unknown or other
  modified_base (1223)..(1232): a, c, t, g, unknown or other
  modified_base (1545)..(1554): a, c, t, g, unknown or other
  modified_base (1935)..(1944): a, c, t, g, unknown or other
  modified_base (2064)..(2231): a, c, t, g, unknown or other
  modified_base (2408)..(2417): a, c, t, g, unknown or other
  modified_base (2853)..(2862): a, c, t, g, unknown or other
  modified_base (3022)..(3031): a, c, t, g, unknown or other
  modified_base (3359)..(3368): a, c, t, g, unknown or other
  modified_base (3548)..(3557): a, c, t, g, unknown or other
  modified_base (3679)..(3834): a, c, t, g, unknown or other
  modified_base (3905)..(3914): a, c, t, g, unknown or other
  modified_base (4044)..(4053): a, c, t, g, unknown or other
  modified_base (5369)..(5430): a, c, t, g, unknown or other
  modified_base (5610)..(5619): a, c, t, g, unknown or other
  modified_base (5854)..(5863): a, c, t, g, unknown or other
  modified_base (6285)..(6294): a, c, t, g, unknown or other
  modified_base (6819)..(6828): a, c, t, g, unknown or other
  modified_base (7468)..(7491): a, c, t, g, unknown or other
  modified_base (7660)..(7669): a, c, t, g, unknown or other
  modified_base (7723)..(7732): a, c, t, g, unknown or other
  modified_base (7786)..(7795): a, c, t, g, unknown or other
  modified_base (8817)..(8826): a, c, t, g, unknown or other
  modified_base (9243)..(9252): a, c, t, g, unknown or other
cccgtctccaccaccatgaccatcactggtggcctcattggcattggctgcctggagggcttcaagggcatcaactacaaagtcctgtttagggtgcgtcctgcagtatgccgtgatgggcgaggaagggccagggcagaaccacctcttgatccctgtgaattgaggagggaagccactgcaacatgctctgggctgtagaaaggatcaacaagtacacactcaccacaagtacaactttgcatcactgcccaacccccccaactttcccagatctttttggggtgggtggccacgctcttcattgcctgcggcatttcagccgggatcaccgcctttggcgcgtactctccctaccagcctatcaatgaccagctggtctcggctgcgattgtaagtggcccaggagaaaaagttggtgtgtctgagatgagggtctcaggggggtaattcaccccagcttcctgctcccccccccgccccccttcctgccttctagtccatgccacgnnnnnnnnnngaaaagttgatgcgtctgagatgaggggctcaaggggtaactcaccccagcttcctgtttcccccctcgacccccttcctgccttctagtccatgccacggccatggcataagctcaccagcatttccgaccagaatcgtgcatatgaccctcctcctctcctccccttcttaccccaggtgtacaaccagaccaacactgccatgatcgcacagatgaacgcggcactcctcacctccaccaacgccgacaactccctcatccaggccagcatcgcggtaagctgtcataagattctctgcaggggagccggttgtggagatgagacttagtatggtgtgctgagtcaagtcgaccctcaccgaccatcgattgctacatttgccagccttcgtcccttccacccgccccaaccaaaccccattctctctcccacctcttgcagagcctgaactcaaccttctaccaggtctttgcccctgtggtgaagaacctgccggatgtcgtttccatcaacagtcagatcctgtcggagttcaacagcacgctggcatggaactccttctcccaggtagacatggggcaaacacttgtgtcgagagacacaacatggctttgcttgcgccacctcattgagcagggggggtgggcagaaccgacaacaatctggtctaactgttccgagcaccaccctagtaaacannnnnnnnnngcatggcttggcttgcgccacctcattgagcagggggggatggacaaaaccgacaacaatctggtttaactgttccgagcaccaccctagtaaacaacttcctacccatccctcttgccatgcagatcccgggaagcctggtgcctcaataaatgcaggtcttggcacacccctgctgctctatatgtcgctacttttggcctgcagcgcactgcaaagagagatgatgggtcggtgagcgatgcatgtccatgccgcaggaagaaagcatggtgcatctccgttcctcatcctctgctaaaccccttgagcnnnnnnnnnncgggtcggggagctatgcttggccatgccgcaggaagagggcatggtgcatctctgttcctcatcctctgctaaaccccttgagcttaagttctactattaggatcctgccagcgtctgattactgatcgatcattcacgacgccttgatcagcctggcattgagccagtccaagttgacatccttcatgtaatcctcaaagtccacgagcatattgggctcggcgttaggccatgcattggagggttgacctgggcagacatcgcatgcatttggctgggacgcaggtattgattgcagcctgcccttgttcataccgtggcatgagcgccacatcctcacgtcgggaactgcaagccatagcgctcgcacaaaagcagnnnnnnnnnnctcgcatgcatttggctgggacgcagctattaattgcagcctgcccttgttcataccgtggcctgagcgccacatcctcacgttgggacctgcaagccatagcgctcgcacaaaagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaccccgcgcgatggccaccattgaaaagacgcagcgagcagggggactctggtgtgatgctatcactcgcttgcatagcgccggctgtgtatgcggtgatcccatgtcattatatatgtcgcctggttacccattggctcctggtaatggagcagcccacttcctgtagtcctnnnnnnnnnncgatcccatgtcattacatatgtcgcctggttacccattggatcctcgtaatggagcagcccacttcctgtagtcctgtctgcactgccctggcccaaaactcaccatcgtagccctgccccaggacgccatgcacccggcgtgtctaatctctttttattgcatcccatttgcaaaacctggcccagcagcttacaagaccagcctgcaatctttcgccactgctgccctcttggaagcgaagctggagactgccgcagacggtccctcgaatcacctgcagacggagcccagacctcaacaaaggccagcctctgggtcaagcactcacgaaggatacgcgacttcccctctagcagtcccctcgaggcaagaaataagtatctaatgatgtgttccactgatgaccagaaaccatttcttgcccgcgggccgnnnnnnnnnncgctcactacgaacaagttccaacttcattacaagtactttcagggtcgtaaagtatagattatctgctccgttgcattttttcgacattccggcatcccgccgataccaaagtcgatcgtaagcttgcccttctgccccctacctcggggtcccagtgnnnnnnnnnncagcagtcctctcgaggcaataaataagtatttaatgatgtgttccactgacgaccagaaaccatttcttgcccgcgggccggatgccgatcttgcggctgcgcctccggtcaggcttacaggcgaaggttcttccgaaacacaacagcatgcccttcgaccgtcaagatgctcactacgaacagattccaacttcattacaagcactttcagcgtcggaaagtgtagattatctgctccgttgcattgtttcgccattccgacatcccgccgataccaaggtcgatcgtatgcttgccttctgccccctacctcggggtcccagtgnnnnnnnnnntccatcggttgcatttcaacaagactatacgcggtataaaagcccctcttgattgctttacttttcttgacactaacaaggcatcattcctgcgtaaggtccgtggatccgcgtagctggcagcgaagtccctggaatattcgcacgggtgttgttttcctcatgctcagattccccaannnnnnnnnncccatcggttgcatttttaacattactatacgcggtatagaagcccctcttgattgctttactgtttttgatactaacaagacatcaatcttgcgtaaggtccgtggatccgcgtagctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggagcaggggtttgcgcggcacgcttcaagtccatgaccttcagtcaaaccgagtttctccctggccnnnnnnnnnnagtgggtgcctgggccgacccccatgtgtcaactttgttcgaggcttaaaagctcctcatgatggagcttcctcaactcagaagcccagggacccctcgggtgcctggatgtcaacagacagtctctgcnnnnnnnnnnggtgggtgcctgggccaacccccatgtgtcaacttgattcgaggcttacacgctcctcattatggagcttcgtcaactcagaagcccagggacccctcaggtgcctggatgtcaacagacagtctctgcagcatggtcagactgtccctgcgccgacctgagaagtagagtgtcggagcaggggtttgcgcgccatgcttcaaatccatggccttcagtcaaaccgagtttctccctggccaagaagcagcatgccccagctgggacagacaagtgccccgcctcctcgagctcccaccccgcaagccattgacacttgggtcctctccctcaagcccaccaccctgaggcacctgagctgggaggggagaacagctgcgcggcagccctggccagcattgcttctggggacgtgaccgagccggcagccatccatggcccggggcaagacaccaggggagccagggcccccagatggcttgccggggacggtgggaaacgtgccttgcgcagtgtgatgggtcttcccgaggctcggggcgacagcacggcatcccaggtggctgcaatcgaccccggtgtgtgctggggaataggggcatcatccagcgactgaggatgaagaacgggttccgagtctgtgctcagtctgtgctcgggagtggggttccaaaggtctacaggatgcagtcatcggggtggttcgagggacagcgcttgctgcagaggctcctctcggcctctcctccctacactgtttgaacatggcacggacacactcccgccacagccttgcctgcggacatcgatggcgaccttggcagcgacatgcagcggagtctcgctgggagccgggctcgccaggacagacccggcgtcgctggctccctcccaggccgccaggagcgttcgccgcgcgccggggcccttgagtgtccgactgcgaccctggctggcattctggggcgcggcagactggggcgtctcggcagtgggacggcgtgggccctcgtcctctgcctcggtctcgaggtggctgtcggtcagcgcggcatgctccctgtccccactgccacggggattggggctggcgttgtccgctgcagagggcagcggcgctggtggggaagcggctccttcccggggcgctgtcactggtctggaattctctgccggccagccacaggcctggccgcccgcaccgcccacacccacgcgctctgcgcgctgtgctcccacagctgtctccatctcgctggcttggctgtccggcaagaggtcgtactttccagagtacggcgagggcggcatgcccnnnnnnnnnnnnnnnnnnnnnnnnnnnnnnnnnnnnnnnnnnnnnnnnnnnnnnnnnnnnnngatgcgggtcggagggtctgacgcttggccgcagcggccttccccgccctcgcctgaggtgcgtgggagcgggagggaggctcagagcagggcggcgatgcttggctgcaccctcgtgtgtacaccacgaggaggttgctgcctgccccattccccccacctctgggcaagtcaagcggnnnnnnnnnncggtgcgtgggagcgggagggaggcttagagcagggcagcgatgcttggctgcaacctcgtgtgtacactacgaggaggttgctgcctgcccgattccccccacctctgggcaagtcaagcggcagtcacagcagggaggagcactcgtaaggaaggaagaaataccagcacacaagcacctccagctactgccacgcatcccaactcaccgaggctcgccgcatcgccacagcnnnnnnnnnngaagggaaggaagaagtaccagcacacacgcacctccagctacagccacgcatcccgactcaccgaggctcgccgcatcgccacagccagtccattcttcatcctgggactcttgaaactctgcacgacttccgacctgctggcccctccaatggcaggggtcccagcacacgcgacctggcgatcctgggaccgcacgggtccaggtgggggtgcttgctccgtttcaacaccagattctgttctgggcaccgccttaacaggaagctggcgggaagcttgcagtctctggaccgtggcagcggtcgcctgcgcctgcagaggtgaaggtaatggggagtggcatgggcaaggcatgccgtgcattgtctcattccaattcctagtaaaacggcttgcgggtcgagtgagggtcacatctnnnnnnnnnngacaggaagctggcgggaggcttgcagcctctgggccgtggcagcggtcgcctgcgcctgcaggggtgaaggtgatggggagtggcattggcaaggcatgccatgcattgtctcgttccaattcctagtcgagcggcttgcgggtcgagtgagggtcacatcttccccgctgcccgtgggctccatccctaagcttcatgtatcaagaacatcccccaaacacactcccctctgtcctgagcagcactcaatacctgctgcctcgcgatggcgcgagtgagtctgggcgccgcgggaatgtgagggccctcgccgctcgccggcatgtggagagatgcacgctcctgcgtcctcctcgcgggaatcgcagcacatgttcctggctctccagtcacgcctgaggtcctgcgtgtccgggaacctgccactgccgatgcgccagtcggggctggcaggtgaggaaggaggatggcagcgctggcgatgtcggtgtcgctggtgtcgaccctggcggctggtaacttnnnnnnnnnnagccgggatgtgagggccctcgccactcgccggcatgtggagtgttgcacgctcctgcgtcctcctcgcaggaatcgcagcagatgtacctgggtctccagtcatgcctgaggtcctgcgtgtctgggaacctgctactgccgatgcgccagtcggggctggcaggtgtggacggagcatggcagcgctggcgatgtcggtgttgctggtgtcgaccctggcggctggtaacttcccgtctaaagttgatgctgagggagggtctgccaggtcagatgggtgctgcctggggctacgccgacggactcggacagactttgtggaacaggccccaacgttatctggcagcacagaggtggcggcccgtgcagtgtcaacgccatgcttcgacgctgatgggccccccaatgtcacaggcccctccactcccgccacgtcctctgggatgatcaagaagggaggcctggcatcgcctgatggctgtgtctctcctggcccgcctgtttcctcagacggcgcgctcctcttgccctgtctgctctcatcggctgccgctgcgccgtcttcctctgtgccagctcctgccgcatcctgtatctgctgaccgggcgctgttgctgctcctgtggccgtcgtgggnnnnnnnnnnnnnnnnnnnnnnnngggcttgctcgtcctggggctctcccgtgctgcaccctgccgtcgctccgtcctttgcggcgagcacagggctggctgcaccagggcccgagcctcccgcctgcatcgctgcctgcccagcatggcatggcccctcctgcagggagccgtctggggttgccgactcagnnnnnnnnnntagcaccaagaagtctccgcctgtcaatgcttgtcccggcaaggcaggggccannnnnnnnnncagcaccgggcagtctccgcctatcaatgcttgtcccggcaaggcaggggccannnnnnnnnntgagcctcccgcctgcatcgttgcttgcccagcatgggatggcccctcccgcagggagccgtctggggttgccgactcagcagcagcatggcccctgtcccagtgcatctcgtgcagctgcgggggcgaaccccccggtgcgaacgtttgctcagcgccaccatcggctctggcgtgtgcggccctgaaggccgggtgtgagacagggtcgagcagctggggggtgaggggctccgatcgatcggcgcgatgaacacccatgcgcacctgacaatcgcagcaggcgttgctgctcgtcagggaacacatgcatggcaggcaccaggccccagtcctgccttccagcagtcgactcaccgagcagcatgggcgttggtgagccaggtggacatggcggcagggaccgggccgagggccgccgtcgcagctcgtgccctcctgtcctcctcagcccccatccccagggcggtggcgggccagcccggggaggtgggaggggtgggcccgatggagaacacgggcacgagggctcctggcagctgggccggggcgctcccctccgtctccccgccggggaacgccaggggcagcagcaggccgacccccgcccagtgtcggcggggagcagcctggtcgccggacccgggcctcatctcgctccccgggacgaaggggtcttcctcgtcggcgcggatgccctggcggctgccgggcgcctgtgccgccgccggggggctgacgatgcccaccctgtgtgagagtgattgaaggggtggggggtatgcagggatggctggggaggggaggggagggggggctgccgggactcgtagtgatgtgcaggggcgcttccagcctcacccctcagccgagcaagggtcatgtcgggacaacatttgcagagagggcaggggcatgcgctctgagtctcagacatcagccatggggtgcatggacctacccagggcttcaaaccccgatggatactccatcacaaccaccaacacacgcactcttcgacnnnnnnnnnnggctgggacctacccagggcttcaaaccccgacggatactccctcacaaccaccaacacacgcactcttcgacaggggcgtcggatcgccggggactgcgtctgcgcttctcccctccgcgccgcgccacctccccgcgagcagtctccggcctggcagaccccgtgctctggccatgggacgtgccctccgcatgtccgccctccggccgccgccggccctgccgcggcggcagctgggcgccggcctccctcggcgtgacgctgccgggagcgctgtgccgggatgtacccgcgacactgaaccccgcccgcacctgatagctcagtgccctcgtgttattgtgcctgggaatttgggggggaaggcagagggaggcaaaagttgacgctgacgcgtgggctgggtgcactgtgnnnnnnnnnngtttggggggggaggcagagggaggcaaaaatggacgctgacgcgtgggctgggtgcactgtg

SEQ ID NO: 35184 - DNA, 69 bp, Chlorella protothecoides
caggcgggcatgtgcatgctcgagcaccacgacatccgctgtgggaggaaccaaactctccagccggcc

SEQ ID NO: 35185 - DNA, 62 bp, Chlorella protothecoides
cgagacgggcagtcggcgaggcagacgctggcggtggacgtcttctccctgggcctggtggt

SEQ ID NO: 35186 - DNA, 71 bp, Chlorella protothecoides
cttccaaacccgtgccatcccagaagtgagttgcaggctcttcttgtggtagttgaactcttgagatgcac

SEQ ID NO: 35187 - DNA, 61 bp, Chlorella protothecoides
gtgatgtgagagggtgtactggtgagggtgacgggatgcacgctgatggctgtagagctcc

SEQ ID NO: 35188 - DNA, 91 bp, Chlorella protothecoides
aaacttggagagtatggcattgccatggacccctccaccctacagaggcgttgagagaggttggcactgggtatgccactcctgagactgc

SEQ ID NO: 35189 - DNA, 121 bp, Chlorella protothecoides
ccatggaatggggactgtccacatgaggggcttcccctagtctcactgttcccatgtcctcaccatctgcaatctgtgtgcaaccgcccaccaggcggtggtcatggcgagcctgaacatc

SEQ ID NO: 35190 - DNA, 79 bp, Chlorella protothecoides
gccacgtgtctggggttggccaacaacagcttgggttatcggcagcagagcggccaggctctcccacgctacaggagct

SEQ ID NO: 35191 - DNA, 72 bp, Chlorella protothecoides
tccaaaacacaccaatccacctcccaggaaggtttcgccccctccccaaaggaaattctcgccgccacctcc

SEQ ID NO: 35192 - DNA, 163 bp, Chlorella protothecoides
gcgaaggccgtggcctggggtgagcgtgtgagttttgtgtgtgagaggtggaggacctggagcccgctggggtggatgcctcggggaggaggagggacacgccacatggggtgaggaggtatccagccccgtgggggggcctggtgcgccggatgacacgcgc

SEQ ID NO: 35193 - DNA, 121 bp, Chlorella protothecoides
tcccgtgggcccatcgcatggatcaggctgatgggtcggatgccctggtacctggcagaggggggtgggtggggaggggaatgagtgggggaaggcgaggaggggaggggccggtgatggg

SEQ ID NO: 35194 - DNA, 61 bp, Chlorella protothecoides
ggaacatttcagcatcccaaaacgcatgaaagaccattaccgcgttgtgtaagtcctcaat

SEQ ID NO: 35195 - DNA, 61 bp, Chlorella protothecoides
ggtggtacgggagtgttggctgctctgttcgcgggagtgactgaggatgtggtgtatacca

SEQ ID NO: 35196 - DNA, 71 bp, Chlorella protothecoides
aaccaatcaccactcactggtgcagcttctggacatcgggtggggcctttgcgtgccacttcgcaatgacc

SEQ ID NO: 35197 - DNA, 98 bp, Chlorella protothecoides
agcagtgggggcctgtagcgcggccttggcaatgtagtccgccaagcacatggcgtctaagaaagcggtgcccatcccctccccgacctctccggcac

SEQ ID NO: 35198 - DNA, 141 bp, Chlorella protothecoides
agcgcatccaggccggagtagggcgaccaatactcggtctccggcgggcacaggggcaggagctgtgggggtcgcaaacaggggggatgaacggccgggtggaggggttggaagggcagtattctggaagagactttatgg

SEQ ID NO: 35199 - DNA, 130 bp, Chlorella protothecoides
aaggcggaccctgcatggtcccgcatctccatgaagtacttggaatcaggtattggatgttatcaggatggcgcaagcgttaccgtgggatgtagccggccacggtgagtgccttgccatgcctgccaat

SEQ ID NO: 35200 - DNA, 8718 bp, Chlorella protothecoides
  modified_base (1440)..(1449): a, c, t, g, unknown or other
  modified_base (1978)..(2095): a, c, t, g, unknown or other
  modified_base (2253)..(2262): a, c, t, g, unknown or other
  modified_base (3280)..(3289): a, c, t, g, unknown or other
  modified_base (3524)..(3533): a, c, t, g, unknown or other
  modified_base (3854)..(3863): a, c, t, g, unknown or other
  modified_base (4527)..(4536): a, c, t, g, unknown or other
  modified_base (7477)..(7486): a, c, t, g, unknown or other
  modified_base (8190)..(8199): a, c, t, g, unknown or other
  modified_base (8283)..(8292): a, c, t, g, unknown or other
  modified_base (8497)..(8506): a, c, t, g, unknown or other
gctcggcttcctggaccacggcgggctggcggggatgggggaagccgcggcgcgcgccgccgccgccgtcatcgcacgcgacgggccggggctggacccttccgacgcggagagcgcggcgcgcgccatccaggccgcgcgcgcgcgtcgggctgcgcagcagctgccggtgtgggtcgcggaggccgagggcgccatgtgacgcggagtgacgcgttgctggggtttacatgaggtgtgcagcatggagcggttgcgccgcagagtgtccctcgaggacgtcctcccaacattgcaggccagccccccaagccgctcctgcgatgaatgccattcaaggctccttgcatgcgcgtgatcatcaagtcttccctgcccctgtagaatttcatgtatgcacacggggatgcagtcttgctggcactgcccatggggaagggaggtacacaggtggtggtggtgaccgagaggtccaggagattcacactgggcaacaggtaggcgtcggcgacagacaggggtattacatgtttgcaatcatggttcattgcgccaaatgtctggcagggagcgacgcaaggggcaaggttccaggggcgcccacgcccttcagaagccagagggcccagcagtgctccccactacgccttgcgcttctcatccgcgaagcccaccacccggcccacgcccttggtcttgccctcccggaacacgaaacgggcccccggggtcaagtattcggggtgctgcaggaagcggaagcgcacggtggctcggtccccagaccgcagccggtccctgtccatgcccacgacctgggccgactggcgcaccgcctcgcagtggatgacggcctttgggagggggcgcaagggtgcagggtgggagggtggatggagcgccaggcaggtttctgctctcgaatgcaccaggggaccagtagtttgctgtcttgcagaggaggatgcggcaaggttggaccctcagcccggacccgccctgaactttccccactcggcgcatcaggtccccctttcttcatgcaccctcgctcacacctggtaccgggtctggatggtggtggagtgcgtgagcacggcgatctcggcctcaaactcccagccggcgctgcagtgcaggccggggtcggccaggatcatgcccctccgcacgccgctgcgcttgaccttcttcagtgccagggaagcggtctggcctgccaccacctgttggtgttggagcatgaggttgggggggcgtcagggggaggtgatgtcgaaagaagagggagctcaggcaacatgcaaatgtgccaggagtgttcaggcgagggggcaacaagttgccagccttccctcgtccattaccaatgcactccaacaatccaccaccctcactgcagccccccaagccccagcgcacatggtcgactgggagccnnnnnnnnnnttgttggagcgcgaggttgggggggcgtcagggggaggcggtgtcgaaagaagagggagctcaggcaccatgcaaatgtgccaggagtgttgaggcgaggggccaacaagttgccagccttccctcgtccatcaccagtgcactccaacagtcccccaccctcactgcagcccccccagccccagcgcacatggtcgactgggagccgtttgaagtggacactcttcacggcgcagggcttgaaggtgccgtcggacacgtcgggcccgagggccagcactgagccgggcacgatgacgccggagcgcacggtcccggacaccactgtcccgacgccgggcaccccaaacacctcgttgatcatgaactgcgccccttccgcacgcttggtggacctgccaggagaggcgggcaggggggcggcgtgggaagactggcggggccggctggatcagatgctgacgccaagacccaagcctccccatccaccccatgcttaccactggtgtctttgtggcaggaggtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgtgtggtcggggagagcgcgggtggccccgatgcaacgggggcctcgtgtagaaagcgagcatgacaccaggcggttgcggggcctggcgggcccactctcaaaaagggatcattattcgtctctcaccatgaagggcttcttgcgtatgctgnnnnnnnnnngagagaggcaggcagggaggcggtgggggaagactggcggggacagctggatcaggttctgactccaagacccaagcctccccatcaaccccatgcccaccactggtgtctttgtggcaggaggtccaggaaggtgcggatgaggtccaggcccgcgccagagacgcaggaggtcacgaagatgggtgccaggttggaagtgtgcaggtgcttggcgcatgtgatgacgtcatccatgctcctgatctggagcggtgtgtggatcggggagagcgcgggtggcccggatgcagcggggcctcgtgcagagggcgagcatgacaccaggcggttgcggggtctggcggacccgctctgaaaaaggggtcaccgttcgtccctcaccatgaagggcttcttgcgtatgctggggtgcttgaggatggtggtgagcgtctccaggctgtgctttgccacatgcgcaggcgcaaggtccaccttggtgtcgaggagggttgcgggggggtgatctttgcagcgcaagcacgtcgaggcgagtgcagccaggcattcacccctgaccattgctgatctgtgttgatgtccctggaagaacattggcaagtttgcagggtgcagttcagcagggctcctcggtgacaccagctgccaccagcgatcccacgggatcacatgactcacttttgtgacgacaaagaaggtggggatctggagggccagcgccacccccaggtgctccttgcacatgccgatgaccccggcgttggcccctatgaccaccgcagcgtagtcgggcaggtgtcctgtcagacccgacgccgtcgtcttgaagtacttggcgtgcccggccaggtccaccagcgtgatgatctgggcgggaaaggggggaactggaaggcagaacttgcgagaggctccagaactgtactggggacgaagcagtcccttgccatctgcctgaatcaggacggctacatacgcaacccagcgcttgcggggcaagctcatcagcccctgnnnnnnnnnnagtcgaagcagtcctgtgccatctgcctgaatcaggacggccacatacgcaaccccgcgcttgcggggcaagctcatcagcccctgggaggtatcgccaccagcaaaaacaatgaagtcgtgccttactggagagtcccgctccgccgagctcaatgaattcggcagcatatcaggcacccgacctcgagcccaccccatagcctactcaccttggcggcgcgagcgacatagtnnnnnnnnnnctcgacagcatatcaagcacccgacctcgagcccaccccatagcttactcaccttggcggcgcgagcgacatagtctgaggccgtggaagggcggtactgggcgtcgttcaggaaagtaccgctcgcgtccaagcatatgctgtgctgccctatggacgatgtgcggcctgcacaatggccatgagggtcccaaatgagtggggtcacaatgccaaggatttacaggcaaggcccaatgcccactccaatcctgacgtgggcccctccatcaaatgcatctccatcaaagatccccttgcccaccggtgctctgctcgtgnnnnnnnnnntgtggggccctccatcaaatgcatctccaacaaaaatccccttgcccaccggtgctctgctcgtggccgtgcgtgaagacgcgggcgcgggcgctgcccctgccgtcgtccagcgcggcgtgcgtcagcacccctaccagtgtgctcttgccgctgtccacgttcccgatcaccgccacgtgcacctccagcacctccccctcccccggccggcagcgcacccagacgtcggtggaggcgcgggagtcgcgcgtggcggggcgggatcgtagcaccctggcctctgcgcccacggcctgcatcgcatcgtgcagcgaggaaagcgcggcgtccatactcgcctggctggggctttcctcccccagggtagtgccgttcagctccaccataccctcgccatgtgtttggatgtgtttctggtgggagggagtgatgcagtaggaagggtggggatcctcaaagagatctccaaagcttccagtgattcaaggtacaaccgcaatataaactgggtctctgcatcccttcccagtcacgtgcctgtacatctcgaagccatgccggcatgtcgggcgtgcctgggtcgtgcactccaagagcctcctgccgtgggagaagtaaggcgtaccaagcataattttcaggtttatatggtggacattcnnnnnnnnnnatcgcgcactccaagagcctcctgccgtgggaggagtaaggcgtaccaagaataattttcaggtttatatggtggacattctccatgcaagaggttgaatgatttcagtgttatcttccaaatccgacttcaagtgtctcacatcgtggagtcctgtggttgacacttctcctgagcgggtggccgggcttgcaccatgcaagaccttgccattacctccagtccccgcttcgtacagtcgtgcggtggccttgtcctgcaggcaacgatgagcacatcatttgacaggggctgcttgacaagtttgccccattgtcggtcttgcatggcatgttctccttcctgactctcgaaagtcccggatgctcgcctgtgggatggaggggctttccatgacgactggttcaaccctcagatcagaggggtactcttcgagccactgcccacattatctgcggtcttgactgagccatgcacggtcgtgatgtcgcacagtctgagtccagaatgaggattttcgtgagagttgtcgggcggactgaactgatcaaacacggaaccctcccacgtggcgctagcgcccggaaccctcatggtgcagccctctccctcctctgcatgcatggacacaccaacatgtgcaaatatatcagaagctatcttaggaactctaataccattgttactccctcgccgtgacacattgctcgggtgtcgcgccctcacccaaggatggctgccgagctcgccaacgagcgcggcgacgctcgccaggcggcagcggtgaaggccttcgaggccctagggatatgcacgcagctggctgagtctgcagcgggactggggtggaaggagccgtccgaaatccagacccaggctgtcccactcgtcctgaaaggtgcactgggtgaagcggcatggcatcaggctcagatggcatgagcagctagagcgccttgccttgtatcatggacttgaactcataaagatatcgccgtgcaggccaggacgtcatcggactggcgcagaccgggtctgggaagacaggggcctttgccctgcccatcctccaggtacttctgcagtgtgcttagagtgggaggtataggatggtatcaatgcagcccattgtgtggggacactgctgctggtgggctgacctgctggaggaccagggtatcctccatcctcaatgtgcatcctcaaacttccccctctcatgactccaattacacagcaattgctggacacgccgcagcccttctttgcgctggtcctgtcccccacccgcgagctggccatccagatctccgagcagtttgaggccctgggcgccggcatcggggtgcgggctgcggtgctggttggcggcatcgacatgatggcgcaggccatcgccctcgcccggcgcccgcatgtggtggtgggcacgcctgggcgggtggttgaccacctgacaaacaccaagggcttctccctgcgggcgctgaagcacctggtgctggacgaagccgaccgcctgctcaacatggactttgagcaggagatcgacaccatcctgaaggccatcccgcgggtgggtgtcggtgtgtcttatagtatgctttctggggggaaggattcagagctcaaggaggtgaggcatggggttcgcaggcagagcctggcaacagagctgattggttcaagctcttctcggctcctttgctctcgacattattcatgtgcactggttcccggcacggggactcagcaaggagaaacctagcgctcgcaccgccctcttcctctcacacacacacacacgccacacaggagcgacgcacgcagcttttctccgccacgatgaccagcaaggtggcaaagctgcagcgcgcctgcctgcgcaaccccgtcaaggtggaggtggcggccaagaacaccacggtcgccaccctacgccaggaatacatgtttgtgccggccaagtataaggactgctacctcgtcttcctcctcacaggtgcgggaatggcggtttacacttgtggttggggagggggggtgctgcatgcttcagatggctcgaaggagtgggagagggtgggactggagggtgcatcttcacgtccgggatgtcgatgctagcaggtggagcatgcgcaggaggaaatccctatgcagtccccatggccccccccagactgccccttcccccaagcgtagcctgccgaccccctgcccctccaattcccccccacccccgccaaccgacaccccaacacagagcttgccggtgcgagcaccatcatcttcacgcggacctgcgacaccacgcggcgcatcgcgctgatgctgcgcaacctgggcttcggcggcgtgcccatccacggccagatgagccagcccaagcgcctggcggccatgaacaagttcaaggtgtggggaggggtggtgggggtgctgagtttgaggggtgacctgacggcgctgctgcgtcatgcactgcccatgcccctgggcttgccgagatcccccgacccgccatggaccgacaggccggggagcggagcatcctggtggccacggacgtggcatcccgcggcctggacatcccctccgtcgactttgtgctcaactacgacgtccccgtcaacggtaaggactacgtgcaccgtgtggggcgcaccgcccgtgcaggtcgctccgggcgcgccgtcaccctggtcacgcagtgagtgctggtggaagagtggggaggtgctagggggccgaggggggaagggaagcggggcggggttgcctgtgcaggcctgccccccggtcttcctgggaggccccttgcatcaggatcttctttccccctgtgcggcccctgcacatgcccttcgctcggccccttggttccctcatgcttggacactcatgcatgcacccatgcccggccgcccgcacccccccnnnnnnnnnntccggtattcctgagaggtcccttgcatcaggatcttctttcccccgtgcggcccctgcacatgcccttcggtcggccccttggttccctcatgcttgaacactcatgcatgcacccatgcccggccgctcggcaaccccctctccccccacccccaccccccaggtacgacgtggagctgtaccagaagatcgaggcgctgatcgacatgaagctggaggcctaccccgcggagcaggaggcggtgctggtgctgctggagcgtgtgagcgaggcccagcgcatcgccaccatgcagatgaaggagaccgactcgcgcaagcgcggccgcaagtcggcggtggacgacgacgagcgcgacgctgagggcgtggcgcgtggcggcaagccccctccccgcaagcgctgagggggtgggtcgtgtttggtgatggtgcactggagtgggtgtgaggctgggcaggtccctggtaccaatggcgtgcgggccagacagcccccgccgcactgggtggtgacgaaagactaccccgatcggcactgagttctgtgacgacagacgcgagtgtcaggggcgctgcggcgcagggcaggggagcgtgcatcgggaggggcgtccggggatgggagcggctcccgggcggcgcatgtccagacaactggagaggtggggcaattcgggcaaaacatggttcggggggggnnnnnnnnnncccccgatcggcaatgagttctgtgaccacagacgtgagtgtcaggggcgcttcggcgcagggcaggggagcgtgcatcgggannnnnnnnnnggggtgtcagcgtcgtgagtggccggggtgaccgaagagggctcgggctggcgctgcgcctcaagccctccccgcttccgtacaccccgcaaacaaacagatgaacgaggaaatcagggcactctctcagcctggagcagcaggggccgcatcctccccgcctgcacgtcccccagcccccgcgccgagcgccgcaccaggtccnnnnnnnnnngaccccgcgaacaaaacagatgagcgaggaagtcagggcgctcgctccgcctggagcagcaggggccgcagcatccccgcctgcacgtcccctagcccccgcgccgagcgccgcaccaggtccagcgccgccgccgccgcggcctcgtcccggaacgccagcgtccagtggcccgcggccagcgcggcgcggaggtccgccggcgcgggcgc

SEQ ID NO: 35201 - DNA, 67 bp, Chlorella protothecoides
ggagcaggatgtaacattggcatgttcatccaccgcggtgaacatcttggtccgcccagggtcgatg

SEQ ID NO: 35202 - DNA, 110 bp, Chlorella protothecoides
cgcgcgcactgcgcaggcgggagggatcggccggcgggccggcgggccgaggcgcaagagggtcgctccagggcagggcggcgctcaggtctgccatgcacctgcgccaa

SEQ ID NO: 35203 - DNA, 67 bp, Chlorella protothecoides
ccgcgccagagggcccgagggaggaggggggggatgacgggggaggggagcggggcgccgccagcgg

SEQ ID NO: 35204 - DNA, 108 bp, Chlorella protothecoides
tgagattgcactgaagtacgggtgcacccgcaacttctgcccagcccgaagccttgcctccacatgcagactggtaccaaggaggatgtggaaaagtactccaagcgc

SEQ ID NO: 35205 - DNA, 62 bp, Chlorella protothecoides
gcgttccaggccccctgcagcctctctgcaaaacggcttgttgtttctctcgacatcgccgg

SEQ ID NO: 35206 - DNA, 126 bp, Chlorella protothecoides
cccgggcctcttcgtgtcctggttcacccccgtctgacacacctaaagtgtcgctaagggcggagtccctccccgggcatgcacggcgcggcattggctcgtttaccgtacgcagaggcttggagg

SEQ ID NO: 35207 - DNA, 78 bp, Chlorella protothecoides
gaagagacagctgatccaacacacatgaccttttcttgcaaaccaaactatgcgctcatagacctgcgcgttctggtc

SEQ ID NO: 35208 - DNA, 93 bp, Chlorella protothecoides
cagaagtgatctgagtgacgacgtggcagacctccgtttccgcatggcgtatcgctccatgcctgtaggccaaacgatacacggacactgaca

SEQ ID NO: 35209 - DNA, 64 bp, Chlorella protothecoides
tcgattgatgtcgagcccttggcaggatatgtataaagaggcggccacagaagatccaattgtc

SEQ ID NO: 35210 - DNA, 153 bp, Chlorella protothecoides
ggaggggtggagcgtgagggggaggggggggggttgcaggggaggaggcggtgtgatgtggggtcacttgcctgggcgctggtccgatgaggggctgggacgggtgcctggaccaggggcctcggcacgcagaccactctcgtcgaccgcgat

SEQ ID NO: 35211 - DNA, 94 bp, Chlorella protothecoides
cgacacatgacttccctggacatggtttcgggggcatgccaggcgcacagggaaggatttcactctgccgggcacggggcagggcgcaaatcca

SEQ ID NO: 35212 - DNA, 61 bp, Chlorella protothecoides
cgcctagtcgcaggatgtgggcgaggggggtctcgccacatgctgtgaagcagggctgaag

SEQ ID NO: 35213 - DNA, 128 bp, Chlorella protothecoides
ggggaggggtgagagttgtcgcacggctgctgctgcctgcggttccccatcaccccccaccccacctgaaccaacagaatccaaccagaagggtcgtcccctttgccaccgacccacctccacacaac

SEQ ID NO: 35214 - DNA, 61 bp, Chlorella protothecoides
tttctatccctgcagccaccggcatgacaacctcgtgctgcattgccttgtctgtgtactc

SEQ ID NO: 35215 - DNA, 67 bp, Chlorella protothecoides
acctgacaggtgggtttgaagaagggagggaatgggtcggccgtgctcgctcaccccatgctggcct

SEQ ID NO: 35216 - DNA, 62 bp, Chlorella protothecoides
cacgcgccgggtgcatgccaccagccccccagcgcacctgcaggcacgctgtgcgcgcttcg

SEQ ID NO: 35217 - DNA, 61 bp, Chlorella protothecoides
ctgctggcatccattcaaaaagtgcgtcacacctgccatacagcggtatacctcaaaatgc

SEQ ID NO: 35218 - DNA, 125 bp, Chlorella protothecoides
gcgtcagggcacagcatgggatactggctttcagccctcgacgggatggctcgcaatctcggcagcagcttcctaccactgcagcaggggacggaagcatctgtccagatcctggaggtggcccc

SEQ ID NO: 35219 - DNA, 70 bp, Chlorella protothecoides
ggcccagcatgctgtggtcagaccccggcaagcctgcgtccacgctggcgcggtgagcccggagcagggc

SEQ ID NO: 35220 - DNA, 61 bp, Chlorella protothecoides
gcacctcagatccctgccgtagagcctgccaccgccgccaaagccccctcgtcgggcgggg

SEQ ID NO: 35221 - DNA, 61 bp, Chlorella protothecoides
gcgggggtccacagacgtgaaggtctctccaccagcagcatccacgaacttgccgccgatc

SEQ ID NO: 35222 - DNA, 115 bp, Chlorella protothecoides
tgaaggaatccatcattgcattcacttgtttgttgtaatattgaaccggtgctgttcaatacatcataccagtgtccagtcacctttgcttgtgctgaattcgagtctgcatgtg

SEQ ID NO: 35223 - DNA, 104 bp, Chlorella protothecoides
caacatgtgaaggcagatgcactgggagagagacatccgcagcatccattgagtattgttttcgattcttgaactgagcaatcataaagataaatgtcgcaact

SEQ ID NO: 35224 - DNA, 181 bp, Chlorella protothecoides
ccagggcgaggcagggtggaggtcgtcgtcgccacgggtctgatgccgtggctggggtgtgacgaccgaactgggttcgcccttttggacgggcggggcctggagagtgaggctgggtgcatcacttaccccccctcccccctctcaacaccccgacaggtggtttctccgtgtttgcggg

SEQ ID NO: 35225 - DNA, 64 bp, Chlorella protothecoides
ctcgtgcccgagaggctgtagaggcgggggtggtggggcacactctgttgctccagaaggacct

SEQ ID NO: 35226 - DNA, 61 bp, Chlorella protothecoides
ctcctgcttgtgctgtgctgcaacctgtgccagctcagcgcgatgtgcccggtgcagctca

SEQ ID NO: 35227 - DNA, 443 bp, Chlorella protothecoides
  modified_base (160)..(313): a, c, t, g, unknown or other
cggccgcggcgagcacgcgcgggccgggtgcgtgcgtctcgcgcagcgcacacagcgcgtccagcgcgccatccaggccccggctggacgctgcgccgtactcgcccgcgacccacaccgccgccgccaagagctgcggcggggcggtgactggggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgagcagctcgtccacggcctcccccagctcctcctcgccctccgcgcccatctcggccaccaccgccgccagcgcgtcgcccgcgccgggcggcgcgtcggcgcccgcggcctccagcgtctgcgc

SEQ ID NO: 35228 - DNA, 69 bp, Chlorella protothecoides
cctcacgacggggcgagcggccatggtgcacaccgactaccagtcccaagtctgcccccgtccaaagcc

SEQ ID NO: 35229 - DNA, 9263 bp, Chlorella protothecoides
  modified_base (319)..(328): a, c, t, g, unknown or other
  modified_base (1009)..(1055): a, c, t, g, unknown or other
  modified_base (1862)..(1871): a, c, t, g, unknown or other
  modified_base (2371)..(2472): a, c, t, g, unknown or other
  modified_base (2540)..(2549): a, c, t, g, unknown or other
  modified_base (2708)..(2798): a, c, t, g, unknown or other
  modified_base (2949)..(2958): a, c, t, g, unknown or other
  modified_base (3026)..(3035): a, c, t, g, unknown or other
  modified_base (3399)..(3408): a, c, t, g, unknown or other
  modified_base (4206)..(4215): a, c, t, g, unknown or other
  modified_base (4901)..(4910): a, c, t, g, unknown or other
  modified_base (5373)..(5382): a, c, t, g, unknown or other
  modified_base (5773)..(5782): a, c, t, g, unknown or other
  modified_base (5965)..(5974): a, c, t, g, unknown or other
  modified_base (7248)..(7257): a, c, t, g, unknown or other
  modified_base (7782)..(7791): a, c, t, g, unknown or other
  modified_base (7959)..(7968): a, c, t, g, unknown or other
  modified_base (8054)..(8063): a, c, t, g, unknown or other
  modified_base (8368)..(8621): a, c, t, g, unknown or other
  modified_base (8698)..(8707): a, c, t, g, unknown or other
agcacggcgtccggcgcgccggcgtcgccggccgggcccagcaggcccagcaggcgcagcgcgtggaccagggacgcgcgtagcgccagcagcgcggcctgcctccccgccgcgcccttgccgcgctttccggccagctcgttgagctcgcgcaggggcgggcccagcgccgccagcgcggccggggtgttgaggtcgtcggccaacgccgcgcgcacggcggagagcagggcgcagggctcgccagggagaggccgaccgtcgctcaggtcgacctccgggtcgtgcgcgcgcgcggcggcctcggcgtcggccaggnnnnnnnnnnacggagagcagggcgcagggctcgccagggggaggtcgaccgtcgtccatgtcgacctccgggtcgtgtgcgcgcgcggcggcctcggcgtcggccagggtctggaaaacgtagtacacgcggtcggcggcctggtccagagcggtgggcgtgaagttgagcggagcgcggtagtgtgtgctcagcaggaaccagcgcagggccgcggccggcgtggcgcccaggatgtcacggatggtgaagaagttgcccagcgacttgctcatcttctcgctgtccacatttacaaagcctgggtgggagagggaaggagtcacatgggtgtgcggaggggatgcatacaggggagggggaggggcgctgggagtggatgggaggggtctgcgctgccggtatccagtagtgccacggctgatgcgtcaggtcatcatgcaatcccagaccaatcccactccacaaccgcaccgttgtgcatccagtaccgcgccagctcgcgcccgtcgccagacgaacccgtctcgcagccgcagccgccggagtgccgcgtggcagccatggtctgcgcccgctcgttctcgtggtgcgggaagatgagatccctggagtgagtcgtgtgtggggatgggtgtgtggctagaaagggcggcagtctgggcccggggggggggggggggggggccnnnnnnnnnnnnnnnnnnnnnnnnnnnnnnnnnnnnnnnnnnnnnnngctgggtgtcttcccacatgccgtccccaaaattgccaaaggtgcccccagggtgtctgcaatcatgcaggtaatgctgggattggatggcctggattccttcaatacttcctcccaaacgacgcagcgcacctgccgccgccgtggatgtcgatgccctcctccccaaagtgactcgctatcatggcgctgcactcaatgtgccagccgggacggccctggccccagggcgagtcccaggccggctcgcctggcttggcagccttccagagcacaaaatccgcgggaccgcgcttgcggccatccacgtccacccgctcccccgcccggttgtcctccttcagaatgaggttgatggcaggtttagtgactgccctgattgcatgctgcccattcccaccagctctcagatgcaccacacccatgttgctcctcccgtgtggtctgtgctcctcaactaagcattccaggcagcctgtggctcactaagtgggcggtgtacagacgctcagtgtcctacctgcttcctcccagacagcgcgccatactggggcagagtcgccacctcaaagtacacatccccatccacgcagtaggcgtgctcatttctgcagtgcggcattgccaagaaagattgacaaggcgcagagccacggctgaaagtaatggcatgctgcacatcccaaccttttcatcagggcccggcatcatcatgtgcaatcaattctatgttctgcatgttttcaagggacatgagcacccagcaatgctccgagaacagactgtatatgccaagattcagattcnnnnnnnnnnatgctcatttctgcagtgcggcattgctaagaaagattgccaaggcgcagagccacggctaaaaatactggcttgctgcacatcccaacctcttcatcagggcccggcatcatcatgtgcaatcaattatatattctgcatgttttcaagtgacatatgcacccagcaatgctccgaaaacagactgtatatgccaagattcagattcaggcctacctgaggatggactgaatcatggagatgatggctggaatgttatccgtgactcgtggctctagcacagggtgcaaacagttcagtgcctcctgcagtttgcatggcccgggcaaaatgtcagaagcaatttctgtacagagtaagggcaggctgaagggcctgcatggctgaatctctggaacacagcatcgtcgccgcaccttgatcagcaaccaaaaccgtgatagccaagttgcaagagtgggatgtcagcatcccctctgaacatccagttcctcgtcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccagcaccactcaccatgtctgtgtggaactcatcaatgaagcgctgcgtcaggctctgccagtgnnnnnnnnnncggaacacagcatcgttgccgcaccttgatcagcaatcaaaaccgtgacagccaagttgcaagagtgggatgtcagaatcccctctgaacatccagttcctcgtcttcctccagtactgcccatcccagtcaactagccaccgtacacacccttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgcctgcctcccttgccctcttgatgatcttgtcatcgatgtctgccgagttgaggaggagtggtggtctctgtgagcacaagcagctcgcagacttccacagggaccgacctgggtatggcaacaccagctcacagggccgtctccannnnnnnnnntaccagcaccactcaccatgtctgtgtggaattcatgaatgaagcgctgcgtcaggctctgccagtgnnnnnnnnnngtctatgagcacaagcagcttgcagacttccacagggaccgacctgggtctggcaacaccagctcacagggccgtctccagggcacaggaatgtgcccctgaactcagcaacatcatgcctcacctgtgaagttacgcacatatcgcactgggtaccccttatccagcaggaatctgtagaggatgtcaaacgccacatacaccctagcatgccctggtcacatgggaaggtataagccatggtgggtgggagggtgatggagcttggtgtggagcttggtctgggatccagaaagggctagggtgtagccccaaggctgtgctcatggcctggacctcggcatgccaaactcctgttggaatnnnnnnnnnngtaagacatggtgggtgggaggggtgatggagctgggtgtggagcttggtttgggatcctgaaagggctagggtgtagccccgaggctgtggtcatggccttgacctcggcatgccaaactcctgttggaatggcgcacatcagccagcatcccagcccgccctcagtgccgcagatgacatgctgcgtgaccggatccatctcatcaaacccacctatgtgactgaagtcatacacagtgacgccgcagacatacatgtcgacccctggctgggttcggtctggatccctgacggtgaagagccgcttctggcgagtagcagtgtcgtagaggtacaggtctggacccgtgatgtctgacccatcatgggaactgtttctcctgtaggaggccaggccttggctccccatgcgtgagcatgctcgcctctgaccagctaggcctgttgcctgcagggtggcggggcttgcagcacgatcatcttcaaccaagctacgcgagtgggatgatatataagcagaatgttcttggctgcgctcatgtgtagtagcactcacccattgctggtgtgggctgcctcccaggaggaccgacatcatccgggttggtgcatggacgggcagcatcggtgcatgtgttatcgcactcagggagcggactaatgagggtatgcagagccttgtcgacattctgatatacattgttagttcacatatcgctcaaagagcgttgaggtgcatgcataagtatcgcacaccccatgcgagttgcagagaacgagtgccagacagaaagannnnnnnnnncatcgcactcagggagcggactattgggggcatgtagagccttgtcaacattctgatatacattgttatttcacatatcgctcaaagagcgttgaggtgtgtgcataagtatcgcacaccccatgcgggttgcagagaacgagtgccagacagaaagagcttaaccgggttctggctcgctggttggtaattaacccgagtatgattctgtatggtctcagtctccccagtcttactgtgcgcggcttctcttgagcgctggtggggtctcggatcagatgcacaacccgcagcataaagcgcgcgcgcgagttgtgtctgattctggatcctatattcacgccctcttggtaatggtcgctgagattcagaatatgtttgtgacccatactgcaatggaattctgtagtggaaggttctgaaacaccaggtctcccggtctgagacaggaccgtgactgcgccatggcagcgcgcgggggggaggtcgactgggagaggtgcgtgtctgccggtcggtcctgcgtcaagtgttgtgcgctgccaggggatccgttttctatgtatgcaagcacggatagcaggaaggtggccagactcgcgctgcccagctgtggacaggttgcttcaaccctgtccttccctgccacaggcttgacaagcgaaagttcttcgtgtatggagggnnnnnnnnnnaaacaggttgcttcaaccctgtccttcccctgccacaggctcgacaagcgaaagttcttcgtgtatggagggggcctgttctcggtgggctaagaatctgggatctcaaaggacgactgtttcgaactcagcattttgtgtgattgcttgccgccgtgcctcacatattttccgcactctggaacccattgttcctgccacccatgtgcaggccctgaccacatgtctgtacccgctctcggccataaagaccaggcagatggccctggatggcgccccggcaggcctcaaggtagacgctggggtgtagaactggcgtgcacacgggtggttgcgactccttcttgatgcgagaatgaggatgtgtcgcatgtgtcatcaggttcccaggcctgttaggtgttggctccctcacacctcagaaccctacgtccactccagggtgccgtctggactggcagannnnnnnnnntccaggcctgtcaggcgttggctccttcacacctcagaacccttcgtcccgggccccactccagggtgccgtctggactggcagaacggtggtggctactgaaggcatccgcggcctgtatgccgggtttgggacggtcatcttcggcatgatccccgcccgcatggtgaggcggaagggagggtggtgggaaggtggggccctcggctgccttgtcccggtttgggggggtaagcttgcgtttggacttgcaccctcaagccaattctcactgctggccaacgttgggggctgcggccatgggccaatctgtcgcttcatgaccctcccccctcctcgccgtgggcaccccaacccgttgctgtaccccttcaaccccccccccccctannnnnnnnnnggtttgggggggtgagcttgcgttcggacttgcaccctcaagccaatcctcactgctggccaacgttgggggctgcggcactgggccaacctgtcatttcatgaccctcccccacctcgccgtgggcaccccaacccattgctgtaccccctcacccccccccccccccccctcccccccctnnnnnnnnnnacacactccagctgtacatggcctccctggagctggccaagtccgggatcaccaccgcactgcgcccgctgggcttgcccgacgccagcgtggccggcgccgccagcttcgtgggcggcggcctggcctccttctcctcccacgccgtcatggtgccgctggacgtcgtctcccagcgccagatgatccgcacggggcagctgcgcggcggcggcgcctccgccacgccggcggtggggcccgggggcgccgccatggcgcggcacatcctggctacggagggcgtgcggggcctgtatcgcggcctgggcgccagcatcgccacctacgtcccctcctccgccatctggtggtcctcctacggcgtctggcagacactgctgtgggaccgcctggatgcgcttgtcggcgaaggcggcgcaggcgcggagcggactcagggccgcaccgtggctgtccaggtgagaggtgttcttcctttctgttggggtggtgatcgcgccaacgtgatcccatgtgatctgagtggcgtgccgggcgcagcgctgtcgcggtgcagaccacgaattctgacccctttctcacccacgcactgaatactctccccctgacaacacattcccacgcacaaatgcaggctgcggcggggctggccacagggtgcacctcggcggtgctgaccaacccgctggacgtggtgaagacgcggatccagacgcggcagcgcgaggcggggggcgctgggctgagctgggccgggacggcgcgggacctggcggagcgcgagggctgggcggggttctaccggggcctggcgccgcgcatggtcagcacctgcgcctggggcaccgccatggtcaccacctacgagttcctgaaacgaatatgcgccctgcccccggaaagctgaggcaaccgacctcaatgctggtgggcctggctgggccgccaggagagttggcctccgcctgccccaagctggactccttggcacccgcgatgcgcttgcttcttttgccctgtgtcgttgcaaggctgtagaatttcccagttggtgtgcattgtggaaccgtgctgatgtggttcgtcgtgacattgaatgtcgcacgccattattccccgagagctgacgtcaccaccctacagaatgaaggcgacagtccccacccccttaccacgtcctggtccctacatgtgctgcgatcgtacaatcaagagcccaatttcggggttaatgtcgattccaccatgctgactcgggtcaggccactggnnnnnnnnnngcgtcgtgacatagaatgttgcacaccaccagtccgagagctgacgtcaccatcctacagaatgaaggcgacagtccccacccccttaccacatcctggtcccttcatgtgctgcgatcgtacaatcaacagcccaatttcggggttgatgccgatcccaccatgctgactcgggtcaggccactgggcgcgggcctggcgctgtgccagcgctggacaccggcggtggtggaacgattgctgagcggggcggcagcctctgcctcggatcatgaggacgtgcccgaacgcttcaactcccgcacgagtgagtgctcgcgatgggcgatcgggtcagcggctgggctgggctgcagtagggtcgggccgtcttgctggtggtgggtcgacggggactgtgtaccttgccctgcccttgcgataccttcccaacaagctccagaccaccatctcacatcctcgacatcgtcggaccgcagagcgggacaacaggctgcgatactttgtcgtcagcaaccagccctnnnnnnnnnnggggtcgggccgtcctgctggtggtgggtcgacgatgactgcgtaccttgccctgcccttgcgatacctccccaacaagctccagaccaccatctcacatcctcgacatcctcgcatcgcagagcgggacaacaggttgcgatactttgtcgtcagcaaccagccctnnnnnnnnnngcccacggcatcctcacacctcccctcccacccgcctttccgcccacaggaggcgcagctgacagggcgggccgctgagctggcgnnnnnnnnnncctccgccctgcgcctgctggagcaaaccgtgttccgggtgcccatggtggacacgagcgggagggagaagttcctcaagctcccccccgcctcggtgtgcaacaaggtgctcgactctgccgcccaggttcgcggctgcgagggcttgtggggagtactgggtgtggggtggaaggtgcaggtctgcgactcggagacagagtcctcgacactgatgtcgtgtgctctgcaggccagcgctggcaaaacatgcgtagcatactagagtccatgacatgcacctccacctccctccgccccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtccgcagggagccgccgcgcccgtcgacgacgagcgcggcgatgggggttccgcgccccttgcggccccctccnnnnnnnnnntcccacggcatcctcccgcctcccctccctcccgcccttccgcccacaggaggcacagctgacagggcgggccgctgagctggcggacgcgctgctgctgcagggcatccccctggaagccaagaccctgcgctcgctggtgatgggcctggcggggacgggccgcctggaggacgccctccccttcctcgaccgctggctggcggccgaggaggcggagcggggcagggccgggccgcagggagccgccgcgcccgacgacgacgagcgcggcgacgggggttccgcgccccttgcggccccctccccgcgccacgtccaccgcacgctgagctggctgctggagatcgcggcgcggcgcgggtccaccgccggcattgtggccgtgctgtcccgtgcggcgcgcgtgcaggtggtgcccagcgtgcagagcgtgacggaggtgctggccgcctgcgggcgcgcgcgcgagggcgccaaggcccgcgccatcctgggctggatgcggcgccacggcctggcggccggccccgcgcagcacgcggcggcgctggcc

SEQ ID NO: 35230 - DNA, 126 bp, Chlorella protothecoides
ggggtggcagagggggggggtggggaatggtagggtggatggtccatgcccagacccagagcagggagggcagggcagggagtgcagggcaagagcgcactgctggaagaagaagggaatcctccg

SEQ ID NO: 35231 - DNA, 84 bp, Chlorella protothecoides
ggatgtcgaacgatccgactcgacttatgctcttgtccactgacgatgagtcactgcggccctggcacctgggctcggtgtgct

SEQ ID NO: 35232 - DNA, 73 bp, Chlorella protothecoides
aaaccgtggaggggcatgccttcttgcgccagaggctcacgccagacgcaacagcgctggcgcggcactacct

SEQ ID NO: 35233 - DNA, 79 bp, Chlorella protothecoides
ggcggcggcgtacatgagcttgtccacgtaccgcgaggaccagtacacataggtggcggaggagtatgccgcgttgtac

SEQ ID NO: 35234 - DNA, 127 bp, Chlorella protothecoides
ctcacaaaccattcacagagcatgtctgctgttgggctctgggtatcccctacaggccgtgcacaaatatccgttgcatgcaagcctcatcgcttccaggcaccttgtggcaggcacacggcctcaa

SEQ ID NO: 35235 - DNA, 7959 bp, Chlorella protothecoides
  modified_base (1599)..(1608): a, c, t, g, unknown or other
  modified_base (1774)..(1783): a, c, t, g, unknown or other
  modified_base (3017)..(3026): a, c, t, g, unknown or other
  modified_base (4190)..(4199): a, c, t, g, unknown or other
  modified_base (4434)..(4443): a, c, t, g, unknown or other
  modified_base (5159)..(5215): a, c, t, g, unknown or other
  modified_base (5495)..(5504): a, c, t, g, unknown or other
  modified_base (6218)..(6227): a, c, t, g, unknown or other
  modified_base (6707)..(6716): a, c, t, g, unknown or other
  modified_base (6792)..(6801): a, c, t, g, unknown or other
  modified_base (6923)..(6932): a, c, t, g, unknown or other
  modified_base (7340)..(7349): a, c, t, g, unknown or other
ggggggagggggtagaggtggggggagggcaatgctcaccaacagatccacagaggcacccacccactccacaaatgatccatccactcacccgctcggtgtgcatgagcttgtccatgccccggggacccaaggtggtgcgcaccacgtccgccaccgctacgcacgccccgatattgctgatcagctgcgccttgccctgactcgtgtccgtgccctccttgagcaggatgatttgcggttgctgtggagtaggggagggggtgggtgtcatgggcaggctgcggcgggtcctgatcgccgggtggtgcgggccagggatcgcgggccggcacgcatggcgccgatgtgggtatgatgtagtctgcacagacaatgccgtgtgcaaggggtaccaatgtccacccctgtgtacgccaccctcaccatcccgaaggggagcgccatcgcggtgctagtgctggtccacgcagcgcccgccctgattggagatcacgaagggtagacaaggagggtgttgagtgcagctcctggttgcatctgtgctggcctgcctgcgcgctgcgcgtcttgatcgggacccctcctcacggcgagattgaaacgtcgctctccccgcgggaaggggggcctccgcatggctccacacgcgcatcgcccctggggctggcaggcccctccccttcactctaccccattcactaccgatcgcttcacgactttgtaacaggcatgaagagaagaaacgctgggccgggccgctcggcggcccggccgggggtggggccggtgcctgggtggcttgtggagggtggggggggggaggggtccccatgtgggccccgcccatccccgctccacacacacacaccgccgcacacgcgctcacttgcccgcgatctcggcggccatgcggtccgccttgtcccgcacctcgctgatgtcgcccaccatgtagaaggccatctccggcaggtcgtcgtgcttgccgtccagcacgccctggaagccggagatggtgtccttcaggtccacgtacttgcccggcgtccccgtgaacacctcggccacggcaaagggctgggacaggaagcgctggatcttgcgcgcgcgggccaccaccatcttgtcctcctccgacagctcgtccatgcccaggatggcgatgatgtcctgcaggttcttgtagtcctgcagcaccttctgcacgccgcgcgccacggcgtagtgctcgtcgcccagcacgcgcgggttgagcatgcgcgaggtcgagtccagcgggtccaccgcggggtagatgcccagctccgcgatggagcgcgacagcactgtggtcgcgtccaggtgtgcaaaggtggtggccggggcggggtcggtcaggtcgtcggcgggcacatagatcgcctggacggaggtgatggagcccttggtggtggtggtgatgcgctcctgcagctggcccaggtcggtggccagcgtgggctggtaccccacggcggaggggatgcggcccagcagggcagacacctccgagttggcctgcgaggggggggaaagcgcgatgggtttgggaggttctgttgatggcggacttgaaannnnnnnnnngaaaggggggggggggcgcgcgatgggtatgggaggttctgttgatggcggacttgaaacttacagggagacaatgagcaccacggtgcaatgaacacacaccggcgccaccggatcgggagtgcccccccccccaaccaccgcccaggtatgcacccactgccannnnnnnnnngatgaacacacaccggcgccaccgggatcgggagtgcccccccccccccttaaccaccgcccaggtatgcacccactgccattcctcgtgcacctgagtgaagcggaagatgttgtccacgaacagcagcacgtcctggccctcctcatcgcggaagtactcggccacggtcaagccggtcagcgccacgcgcgcgcgcgcgcccgggggctcgttcatctgcccgtacaccagggtcaccttggactcggcctgggcggcgccggtcttgatgacgccggactggatcatctcgtggtacaggtcgttgccctcgcgggtgcgctcgcccacgcccgcaaacacggagaaaccacctgtcgggtgttgagagggggaagggggggtgagtgatgcacccagccccactctccaggccccgcccatccaaaagggcgaccccagttcggtcgttacaccccagccacggcatcagaaccgtggtgacgacgacctccaccctgcctcgccctggcatcgcacggaccgacgacatcagagccccaggagaacagcggaatcccacgcccccctcccccttgacaagcccaccgtgagccttggcgacgttgttgatcagctccatgatgagcacggtcttgcccacgccggcgccgccgaacaggccgatcttgcctcccttctggtagggggccagcaggtccaccaccttgatgccggtggtgagcatctgctgctccgtggcctgctccacgaactcaggggcctcgcggtggatgggccagaggacgttggagtcgatgggcccctgctcgtccacgggctcgccgatgacgttcaggatgcggcccagcgtgccacggcccacgggcacgctgatgggctggcccgtggccaccacgcgctgcccacgcaccagcccgtcggtggtctccattgcgatggtgcgcacggtgtggtcgcccacgtgctgcgcgacctccagcaccagcctgacgtcgtggtcctggacctccagggaggacaggatggggggcagcttgccctcgaagtggacgtccaccacggcgccgatcacctgggaggccgggggaaggggggtcgggggtggggggctggaggcagcgccacatgcccgggcggggccgaggatggggtccggcaggacgggatggcccgttggacacggctgggtgtcccgggcccggggcctgcgggggcccaaacccggccnnnnnnnnnnttggggaaagggggatcgggggtggggggctggagacagcgccacatgcccgggcggggccgagggtgggtccaggcaggacgggatggcccgttggaaacggctgggtgtccgggacccggggcctgcgggggcccaaacccggccggaccccgcgtgcaccgggtcccaggggtcatgctggatcggatgggacctgccagaggcccggccgaggcgaaaaagggagcgaacccaagcggtcgggagacctgcgcacctgggtgacggagccatcggtctcgggggcggcctcgggggcggcctcggcggcatacagagcacgctgcgccaccacacggctgcaggcgagggcgggggaggtgccctgtgcggagcgtgcgagcccagagagggaacccgcggccctcaggagtgccatcgcgcggctgcgctctatcacggccttgagggaagaaatctggagggatagaggggtggtagaggggacgcagggaagcaggggttggcactcaaatggagcccccaggcgtgggggcaccagggcgtttgtgcaaaaagaaagtggggaagtgactaatttctccacatgtccatggccaactcccctcaaacagcgagatcgactcagtgctgccctcgcaagtcataaggaaatacatgacatttctgcagcaagctgtgagagagatcgcggagtcttgctcgcgggtcaaccatggctgcccttgaggcgaaagcaacgcttacgctctgatgccccatccgcaacgccgctgtgcacgcttgcatctatcgcgtctgtaagggatgcatgtgttgttttcttcttgttaacttggaccccaccctgatcagcaagctgctgaaactgagcactgacagacggcgcaggtgggacgccactgacttcccagatctcggttgctaaggaccatgcagacccaccaaagcaatgcatggaacgtggtatacagatagaacaccaatgtgatggtcaagagttcttctttcccatgttgtcaggcagatacatggttgggagtgtgacaaggtggttgtgcctcccagaggatgataagatgctgatcaagatcctgaatgcattgaattgctgagaggagataatctctagtgtgatgctaccctgtgcagcttcatcannnnnnnnnnctgtctggcagatacatggttgggagtgcaacaaggtgattgtgcctcccaggggatgataagatgctgctcaggatcctgaatgcattgaattgctgagagaagataatctcgagtgtgatgctaccctgtgcagcttcatcatggtctctcgcctcttgcgcacatgaatctacactcccagagtgacaggccaaacgcacaaagggggtgaccccgacgcgcgcgaacgagnnnnnnnnnnaaaattgtactcccagagagacaggccaaacgcaccaagggggtgaccccgacgcgcgcgaacgagacgagtcaccggtgtcgaaccagttgaggtccgtaaggacagactttcaaccttccataactttaactttgccatatcgtccccgaagcattcttccgattctttaggggaaagcagcgtcccgacgaggggtgacggaccctcgccaactcctcgaacgcgcctttgacgttacggcgccatgccactcatttacagctttgtggctcggcaaacgacggtgttggctgactacacttccttcactggaaatttcagcgttgttgccatccaggtatgcctcagggcgtgggaagactgccggcctcgccaactggatcacgttggcgttgtgtgatcaacttcgcatgtgcgctttttgcaggcactcgagaagggagcacaagggaacaacagcaagtttacatactcctgcgacggacacagtaagccacaggggcgggcctgcatgagctagctgttcttctccagcacagttagaaaccctccatactccctcccttcatcgtgcagccttcaactacctctccgccaatggctatagtgagtgatactccggttccttggtatgcagctttgatacaatgggcttgtgctgacaaaagggcacactccttgagtgttaacactgtgctgacgtcaccactgcnnnnnnnnnnnnnnnnnnnnnnnnnnnnnnnnnnnnnnnnnnnnnnnnnnnnnnnnnacgatgcctttgggcgccagatcccgtttgccttcctagagaaggtgaaagaggaatggttccagaagtgggccgacaagggagcagccgcattcgcccactccctggacaagagcttcgggtgagggggagagcaggatgggacgggggccggtgcaccaatgcgcgcgggggcgctctgcaacgaattagtataaatgatggagtgcagggcttatgcctgcagaaggacggttgacgctctcatctgccacgctcttgctgtgtctattcccaaggnnnnnnnnnntgcgcgggggcgctctgcaacgaattagtatgaatgatggagtgcagggtttatgcctgcagaaggacggttgacgccctcatccgccacgctcttgctgtgtctattcccaaggacctacccaaatgtcgtcgccttcacgctgccccactctgccttgcagcccccgcttgaagtactggatggattactgtgagcaacacccagaggagctgtcaaaggtggcctccgtccagaaaaaggtgagttgcggtgaggagtcttgcacgaagctcgatggcccgagcgccagctctcgcggtgccaggcaggcgtcgatgcatcagccccgcccaatcccctcaggtggacgaggtaaagaacatcatggtggagaacatcgagcgcgtcctggagcgcggcgagaagattgagctgctggtggacaagacagacaacctgcgattccaggcgcgtgggtggctggagaactggaatctgtgcatcgtgttgtggggatctgctcgtccatgacctgcggcagggttaccagatgtacatgatgcaagggacctgccggccgcggatgaggcatgtgggcttggggtgaattttgagcgcaccgctggcactctgtgggtgtgtgcctgatccaggggttatcgcgcccccatcacctcagaatcaccccccccacaaacctgcaggccgacaagtttcacaagacggggcggnnnnnnnnnntgtgtgaattttgagcacaccgctggcactccatgggtgtgttcctgatccagaggttatcgcgcccccatcacctcagaatccccccccacacaccttcaggccgacaagtttcacaagacggggcggcagctgcgcagccgcatgtggtggcagtccttccgcatgaagatgatcatcatcgtcatcatcatcctcgtcgctgtcatcatcttctgcgcggtctgcttctcagggggcaactgcctgaagaagggctgatggatggcggggggctcggccatgcaccttggaccccctccttccaccacacacacgcatgcaaccccctcccctgtgccctctcatcacaccgccctcggccctgcccgctgatcctctgtgaccctgcctgatacacttgtgcccttggtccttgaaaatgccctgtgacaccccctggaccccttcctttttattcaagggttgcgatgcggagtnnnnnnnnnncccttccaccaggcacccccctcccctcccctcccctcccctgacccctctcatcacaccgccctcggccctgccnnnnnnnnnncaagagtgtggtggcagagcagggtgtacgcggatttcaaggagcccctttgccagacactgagatgcggtgtgggccctcactcatgccaggtccagctccctgagcagcggtccagcctnnnnnnnnnngaagagtgtggtggcagagcagtgtgtgcgcggatttcaaggagcccctgtgcctgacactgagacagggtgtgggccctcactcatgactggtccagctccctgagcagcggtccagcctgcccagcgccatcatgtgggctcggccgccttgcccagctgcttgggcagcttcttcgcggcctggtccatgatctccttgcggctgtagtagtgcggcgcgatctccacctgtcgatgtcgagattgtgtggggggtgacttttctcgacgagtggagccccagcataggccgtacgcatctccacccatgcccgaggccaccgggacttcagagcgcatgccagacgcccgcacacgcccccaccagccccacacaccagccattcgggcttgatctccgacacnnnnnnnnnncgtcgagattgtggggggtttgaatgtacccgacgagtggagccccggcaatggccgtacgcatctccacccatgcccgagccagcgggacttcagagcgcgtgccagcgcccccgcacacgcccccaccagccccacccaccagccattcgggcttgatctccgacacgacgcgcatgtactccttggtcgtcagcacgagctcgtggtagaccagccagcgcggcagggcctccgccaggccactggaggggtggatggccacggtctgtgtgcagggggccgggcggaggaggcatggttgcaggggtggaggaacagctgaacgccggaacccactgatcagctgccatgctccgcggcgggttcccaccatacgcacagcactcccgagtacctgagggttcttgacggtgcggtagctaccgttgcgctgcagggaggcggtgtggtagaagaagccggcggtgatggccttgcgcatgccctccaggtcccccacgttgctcaccagctccacctcgcagcgctccatgaggcccaggatttgatcccggatgtccctcgcccgcttcatggaccggacctgtgtgtgtgtgtgtgggggggg

SEQ ID NO: 35236 - DNA, 67 bp, Chlorella protothecoides
gtccgggacgcgctaagtaggatccatgcaacagcatgaaccccagcaagaccagccgagcggccaa

SEQ ID NO: 35237 - DNA, 61 bp, Chlorella protothecoides
caccttccgagacgtggtcttctcggccccgccctccgccagcgccgactaccccggcgag

SEQ ID NO: 35238 - DNA, 138 bp, Chlorella protothecoides
cagtggtcctgacccaggtcggcttggtgggtcgcgggggcagcttgccgcagggattggggggtaggcaggggctgcatgcaggaagggtcttgtgggcaccattcctaccgtatgctgatcctcgcatcatgcccc

SEQ ID NO: 35239 - DNA, 88 bp, Chlorella protothecoides
gcgtattcagccgccctgctcctctccgctggtttctcaatccttccagtcgaggcaacacccctgcaggagggtgtgggtggaggag

SEQ ID NO: 35240 - DNA, 61 bp, Chlorella protothecoides
tcgcagcagggatagatacagggacaggagtagggagcgtcgaagcagcccatccaggtgt

SEQ ID NO: 35241 - DNA, 318 bp, Chlorella protothecoides
tgtgcagaggggtgttgtgccatggggggttgtggtgatctggaaacggtcgtaatgtactaggtgtcccaggttgccagcttcctgccggcctgcactcaagatgtgcggtgcctaccaccgcatgactcttagcctcacatccccactccctcccatctgcaggcgcaatgcgctgtgcccgacacccaccaccgaggatggggcagtgacccctccatccaggtgtttgcggtgcgcatgggcaccgtgcgctgggaaggtcccagcattgaaatgggcgacacattcatcactccgcacactgtcgcacacctg

SEQ ID NO: 35242 - DNA, 123 bp, Chlorella protothecoides
ctcattccccaagggcgtgaacctgtggaaggcgatgggcgacatgggcctgcatggtgagtcgggggcagggtgtttgaattcttgcgaaattcatgcactatgctcggacaattgatgagg

SEQ ID NO: 35243 - DNA, 61 bp, Chlorella protothecoides
accccgcactgggcgcggtcatgggtgaccgcctcctatgtggcagacccaaccgcgacag

SEQ ID NO: 35244 - DNA, 77 bp, Chlorella protothecoides
gctcgataccactgagagcatgccccagattcccccctcagaccctcacagcaccccacctgcaaagaggaactcca

SEQ ID NO: 35245 - DNA, 86 bp, Chlorella protothecoides
ctcgcgccgccctgccaccgctgaaggggccgggaggctcgcgccgccctgccactgctgaaggggctgggaggctcgcgccgccc

SEQ ID NO: 35246 - DNA, 61 bp, Chlorella protothecoides
ctgtgcgcgatgcaggacgctgtcgagtgctggagagcacccaccctcccgcacctgcttc

SEQ ID NO: 35247 - DNA, 73 bp, Chlorella protothecoides
gacagcactgcgcgggcacagtgggacgaccagttccccttggtccccagctccagcttggcgttctgtcgga

SEQ ID NO: 35248 - DNA, 9261 bp, Chlorella protothecoides
  modified_base (118)..(127): a, c, t, g, unknown or other
  modified_base (416)..(425): a, c, t, g, unknown or other
  modified_base (3374)..(3446): a, c, t, g, unknown or other
  modified_base (5082)..(5091): a, c, t, g, unknown or other
  modified_base (5167)..(5176): a, c, t, g, unknown or other
  modified_base (5252)..(5261): a, c, t, g, unknown or other
  modified_base (5453)..(5462): a, c, t, g, unknown or other
  modified_base (5552)..(5561): a, c, t, g, unknown or other
  modified_base (6010)..(6019): a, c, t, g, unknown or other
  modified_base (6513)..(6522): a, c, t, g, unknown or other
  modified_base (6696)..(6705): a, c, t, g, unknown or other
  modified_base (7825)..(7892): a, c, t, g, unknown or other
  modified_base (8573)..(8582): a, c, t, g, unknown or other
ggcgggcggcgcatccaagcgcgccctcctgcgcagtctgggcgcgcacgaggtcctcaactcccgtgacaccgcctttgtctcggaggtcgccgagctggggggcgtggacgtggtnnnnnnnnnnagcggccctgaatgccggcgggcgcttcgtggagattagcaagcgcgacatctggagcgccgggcgcgtcgcacagggtgggtcatgatggaaggggtgctcggtgctcgaccaggccctgatccatgcacctccccctcgccccacttcacacgacccagtggcccccaactgaggggcccctttaccccactgtcgcgccttcgtgcaccctactcaccctcccccgcccccccccgcacagagcgtcccgacgtcgggtactcgctgctggcggtggacttcctcnnnnnnnnnntgtcgctcagggtgggtcatgatataaggggtgctcggtgcttggacaggccctgatccatgcacctccccctggaccccttcacacgaaccagtggcccccatttgaggggcccctttaccccactgtgtcgctttcgtacaccctactcaccatccccccacccccccgggcacagagcgtcccgacgttgggtactcgctgctggcggtggacttcctccccgcccccatcatccagtccaccctggcccgcatctccagcgccctggcctccggcgcgctggccccgctgcgcagcatcgcccacggcctgggcgcgctggcgggcgccttccgtcagatggtgcaggccacgcacgtcggcaaggtggtggtcggcgccggcgaggcgggcgccctccccggccgcgccgcgggcggcggcatcgccgtcaccggcgggacggggggcctgggcctggccatggccgactgggcggcggccacgcacgctgcacgccacctggtgctgctcagcaggtctgggcgcaccggtgaggccgctccgattggcctgctggcctccccggccagcatgacgctcgcggccgtagacgcatcggtgcccgccgacctccagggcctggtgtgcggtggtgtgctggaagggctgcccatcacgacgctgctgcacgccgccggcatcctgcgcgactcgctgctggcccagcagaccgccgactcggtcaggcgtgtgctggcgcccaagctggggccgctgcacgccttgcgcgaggcgccggggcccctggccgccaccctgctcttctcctccgtggcctccctgctgggcgcggccgggcagggcaactacgccgcggccaacgcagccctggatgcctgggcgcacgcccagatggcctcgggcgcgaacgcgaccgccgtgcagtggggagcttgggcctcctcaggtggggatcttttgtggagagaggggtttatttcaatgagatattgtgatgggagagcatggttgtgatgtgggtatcttgtggagtggctgccgcactcagaaaatcacctgccctttccagcctcctgccctccatgggcttctcctcttggcgcaccgtcaatcagcatacttgaacaaagacaccaatccatcccccccactcccccccatcacccaggcatggcatcccaggcggtgctgaagcggctggaccgcatcggccagggcgccatctcggcggagcagggcatgctggcgctgggcgcctccctgcgcgctgtgcacgctgtgccccagatcgcggttaatgccttcagctgggacacctacctggcgccctggacggggcccgagcaggcaagggggcccgtgccaaccatgtatgccgagttcgaggcgtcggcaccacctgccctggtcgcccccatcggcgccgctgcaggtgggcgcaggaagcgcggcgtggacgccaacaagggcggcgccggcacggccgcgccagacgccgccgcgctgcgcgcccaggtcgcggcgaccgtggccgcggccgccgcagaggtggtcggccccggggtcggggaggacgagcccctcatggccgccgggctggactctctgggctctgtggaatttgccaacatgctgagtcagcgcctgggcatgagcatgcccggcacgctcatcttcgactacccctccctgcgcgccgtcggcgattacctgtccaccgcgctgctgaagaagcagggcgcaggaggggatggcgcggcgcccatgcccgaggttgatgaggacggcgacgtcccctccgacagcgacggggaggccagcgacggcgaggctccatcgcgcgggctgcgcgcccggcccgctgcctcgcccgcggccaggccgatcgcgctggtggcgatggtcagccagggcctgcagggcgacatcctgcacgccagtccgggaacccaggccatagtggcgctgcaggacgcggttcacaaggtgccgctgtcgcgctgggacctcgacagggccgagctggccagcggagacccctacacgctctcaccccaggtgggtgcaggattgtggtgttggaggttggggaggtgatgcaatgtttttgaggtcgcaagactccgctggccgaggcagatgcctgtcgtcgtccccccaatccaccccatccctcacccctcccaaccgctgtgcaaaccaccagtttggtgcgttcatgagcgagatcgaggtatttgacgccgcggcatacggcatgtctgtggcggaggccacgatcatggaccctcagcaccgcctggtgctctccttggccacccaggccctgctgggttcccagggccttcacggcgcccccctcccccgcaccggcgtcttcatgggcatttcctggaccgagtacggccagctggcgcaggccggcggccttcccatctcggcctacaccgcgcagggcgcggtgctgtccgtctgccccggccgcgtcgccttccaccacggcctcaagggccctgcggtggcggtggacaccgcctgctcctcctccctcgtggccgccaacgccgcgcaggaggggctgacgcgtggcgcggggggcgccatcgatgccgcgctggcgggcggcatcaacatgatgctggccccggccacctccgccatgttccgcaaggcgggcatgctggcgccggacgggcgttgcaaggccctagacgccgcgggggatggctacgtccgctcagaggtgggattgtgtcgggtttggactgtgcttttggcggggccgctcgtggaaggatgtggcgatttgctttgagtttgggcggagtcaggggtggcacagcaagcatgggagctccatctcgatgtccatggaaaccatgcatgctcatccactgccctactttcctcacctctccccccccccccccccccccccacccnnnnnnnnnnnnnnnnnnnnnnnnnnnnnnnnnnnnnnnnnnnnnnnnnnnnnnnnnnnnnnnnnnnnnnnnngctcagttgcgctcccatcgatgcctccgtgctcgccttcctggtgggcagcgccgtcaaccagggaggccgcgccagctccctcaccgcgcccaacggccccagccagcaggacgtgatccgagccgcgctggcggccgcgagcctgctgccggcggccgtctccaccgtgcagctgcacggcacggggacgcagctgggcgaccccatcgaactgggcgctgtgtcggagctgctgggcgcagggcgggccggcgccggtgccccgctgcgtctgctggcctccaagtcccagctgggccactcggagccagcctccggcatcatgggcgtcgcccagctgcaccaggcgatgacgcaggcgctggcgctcccggtgctgcacctgcgcacgcccaacgcgcacgtcgcggcggtggtgagcgagcccggggtctactccatgccgcgccagcccggcgcggcgcccatgcgtgcgccggcggccgccgccgtcaccgcgggggcctcggcctttgccttccagggcaccaacgcacacgtgctgctgcaggcgggagccggcgcagccctcgcacctgttctgccgcctgcgccagctttcgaggcccggcgcttctgggtcctggccgagccgcacgcgctcctgggcggggtgctggccctggacccccgcaccggcaccgtcacctttgccgccgacctgtcggcacccaagctcgccgccctgcgcgaccacgccgtcaacggccgccccatcctccccgcggccgccttcctggagtgcgccgccgcagctgcggcagccgctgccggcggcgcgcgagacggcgttcaggccgtgctgcaggtgaccatccccgccgccctggagctgctgcaggccggcgcacaaggtgcccgcgcgcaccagcacctgctctgctgctcggtggacgctgggtcggggcgtgtgcgcctgagcagcagccgcgcgggctcccgcctgcgcgaccatgcttacggcctgctggcttcaatccacctcggggacattggtgccggggtctcaacggcaccagcaaccccatctggcaccgtcactgccctgctccctctctctgtcgaggcagcgggctcgggcgggcccgtcggcaccatcacctgcctcaggccggatgggcgggtgggcggcgcagggctggacgccgccgcactggacaacgccttccacctgggcgcgctggacgccagcgccctgcgcatccccgccggcatcgccgcctaccgcgtggcggcggcgcccagcgtcgtgcccgcgcccgtcctggccgcgggctgcgcgccggtctcccagtccacgacctccgccctcaacgactactgggtggagagcgcggcggggaggtcggcgggcgtccagggcctggaggccagggagctgggcgccgctgcgcggcgcgcctccggtggttctccgcaggcagctgctgccagcacggcgctggagtaccacaccgtctgggagaccagcgtcgtggtggcgggggggctctcctctgcccgccccactgcctccgcatttgatctggcacagggggtctccacccagcacgccgcgatcatggctctggcaggcctgcaggcggcggcagcnnnnnnnnnngctggaggcccccgggccacgctacacggccgtcgacagcgacggcgcgcagcgtgcccagcgccccaccgcgctnnnnnnnnnnactggaagcccccgggccacgctacacgaccatcgacagcgacgacgcgcagcgtgcccagcgccccaccgcgctnnnnnnnnnncccgcatttgatctggcaccgggggcctccacccagcacgccgcgatcacggctctggcaggcctgcaggcggcggcagcctcgcagggccccccctcggtggctctggagtcgcgtgcccgccccggcgccgggcctttcaccggcaatgcaacgaccgcgctgctgcgcggcatgctcaaggccctggcnnnnnnnnnncgcgcacgctgcagacaccgggccttgccgtggggccgccctcggcggaatcaaagacccgtgtttctctggcatctgccgccccgcgcnnnnnnnnnncgacacccttgtttttgggggcgcggccgtcgatgacggcgtcgatgcgcacggcctggccctcagggggcgcacgcagcagacaccgggccttgccgccgggccgcccttggcggaatcaaagacacgtgtttctctggcatctgccgccccgcgcttcctcatcacgggaggcacgggcagcctgggccggctcatgaccgaggcgatcctcaccgggagcgcgggcggcgccaccacctgcaccctggttgggcgggctgggcggctgggcagcagcggtgacgccgcgccgctgctggcaggcctaccaaccgacgccaccgccgtctccagcctggtcgtgacctctggcgacgcggctgtggcggccgacgccgtgcacctactggccgcggaaggcgcagagcccctggccgtactgcacgcagctggcttcctggcggacnnnnnnnnnncgggcgggctgggcggctgggcggcagcagtgacgccgcgccgctgctggccgccctcccaaccgacgccaccgccgtctccagcctggtcgtgacctccggcgatgcggctgtggcggccgacgccatgcacctactggccgcggaaggcgcggagcccttggcagtactgcacgcagctggcttcctggcggacgccatcctgggcaaccagaccccctcggcgctgcgtcgcgtgtttggcgccaagacgtccagcgcggaggcgctgcgtgccggcctcgctttccttcccgcctcccagcaggtcctcttctcctccgtggcggcgctgctggggtcgccagggcaggtcacttactcggcagccaactcggtgctggatgcggctgccgagctggcgcaggcccaggtgaggagggagggtgggtggttgttgatcagagagtgacctagctgggggaggacggctgcgcctggccaaggctgtgctnnnnnnnnnnagggtggttattgatcagagagtgacccagctggggaaggacggctgcgcctggccaaggctgtgcttccacatccacattttctcaagcaccacggctccatcgctgccccacaccaacccccccaccaactccatcttccgacgcagggtttgccctccaccagcatccagnnnnnnnnnncctcaagcatcacagctccatcgctgccctacaccaacccccccaccaactccatcttccaacgcagggtttgccctccaccagcatccagtggggcgcctgggccggcagcggcatggcagcccaggaccgctccaccgccctgcgcgtcgagcgcatgggcatgggcatggtcgaccccggccaggggctgcgcaccctggtcagggccctggcctccacaccggccgtcttggtggccgtgcccttccacctgccgcgcctggcggcgctggcgcagcgcggagcgggcacccactccatctacgcccgcttgctggccgacgtgccagcggcggcaggagcagcctctcgccggcccgcgtcccgcgccggccaggcgagctccgcggcgccggccgcggcagcagcggtcagcacggccgccatcatgaccggcatccaggaggccctggcgggcgtgctgggccagaccctggagcccgacgcgccgctgatggcggccgggctggactcgctggcggctgtggagttccggaacacgctgcagtccacgctgggcatgcagctgccgggcaccctggtgtttgattacccgacggtatctgcgctggtgggcttcgtcgctggccaggtgccgcgcgcccagggcacccacggcgccagcagggcccaccgagggtctgccgcgccaccccgcgctgcgcctgccgtcgacatcatggtcatccgcgggagcgtggcgcaggtcgtgggcgaggtgctgggggccgaggtggagcctgacgcgcccctcatgtctgccggcctggactcgctgggcgcggtggagctgcgcaacagcctgcaggccgcgttcggtctggggttgccgggcaccctggtcttcgactaccccaccgtgaccgcgctggcaggccacatcgcaggcgaggtggcccgcgccggcggcgacgctccgggcgccgcgccgcgccccgcctcgcgtgccagcgccctgctagaccgcggttccgtgctttccacagtgtccgaggtcatcggcgaggtgctgggcggcggcgatgtggacgtggacgcgcccctcatgtctgtcggcctggactcgctggcggcggtnnnnnnnnnnnnnnnnnnnnnnnnnnnnnnnnnnnnnnnnnnnnnnnnnnnnnnnnnnnnnnnnnnnnggcgtcggcctgccggggacgctggtcttcgactaccccaccgcgcaggccctggccgggttcattgccgacacggtggagccggagggtagcttcctggggacgctggaggacgagctgagcatgctgagcctggccgaggtcggcgcggtccgggcctcccaggacttccccctcgtctccctggcctcgcgcctgcccaaggtgtgtgtttcaggaggggtgtggagcctcatttgcagtgttataccctcgttctgtagtgggtctcacatccgctacccttggcaatgaacttggtttagaagccacacttcaccttacaccgcattccccctcacctccccgccaccaccacacaggacatcctgaacctgagcctggccgaggcagacgggagtggggttgtgccgttggagcgctgggacctccaggagcaggcgcagaccctgggcactgcgccggcaaggtgggcagcggatgtgctgggtttggcaaagccagatgctgcagcgtgtggcaggcttttaggggcagttgccggcaatgcatgtgatgggtgtggtggatctcagatacatctcctgtgcatggtcaccgtcacatttccctccccttctcccctcacatctcgccccccaaaaatctccccccaccccaggttctcttccttcctggagnnnnnnnnnncggcggatctcagatacatctcccgtgcatggtcaccgtcacattttcctccccttctcccctcacatcccccccccaaaaatctctccccaccccaggttctcttccttcctggaggacattgatctgtttgacattgcggccttcaagttcaatgccaacgaggccatctccatggacccccagcagcgcctgcttctggagctcagcgcccaagtcctcgccgggcagtcggcacccaccgacacgggcgttttcatcgtgagtgggggggtgtcttggtgatgaacccctgcaccattatagcggcctatgtcccattcctcccagaccagcctcccataaatcccccgttctcaaccccgtcttgctgcagggtgtctcctccacggagtacaggatgttggtgtccaaccaccttcccgccttcactccgtactctgccactggcactgtcagcctgtcggtgacggcggggcgtctgtcctaccactacggcttcacggggccgtctttccccatcgacaccgcctgctcatcgtccctggtcaggtgagcgagggtgcgttttctgaccactgcacagggttccgcgggggtgtctgttgtctatggattcatacaaatcccatcaaggcaaggcattcgacttggatacgaagcccctctcagccctgct

SEQ ID NO: 35249 - DNA, 107 bp, Chlorella protothecoides
tgtcgacaccatgaccctttccgaaaccaggagggtttcgaacatgctctgcatgcggcgtcaaccccccccaggagtttgggcgccatgcattgcattgccgtgca

SEQ ID NO: 35250 - DNA, 116 bp, Chlorella protothecoides
agccatgcttgctgtgacagctgtggggcaggtgcacacctgagctctgcggggtgcacgcccttgcagtaatgaccggccccctcacctcgttgacggaggtgcagacggatttc

SEQ ID NO: 35251 - DNA, 102 bp, Chlorella protothecoides
atgaggagcatctgggtatgcgtttggtatacctgttccgatgggtgacagaggtcgcgggggtgcaggcattgctgtacactttgctcctgggagtggaag

SEQ ID NO: 35252 - DNA, 67 bp, Chlorella protothecoides
gcccccctcacgccagcgccgcgcgtgcagcttactccgtcgatctcggtccagacccgctgttctc

SEQ ID NO: 35253 - DNA, 61 bp, Chlorella protothecoides
ccctcccctccagcacctgccctccacctcacctgcccagccaatttcctcaccctcccac

SEQ ID NO: 35254 - DNA, 68 bp, Chlorella protothecoides
cgtgaacgtttctggagtcaagttgcctgcagaggattggcaattgttttcctcctctcaccctcccc

SEQ ID NO: 35255 - DNA, 61 bp, Chlorella protothecoides
gggcgcgcggttcaccctcaagagcggcgatcgcccccacctcctcaagttctgatgcgcc

SEQ ID NO: 35256 - DNA, 98 bp, Chlorella protothecoides
cggtcttgcgacgcaagccaggcgatgcgaatgttggcagggtcgactaggagagcgaatggttgcttgagggaaggtggggccgcggtctggtgcgt

SEQ ID NO: 35257 - DNA, 107 bp, Chlorella protothecoides
ttaagtctttctatgccgaggtgtgcggtgccaaaggggttggagagggacagcgatgtgtgcacagcagtgtgtggaagagtgctggtacagcgtgacaaatgatg

SEQ ID NO: 35258 - DNA, 73 bp, Chlorella protothecoides
cgcacagtattgaccaccccatggaatgcatttgccctccgcgaaaactatgcacgcaccctcagcgctgccc

SEQ ID NO: 35259 - DNA, 61 bp, Chlorella protothecoides
aatacatgcttgaaccaaataaaagagactcccgtcctttattacgaaaattaactcctaa

SEQ ID NO: 35260 - DNA, 61 bp, Chlorella protothecoides
taaagtacatgaagaatgatcggctcagaagcctgccgcgagcctcgcgcggaggacttcc

SEQ ID NO: 35261 - DNA, 118 bp, Chlorella protothecoides
taacgtccgaggatttggatcaggcactggtcacggtccagcccaccgcccaggggctcagccatgcgtctccggagctgccaccccccagccacttcgaggtcctgaccgcggcggc

SEQ ID NO: 35262 - DNA, 150 bp, Chlorella protothecoides
ggacgccgccatggaggtgggtagtggatggtcatgagttggggtgagcggtgtcggtaagtcgggatgaccaagcatccttctacgaaggttggtgatcaagatgacgcagctgtgccatccacacgcctgcaggaggatggagtgaca

SEQ ID NO: 35263 - DNA, 416 bp, Chlorella protothecoides
  modified_base (89)..(255): a, c, t, g, unknown or other
tgagagaagggcccagcaactcgttgcatcccagcacagagtcggcaaacaaacgaacaggcagcgtctgggtcgcgaggggtggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagtcataatcgttctccgagaagaccccgcatccccccaaacaccataaggagtaataagcaaccctgagctacgcgcctcgacccgcctgttctctgcatctcacctccaccaccctcctctcgatgggttcaaggcagcctgtgacaacgctcctg

SEQ ID NO: 35264 - DNA, 69 bp, Chlorella protothecoides
taggagcaaggggccacggccggcgctggcccggtccagttctgcagctgtgctggtagacagcaatct

SEQ ID NO: 35265 - DNA, 71 bp, Chlorella protothecoides
gaatagatgtgcacagatacttggaaagccggtgtgtaggaaatcggcgtgggaactccgtgaagtgactg

SEQ ID NO: 35266 - DNA, 428 bp, Chlorella protothecoides
  modified_base (130)..(338): a, c, t, g, unknown or other
ttcgaatatggaggcatggagaggtgctccattgtgatatagaaggccgctagggaccaccccccttaatcttgtttgcctgatcaggggccgtgcgcaatgcttcactcccgaagacctcgtccctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggggtggtgggagtggaccattcggttggctgcaagagtgtgcaccatgcacccatcatgggggcgatgcaggcagcgtccccttcc

SEQ ID NO: 35267 - DNA, 61 bp, Chlorella protothecoides
ggctgggctcccattcgaacccagacctcgggtacgagcgcacgcacactgagagtggaca

SEQ ID NO: 35268 - DNA, 74 bp, Chlorella protothecoides
ctattgtctccatgatgccactgcagtgaaggtaaggcatatagtcaaggacaaattacgcattctcattggct

SEQ ID NO: 35269 - DNA, 107 bp, Chlorella protothecoides
gccccgggggggggggggggtggaggattggccatcgagcaagctaaaagggtttcaatgacacaccagtttgccggtagcctgggatcgccagggagcgtcccaac

SEQ ID NO: 35270 - DNA, 1185 bp, Chlorella protothecoides
  modified_base (123)..(132): a, c, t, g, unknown or other
  modified_base (694)..(703): a, c, t, g, unknown or other
  modified_base (907)..(916): a, c, t, g, unknown or other
acaactgcgccacgccggaggtggtgagcgcgagcaggcgcgcgtcgcgcgcggccaggcgcgcgactccagcgcccagctgcagtgggcctgccaggcgccgcccggcggggctgtacaccnnnnnnnnnncccgagcgcgtagacgtaggcagcgccgtcggagagcgtggccaccggcgcccccgcggccgacagcgccaggcccgccaggcgggcgccgccctccagcaggcaggccaggccggcgcggaggagggagcgggggccctcaggccccagcacccacaactgcgccacgccggaggtggtgagcgagagcaggcgcgcgccgcgcgcggccaggcgcgtgactccggcgcccagctgcagcgggcccgccaggcgccgcccggcggggctgtacaccagcaggctgccgtcctgcaggcccagcgcggagagggcgggcgtggcggccgcgcaggtcacgccgcagggcagcgagtcggtccacagcacgcagcgcggctgggtcgtcgcattcgcggcgccaggagcggcgcagcgctgcagctggacagacgccgatccgggcctggagggaggggggcgggcgtttctcgaggtggggcgggacaccgtggcatgaaggcatcgatggagggcgatggcatccttgcaccccaggcaagccgcccggggcctcgactcnnnnnnnnnntggtggagggcgatggcatccttgcgccccaggcaagccgcccggggcctcgactctcccagactgagctccggggcatgcaggaaggagatgcccgatcggctcatgccgctcacaagataccagccaccacccacccgcccctcgccaacacaccacccactgcgctcggaccccacacctgttgacgatgcggagctccannnnnnnnnntggctcatcccgctcacaagataccagccaccacccacctgcccctcaccaacacaccacccactgcgctccacccccacacctgttgacgatgcggagctccagggccgtggcagcgtcgccggccttgccggcaaacacccccggcggcacgtccacgcgcaggaggagctccctctgcagcgcgggggcggcgagcggtgcgggccgcggcgcgccggccagcacggccccgctctcggcgccgcgctccctcgcggccgccggcc

SEQ ID NO: 35271 - DNA, 61 bp, Chlorella protothecoides
ccttcatgccacggtgtcccgccccacctcgagaaacgcccgcccccctccctccaggccc

SEQ ID NO: 35272 - DNA, 126 bp, Chlorella protothecoides
tcccaactctcagtgcctctgctcaatggtgcaccgtcgaatctggaatgccgccctggccgcaattgctcacatcttcgcagggcccctgggaatggtaacagcgcgtcgctcttcttctcaggt

SEQ ID NO: 35273 - DNA, 61 bp, Chlorella protothecoides
tctctgccatcacatctgtacgtgcccaagcactccgcatcgcaacccttgaataaaaagg

SEQ ID NO: 35274 - DNA, 79 bp, Chlorella protothecoides
caatcttgctcctgcctcccagctcccactttaaatcccccccccccctttccccacctgcgagccagccggacgtcgt

SEQ ID NO: 35275 - DNA, 77 bp, Chlorella protothecoides
gctggtgtggtgcgctgatgaactggtgcatatcagacggccactattagtcaggaggtatggacagcgacagctgg

SEQ ID NO: 35276 - DNA, 72 bp, Chlorella protothecoides
ttttcggggatacatccttcccaacattaagtggccctcgccccccgtccacaccaacaccacccactcgcc

SEQ ID NO: 35277 - DNA, 442 bp, Chlorella protothecoides
ggcacggccgcgccagcgtcgccgcgccggcctcgcccgaggccgaggcgctgcgcgcggagtgggcgcggcatgaggccaccatgcgcgccatcgccgacccgtccgcgcccgaggcgctgatcgcgcgcaacgcggtggaccgcgtgtccgccatggcgctggagctggggctgggccccggcgtggtggagatcgggcaccaggccgcggagatcctgctcatgatgcggccgccggacgaggcgccctccgacttccaggagtacacgctggtggccatcctggccgtggccgctcacctcagccagcaccacctgggcgagcgctacgggctggaggccctggccgcgcgttacggccaggaccccgacgccctggagcaggtttgtgtgtgggttgaagagggggaagggcgtggttttcttctgcgggggggggg

SEQ ID NO: 35278 - DNA, 61 bp, Chlorella protothecoides
catggcgctggagctggggctgggccccggcgtggtggagatcgggcaccaggccgcggag

SEQ ID NO: 35279 - DNA, 106 bp, Chlorella protothecoides
caacgttcgcattatcgttgtaggagagaatcctcaggggaccccaccagaatcacagcacgagcttaatattctgtcccgaatctgcagattcacgacagaacca

SEQ ID NO: 35280 - DNA, 61 bp, Chlorella protothecoides
ctccagcagccttctccctgcacaagttgcaactcgggtccaggatcaatgcccacccctg

SEQ ID NO: 35281 - DNA, 138 bp, Chlorella protothecoides
catcgaacaagcaagaagaggtccatcctcgctgtccaagccctcgccggccgaggtgtgtctctccttggtgatggctagagagtggcaggaattggaacactgtatcactggtccacatcatcatgttgcatgaac

SEQ ID NO: 35282 - DNA, 113 bp, Chlorella protothecoides
ctcgcgtgcttggggtgtgcaagggagagggtgagcctggttgagctgagcattaggagcagcatttgagttgtgaatgggggttcggggatcgggatatctccagcctctcc

SEQ ID NO: 35283 - DNA, 61 bp, Chlorella protothecoides
atttcaagacgtgtcagaggctggcgcaggtgtgcctccttcgggccatggcagaagcagc

SEQ ID NO: 35284 - DNA, 111 bp, Chlorella protothecoides
ttcatcaaggtgggcgacctggactggtggtggggggggtgggggtccggcagttgggccatgcacctcctgcccatcttgaaagcctggccatgggttgaagaccaggtg

SEQ ID NO: 35285 - DNA, 106 bp, Chlorella protothecoides
ggggccagctacccacgcgtctcgctttgcgtgccgccatacctgagggcaacccctctgacaacatccgggagcgtcctcttacccgctccggcgctggagaact

SEQ ID NO: 35286 - DNA, 123 bp, Chlorella protothecoides
ttccgccgatgagacggggccatcgtcgcacactgcgcactgcagccccaggaaggtgtctggggaggccctgcccacgccctttcgcaccgccaggcccaatgccacgggcgtgccagggcg

SEQ ID NO: 35287 - DNA, 70 bp, Chlorella protothecoides
cgccgcacgccgccgccgcgccaaccagcttccgcacgctaaccctgatcccgactatcggctgcccaag

SEQ ID NO: 35288 - DNA, 61 bp, Chlorella protothecoides
cccgcattccacctgtctcagctgctccagcgcgccgcggctggtgggccgcagggcatcc

SEQ ID NO: 35289 - DNA, 61 bp, Chlorella protothecoides
ctacctgaacttgtggtctcaaaaggcaccctgctggaggtatacactgccaggtgacgat

SEQ ID NO: 35290 - DNA, 61 bp, Chlorella protothecoides
gtagaagcgcttgaagtcgctggcggtgagtgccttgagcctctggaacacagactggttc

SEQ ID NO: 35291 - DNA, 61 bp, Chlorella protothecoides
gatatcgttacaagcccatgtttctctctaaccctgccatgagcaagcatcccaccttccc

SEQ ID NO: 35292 - DNA, 222 bp, Chlorella protothecoides
acgacgccacctggtggggcttgctgtcaggcgctgtgggagtcatcgagccctgctcgcgtgtccaggataaggtggacacatgacagcacaccgtgactctgtctcatacgtgtatggccccctggtgcatctcctgctgcccccagagggccccaagagaccgtcactggtggagttgccacccacctaaacctcccttgccaccatgtacgagagcct

SEQ ID NO: 35293 - DNA, 204 bp, Chlorella protothecoides
cggggccggtggaggcaggatcggggccggcgggcgcggaggccgagccacaaggcgcgggtgtgtagacacatggtcgcaggcacgagcccctcttgtgtagtccagcggcagacgggcgtatgtgtgatgcaagagcggacagccggccttctggcgacattttggatgtgtgatgacaccatgttccttgcgttgcatggg

SEQ ID NO: 35294 - DNA, 465 bp, Chlorella protothecoides
  modified_base (147)..(352): a, c, t, g, unknown or other
ggagcaagtagaattttgtgcacaagggtttcggtgcaatacaagatgctccagcgaaaacaaagagggacagggattggcttgcattggcgcacgttgctgtttccaccggaagccggggaggagggtgccagcctgaccgtcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctgcagcggcgtctgcggtgcaggggttgatgacggcgacgaaggaggtgttgacggcgagtccatggtacgggaagcggggcgaagggaggtaggcaggcggctgcggc

SEQ ID NO: 35295 - DNA, 90 bp, Chlorella protothecoides
ccctggagctgcacaaagagctcgatctgttttgggagaagagacgaggggcatgcaactgtttcagagagttctgttggcggcttgctt

SEQ ID NO: 35296 - DNA, 2980 bp, Chlorella protothecoides
  modified_base (104)..(113): a, c, t, g, unknown or other
  modified_base (711)..(720): a, c, t, g, unknown or other
  modified_base (1875)..(1884): a, c, t, g, unknown or other
  modified_base (2480)..(2627): a, c, t, g, unknown or other
ggagggggtgggtgggtgggtaggtgggtgggcagcagggtgctcattactgcatctctgggacagacgcaccggggacaaatacacacacccatgtgatactnnnnnnnnnnagggtgctcattattgcatctctgggacagacgtgctggggacaaatacacacacccatgtgatactcagaggcagggcagggcacctgctgcagcccatgggctgcctggtcaagagatggctcccggggatcaccccctccctcccacatcgcgcacctcgggccggcgcatggcactgcagcttgtcggtggggagggggacctgggcagtggctcccccgcgccaccacccgctgggggcgacggacacggccttggaccagaagccctgcacctgctcccaggcgcctggcgggggaggggccccgctggcgggagcttgaggggccgcctcagcaaaggccacggagttgacggtcatggccaggccgagtccagtggtgcctccagcaatggcccaaagggcggagctcccggcatgggagccggcgagcacgctgcggggcgggcaggtgctgggcaggtgggtgccatgccccttaacccagtcgcacggcaggcccctcgacccacagccccgacatcagagcagggtggtgatcatccctcaaagccacacctgtgttgacggagagtggaggagaggtgtctgccnnnnnnnnnnctggtgatcatcgcccaaaaccacacctgtcttgacggagagtggaggagaggtgtctgccgagggaacaggcccttctcagggaccacagcatggtcgtcacgtagcaccccagttgccgtgccctgtgcgacgatccgggagctccccagcgctggcccaaatccttcacgagcacatcaactgcccgagcaggcttccatgaagtccgactccgagatcacagcaatgggatgggcatcttcctgtactccatccagcgcctggtgtcgggcctgcgcgccccgggcggtccctggatcaagcctggggcgtctcgtcacgcaggactgtccagaaggtcccaggggcggggcagactccccgtctttcgctgtcacagtgagttccacaacccatccggtatccctggtcatcatgctgagtcaggcgggtcggcggctcgggaagagcctgctccgcctgagcccggagtcatcggtgagcggcgatgctgttgtgctgatggtgtcctcctgctcgtgagcggctttgagatccttaccttgcctcatcatcataatcgcagatttctgcatataaatgcaacgccacatcatggacggacagcctgcggtgcttcgggtgagcagtccgaccttgggtggtgtgtgtgctgagatgtgttgcgccgcatggcatgcaccgaccccatcccccattccacgcaggtccaccgtgagccgatccgccgctgggaatgaggtcatcggcatcgatctgggcaccaccaactcttgcgtggctgtcatggagggcaaggtgaggggatgaatcatctggtgtggggcctgcacagtgctgcgatctggcgctggttgggaatgccttgcaccacagcgtaaccagtgtggatttgggtttgtgcagggctgtgctgacagggcccagggtgtaccgatgctctgcacagcggcacgctgaaggcatgcatgcatgcatgcatgcacggcccttttgctgctgcaagcagtgatccttgctgcagcgtgtggctggggcccaagcagccacttgtcggcagatcgcggacgctgatcctgtctgacccacccccaagaagcctccttcacctcaaaacaatgaaacaggtggccaaggtgattgagaacgcgnnnnnnnnnnaaacgctgatcctgtctgacccaaccccaagcccccttcacttcaaaacaattaaacaggtggccaaggtgattgagaacgcggaggggcagcgcaccacgccctccgtggcggccttcaccgagtccggcgagcgcctggtgggcctgcccgccaagcgccaggccatcaccaaccccaccaacaccgtgtacgcgaccaagcgcctgattggccgcgccttcgacgatgccgaggtgcagaaggagcgcaagatggtgccctacaacatcgtgcgcgccgacaacggcgacgcgtgggtggaggccggcggccagcgctactccccctcccaggtcggcgccttcacgctgcagaagatgaaggagaccgcggagcggtacctgggccgccccgtctcccaggcggtggtcaccgtgcccgcctacttcaacgaccaccagcgccaggcgaccaaggacgcggggcgcatcgccggcctggacgtcctccgcatcatcaacgagcccaccgccgcggcgctgtgctacggcgcagacaagaaggagggcctggtggcggtgtacgacctgggcggcggcacctttgacgtgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgctccgacggcatcgacctgtccaaggacaagctggcggtgcagcgcttgcgcgaggcggcggagaaggccaagtgcgagctgtcctccgcctcctccaccgacatcaacctgcccttcatcaccgccgacgccacgggccccaagcacttgcagctgaccctgacgcggtccaagttcgagaccctggtcaagccgctcctggaccgcactgtgcagccctgccacagcgcgctcaaggacgcgggcgtcaccgccaaggacgtgaacgaggtgctgttggtgggcggcatgacgcgcatgccccgcgtccacgagctggtgcgcaccatcttctccaaggagcccaa

SEQ ID NO: 35297 - DNA, 89 bp, Chlorella protothecoides
gggtgaggcgcatgcatgcgtttgggatactggctggctgtggcagaggttggctggtggcctccggccagctggacatgtgccaggct

SEQ ID NO: 35298 - DNA, 67 bp, Chlorella protothecoides
cgcggcgctggccaagcgcaaggaggccgctgtgaacgccgccggcagccccgccaaggggcctcgg

SEQ ID NO: 35299 - DNA, 111 bp, Chlorella protothecoides
gagatccagatggtattggaaccggcaggacccaggtcacatggattcaaagtgtgccggcatccggcttgccggggccaggcacctcctgagaccttccagggttgcgtg

SEQ ID NO: 35300 - DNA, 95 bp, Chlorella protothecoides
gtcatccccccagtacaccttctggctcagccattgctgcggtgccgcgcttgatatctgtcccttgatcacctacttgagggccttcagcagcc

SEQ ID NO: 35301 - DNA, 61 bp, Chlorella protothecoides
tccctgcctccttcacaggaatgcatctccatgccattagttggcgcggcccatgccatcg

SEQ ID NO: 35302 - DNA, 128 bp, Chlorella protothecoides
cctagcattgccgctctcctttgtgctgcatggggatgaatggtgtgcgtcaggtttaggatgatcttccagctcagctctaggcccttatgcacaagaacctcccgcccatcctaccacaaaaccca

SEQ ID NO: 35303 - DNA, 61 bp, Chlorella protothecoides
agaaatcgctacctctcccgcccccagggcaaccccgttacacagagtgccccaagaaatc

SEQ ID NO: 35304 - DNA, 63 bp, Chlorella protothecoides
cgagtccctgtcatcagaactctgccaaaactactcatgacgagtccctgtcatcagaactct

SEQ ID NO: 35305 - DNA, 94 bp, Chlorella protothecoides
gcgcatgctccagcagccgccagaccgacaaccaacagtccttgcctccaatgccagggcgacactcgtcgtggctgccgttccagccgcgagc

SEQ ID NO: 35306 - DNA, 72 bp, Chlorella protothecoides
cagaatgcatgtgcgcggcctggtaaaagataataacttagaaatttatggctatgcaccatgcccacagaa

SEQ ID NO: 35307 - DNA, 66 bp, Chlorella protothecoides
tgtacgcggggacctgggcgtgggggggggctctcgcgcgcgcagagcgcgctgccacatgcaccg

SEQ ID NO: 35308 - DNA, 109 bp, Chlorella protothecoides
catgtgggctgcattcgcggagggaagtggcaagcgatgccatccccgccctccgtggacgccccagcagcgaccccaccccccatgcctcgcacctgggtcgcagctg

SEQ ID NO: 35309 - DNA, 111 bp, Chlorella protothecoides
ggcccctccggcctgggggccgccctggcctccgcaatgcgccaccacgaccggacggagggccggcgcggggccgaggacggcaggagggcatactctgccatcgacctt

SEQ ID NO: 35310 - DNA, 61 bp, Chlorella protothecoides
ccagtgagccatcgacctcccgttgatcccgaagccaagtccctcccaccaacccaaggcg

SEQ ID NO: 35311 - DNA, 91 bp, Chlorella protothecoides
tcgacacatcccccttccaccgggtcatggaccctgccgcggcgccagtgcaacggtagagaagcacagcgctgataatagacggacccag

SEQ ID NO: 35312 - DNA, 61 bp, Chlorella protothecoides
ggggaaggtggctgggcgtcctcggatgggaagggcgacagccctaataccaggaagtcag

SEQ ID NO: 35313 - DNA, 101 bp, Chlorella protothecoides
aatgtcgccgcaaacctagggtgcgaagggaggacggttcggcggtggtttccatgggatgtggctggacttgcaaccacacacccggcaagtgtgagtga

SEQ ID NO: 35314 - DNA, 8555 bp, Chlorella protothecoides
  modified_base (2091)..(2100): a, c, t, g, unknown or other
  modified_base (4953)..(4962): a, c, t, g, unknown or other
  modified_base (5352)..(5361): a, c, t, g, unknown or other
  modified_base (5869)..(5878): a, c, t, g, unknown or other
  modified_base (6188)..(6248): a, c, t, g, unknown or other
  modified_base (6460)..(6469): a, c, t, g, unknown or other
  modified_base (7475)..(7484): a, c, t, g, unknown or other
gccggcgggggtggccgcgccgaacctgatgcaggcggcgctgaccgcgcacatgctgcgcgcggcgggcatccacagcgtgcgcgtcgcggaggagggcctggccgccatgctgcgcgcgcacggcctcgacagccggggctgaggcacgcgggggtgtggagggacgcggcggccagccggcgtttttggccctccctgcgtggccgctgatgttcggacagcgagcacgcggtggtccaccaggcatgccactgtggcccccgctccaggcactctaccgacgtgggcgagccggcatgggccatgctgcccgtgcctcatccaacacctgcacctttcaagaccctgcacgaggcgggccgctggaatcagggcgcccctgcgagcattcaccaatgcacgcgatgccccccctgcccctcctgtcttttgccatcactgacactgcgtgatttttgcatttccaacgcccccccatgacgtgacctgtagacatgggcaccaactgtgcataccgatgttggcatgcacccgcagtgctcaggtcggattctcccaaagattttcgggccgggtgaatcgccgcctaaggcgcacgggctcctggggtgggcctgggcgtgagctgggcctgtaaaacgtgctgcccagtccatgtccagatcgtcgaaatctcgggcaaaacgtgtcgggagcacgtgtcgggagaccgcagtgccgagagctcatatggggagtcgtcatccaacgtttcgcagtaccaacatcccaacccacccccgcgggagcagcacagcagggagcctggagcgcccaaaacaggctggcattggcagcttttagcacctccattccgccgcgcagcattgcgcaatccctgcccgcgctccagagtgctgggcactgccgagacccgcgaatttgctgcagctatgtgcggcatcctcgctgccctaggcgtgacgggtgacgccgaggtgaacaggcgcaggctgctgcgatgcagtcgattgctgagacacaggggacctgacagcagtggggtatatgaggatcccaagggacgggccttcatctccttcgagcgcctgaacatcgtcgaccccagtgacgccggcaggtacagggaacaggccaatgacaatgcggctgcagctgagagcacttgacaaaggacactggattattctataatatttccgcggctcgccctcattgcaggcaacccttccagatcgtgcgtccggagggcaaccttgcctgggcactgtgagttggcctcggttgtgagccggggtcagggaggggatgtcatgcaattgcaatattccaagatcgccgatgccaatgtggggagcagatgcatggcccttgatccttgcaacatggacaggccactggtgggtcatgcagccaggtcagatcacgcaccgccctgcccagggcatgtgcatgccgatgcgagagggcttcccgtactcattgttgtgcatgaatgtgagcatacttatcgagtacattttggaaatctcctcaacccatcccccccttcacgccccaccatctccctgcacgcctgcaggaacagcgagatctacaacttccagcaggtggtggcggagcagctgcctggcgtccacatcccctcccagtccgactccgccatcatcgggtacctggtgcaggcccatggcgacaccaacgagctgtggaactcgctggacggcatcttcgcatgcgtggtgtgggacgaggccacctgcgagttcaccatcgcgcgggaccccctgggcatctgctccctgtactggggcaaggacaaggacggctccatctgggccgcctcggagatgaaggccctgcagcacctcgaaaccctggacatcttccccccggtgagctgagaggtggttggggagggtggtgggcgggcggcgagtgtaccttgggaggtgaggggtcctgctccagcctccacatgccctgatccccctgcacaggggtgtgcctgcacccacaaccaggcctcacccctacccctcggccaatcgcctcctcccccccataatactttcgcttcaacgcagnnnnnnnnnnaccctcacccctacccctcggccaatcacctcccccccccccataatactttcgcttcaacgcagggccacgtttaccgcagcaggaccgggaagctggagcgatactacaacccgcggtggatggaggagggccgcgtgcccagcgcccccgtggacctcgacctcctgcgccagaccttcaccgatgccgtggtgaagcgcctgatgtccgacgcgcccctgggcatcctcctctccggcgggcttgactcctccctcgtcgcctccgttgccgtcaggtgatcgtgtgtgctggggggtgagaaggcgagcctggtctggcttaccaggacgcggcgggtctttggaaacgggcgccaagccccggggctgcaagccctggaaggcgcaacctaccgggcccttcctcatccctttgcctcacactccctgtttgctgcagtgtgcagtttttcccatgcatccctcagacgccccccctcatccccctaaaacccccaaacaggcacatccgtgagaccaccggcacctttgacaaggaccacaaggtccacaccttctccatcggcatcgcgggctcccccgacctcgtcgccgcgcgccaagtgtcggaatttctgggcaccgagcaccacgagttcaccttcacggtgcaggagggcgtggacgcgctggaggacctcatctggcacattgagtcgatcgagcaggtgtgtgtgtttggggttggatgtttggcaggcatgaatgctaagaaggacgagaggggtggaagagggtcagctggtgggctgcatggctgtgtcgatgctttttctgctgggatcccgagtgtgaagcatgcgagtactgcccacagaccctcctgcgccccgccatgcctgagaatcccaggtcatcctcgtcagaaatggtcccttccctttccctaccgcctcccactcccctccttcctctaaaggtccggtctgccatccccatgtacctgctggcacggcgcatcaaggccctgggcatcaaggtcgtcctctccggcgagggcgccgacgaggtcttcggcggctacctctacttccacaaggcccccaacccggccgagttccaggcggagacggtgcgcctgctgtgccgcctgcaccagtgggacgtgctgcgcgccaacaaggcgcccttctcctttggcgtggagacgcgcgtgcccttcctggacaagcgcctcctggaggtggccatggagctcgaccccagcgccaagatgtgcgacctggcggaccgccccgacggcgttcacccgcgcttggagaagtatgtcctgcgcaaggcctttgacacgccggaccgcccctacctccctgacgccgtgctgttccggcagaaggagcagttctccgacggcgttggctacgactgggtggacgggctgaagggccatgccgaggccgtggtctccaacgctgactgggctgcgcgacacaagcgcttcccggagcacacgccgcgcagccgggagtactacctcctccgcaccatcttcgaccgccacttcacccacccctctgcctttgacaccgtacccaaggtgggcgggggaaattgtgtgtggggtgaggggggggaagggcgggggtcacgtgtaggggtgtacaacacatggggaggataggagggtacatgagtgccctgctgcctcgccccagcaggccaggccagtgccgtccctgccccatcctgatcctcatcaaggatgctccaccctatcccccgcccataccacgcaggggctgagcatcgcgtgctccacgcccgaggccctggcctgggaccccagctgggagaactcgcacgagatcagcgggcgcgccatcacccacgtccatgccgccgggcacggcttcacctaccagaagccggaggtggtcaacggcttcatccacggatgatcgaggatgtgctggttgtggtatggcggcacgcaccaaggcctcttcccatcacagcgcctcctgcggagcaaccctgcacggagaatccgattgcaaactttgtgtgtattccgccgttggcgaataccacgctgctgggaaccccaagctgcagaaaacgcttgcccctgctgctctgagaacctcacaagtcgcgtgcacattgcaactggtcaatcagagcagtgaggagacgagacaggaagagcatatttgaggacaggggacggtgtcggctcggcacaaacacatccccgctcaggtctcgtctagacaactatactgcctgccgtgaaggtcgccaactccggggggcatggactgtgaggggggcacctcttctcaataaggaatccatacaccgggcctgcacaaggcatgccagtgaggatgctgctgaagctcaatacatcgaacagtgtgtgtaggcaacagcatgtccttccccaccgtttcctccagttagcttccctcctcctaccgagcagctgcaaacttgtccatgcacagcacctccttctctatttggcgcacgccatcgccgcgccctgttttcattctaggtacaaacccagcaaaggcaaaggccatgcgtcggccctccagggcttccctccagcgctcggaccccaggatcgtcgattggatggcacgggaggtgcaggccagtctgcacaggtccagcgcctgtgccagaatttggattgggcttgaggatcccgggtgggtggggggaaggggggagggcagcataaaaggtgctttgagtggcagctgtcctgccgtcaagcaacccaagagaggcagaatcatcctacaatcaggggctgagcagatctcctacctcggtagatacaacgagtagagcnnnnnnnnnngaaaggtgctttgagtggcagctgtcctgtcgtcaagcaacccaagcgaggcaaaatcatcctacaatcaggggctgagcagatttcctacctcggtagatacaacgagtagagcatgcactttcccccccacagcgaacctcgagctgggtcatcagtgggaggactgatgtcagttgcagtccactgaggcaggtgaggggctctccgccggccagcctcagtccggtgagtcgggccggcgagaccacgtggtccaccacctggttccaggcttccctcagcaccgccttatcttgtgccagaaagggcgtcaggccggaaagcgagagaagggtcgtcttgaacactgggccgttgttgacgcagacggccaacagggtggcagtnnnnnnnnnnatggtccaccacctggttccaggctttcctcagcaccgccttatcttgtgccggaaagggggtcaggccgggaagcgagagaagggtcgtcttgaacacagggccgtcgttgacgcagacggccaacagggtggcagtgcccatacggctgaagactgcacgacagaccacggcagacgcctgtattgtcgcctgatactccatgcggggcacagaagttgaccctggtgagtagggtaggcgcctagggtcgccctgccacatgggacgccacccgccctccaggaaagccgcgtgccccaacagcaccaccctcgacagcgggtcccggtgggcatctggggaggagttggcacgcctgacctcctccaaacacagttcagggggccagaacgggcatgcaggttcagtagcgggagcctgcagggtggcacatcgtccaagagggaggctgggtggctcatcaagcagagatctgcgcacacccttccggaatattgaatctgannnnnnnnnnaggagcctgcagggtggcacattgtccaagagggaggcagggcggctcatcaagcagagatccgcgcacacccttccggaatattgaatctgaacggctcaagaatttgtaatctgacaggctcatttcaacggtaaataaagattagtccagattcagaggcaccacaacaatgccacgacacgccacaggacctcgtccagcgcttaccatcctgctgtgagatgcctgggcagatggattcccgcctgtcagacaagtatttcgggtgtatggagaagcttattctgccacagattctacataatcnnnnnnnnnnnnnnnnnnnnnnnnnnnnnnnnnnnnnnnnnnnnnnnnnnnnnnnnnnnnnataacacaactgtatcttgctccatccagccacccaccagcccatgcggctgcattgttcgtcagaacgtaaaccaggtctccatgccggagtccgatggactccagcgtcgctaagggctgaccatccagggcattctgcaactcggttgaaacttacaacagtgcttgcaaatcgaaggtggacgagtctgagaagcaagagaagtcctnnnnnnnnnnggggctgaccatccagggcattctgcaacttggttgaaacttacgacattgcttgcacatcgaagttggacgagtctgagaagcaagagaagtcctcttccaccatgtttgaaactcacggacgcattacctttttgtctagcgagaattttgcatcctcatgggtgatgtaatcaggaacaacaggatgtgcgacgacctgggcgacgagatccccgcaggtgctgacgttgtccaacttcagcgtccctagccctgccggcaatcggactcggatcttcattacttggctttgagttgcatgtcttcatgctattgacgcatttacaaagtgtgcacaaggctttgtcgcagtgatcggccctgggcttgtgtcgaggatggatcactttgtgcccaccgcagcatgcccctcacacagcccgtcatctcgaccgagctttatctccatcccaccacggcaatgcctccagcggccacgcacagaccgcgcaacggtagttttatattctttttggagcaaactataccgccatgcagctggtatcttcgttcaccgggcggggcttcatcttcggcgtggcgccatccccgccccggctccaggcctctcgccaggtcacatgcatggccaagaagaagggcacccgcatcattgtcactctagagtgcacagaagctcggggagagggcaagacgccctcccggtacaccacgcaaaaggttcgaagggggctctggggtggcgtgggggaatacaagccagtcaggctcaatgtgcccggtcaagtcttgcgcgggtaaacatgctgagcagtagtctcgcaccctcttcccggcagaataagcgcaacacccccgagcggctggagatcatgaagtacaaccggttcctgcggcggcacacccttcacaaagaggtaagggtgtatcagttaattggggggtgggggtggggggggaggaagaggtgataggactacaaggttggtgcgtcacgcacagnnnnnnnnnngggggggggggggaggggggggaggaaaaggtgagaggactacaaggttggtgcgtcacgcacagggttggtatctggagttgccaagtcgtgcgatgtctgcttccacgtgctctgcctccagaaattggtcccatcacattccccccgcagatcaagtgagcagcagacttccatgatctccccctctgcatcgcttgcccccttggtaaccccacgcttgtaaggcgacactctgtacaggcccagcgatcaagaaggggtgtgatgaaagggtggccatgtgggaacgcagggggagggaggagcatccggtccgcagtcgtcctccacgccggcgggcagcacggccacggctcatcgacgccccgcgctggagtgggcctccctcgctcctctccccatcgccgcccccacccgccgcacacgccccgctcgccccaaaccatccaccttcaaacgcccttctgcttgaggatgagcttgtcgcccagggacagcgcgatgccctgggtcttggaccggatgcggacgaagccggcgaggcgaccgtccgcgccccgctccagcgcgacgttgaccagcgcgtcctcaccaaacacggagcgcgcgtacaggtttgcggccaggaacccggcgtcgccgcgccgcgcggaggccggggtcaggcaccgcatgttggtggcggccaacacgtggtccaggtaggccgcctcgtcggtgagggaggtggccaccgccaccttgttctcccactcgaactcggcccacatggcgcggaaggccgcgtcggtgcaggccgccggcacgatgtagtcgaggatgtcgatgtggatgtcgttcagcaccaccacgctggggtggggcatggagtgggtcgtgatggtcgatggaggggaagagggcgccactgaacgcgtggatggaacggcccctgtggccgggcatcgacaccacgcgagcctgtaccgaagcatccgcccaggaatccttgccccagcatcggccaggagctccctctctccccccccaaagcccctcatctcgccgtctgccccccaaccccccaac

SEQ ID NO: 35315 - DNA, 152 bp, Chlorella protothecoides
ctgggggcctggcgagtcgctgccagcctcacatgtcgtggagcgcctcctgtcgactggttgtctttagcacacatctcaacacagcagcacaatggaattttcctgacaaccccccacttccccttctgccctcctcacacaccgtccat

SEQ ID NO: 35316 - DNA, 65 bp, Chlorella protothecoides
cggacgacgataggatgctgattagatttgcttgtcctcatcaataatctcctggtgccgaaccc

SEQ ID NO: 35317 - DNA, 67 bp, Chlorella protothecoides
gtcacggtctcgtggccttgggcagctgtggcacatacacgtggcgatggcatgcctgactgggtgg

SEQ ID NO: 35318 - DNA, 123 bp, Chlorella protothecoides
gctcgtgacgctgctgaaccagtccggggcagggaaggtcaccgaggcgaatgcgggcgctgtggtgagtgttggggtcaggggtcgcatgccgcctgcattgccagcaccccatgccagggt

SEQ ID NO: 35319 - DNA, 95 bp, Chlorella protothecoides
ctgaaggcgtacaagcccaacaccccaggtacggagggccccttgtaagcttgaggacactctcttgtcagcccacggcattcttgcccacgcac

SEQ ID NO: 35320 - DNA, 67 bp, Chlorella protothecoides
atcatcgggggatctcatgcgacgccaggctgcctgtttgagggatgaaatcggtagtccctgccca

SEQ ID NO: 35321 - DNA, 155 bp, Chlorella protothecoides
gaacatcccccatgtgcccggcaaggtctcaagactcgcattcgggccagtatcaggccttcaccccctcccccctcccctgctccgccccttacatcgtgtatcctccagctcccagacactgagactgggctcaggcctctcctccaaggcgg

SEQ ID NO: 35322 - DNA, 61 bp, Chlorella protothecoides
ctcttggtctcatccctgacctcctcctttacttacagggcggagccccgccaggcatgca

SEQ ID NO: 35323 - DNA, 104 bp, Chlorella protothecoides
gcgccccgtacctgacacctcttcccctccgcgatctgaaacaatgttcatccctctggaaatgtgcagggtccacgaccggaattggctatggcatcatcaag

SEQ ID NO: 35324 - DNA, 439 bp, Chlorella protothecoides
  modified_base (197)..(324): a, c, t, g, unknown or other
ccctgcctccgctgcatggccgtccgggtaccgcgtgagcgaggcgatgctgctgaattcgagcagtcccgcccctgcagggctcgctgggcagcgcccgaccggccagagtccacggcgtgacgtccctgtcacactcacctcaaccccgtggcaggtgccgagggctgcgccgtgcagcgctggttctgcgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaccgtgcctgtaccctgtgcgcagcagcggcccccacggccccgcccaggtcgccgtgacccagggcatcagggtgcacgcatccgtgctcttcctccccgagtactgcagc

SEQ ID NO: 35325 - DNA, 5453 bp, Chlorella protothecoides
  modified_base (406)..(415): a, c, t, g, unknown or other
  modified_base (818)..(827): a, c, t, g, unknown or other
  modified_base (1010)..(1019): a, c, t, g, unknown or other
  modified_base (1834)..(1843): a, c, t, g, unknown or other
  modified_base (2117)..(2126): a, c, t, g, unknown or other
  modified_base (4021)..(4030): a, c, t, g, unknown or other
  modified_base (4393)..(4402): a, c, t, g, unknown or other
gcggtcgctggcccggccagcgccgcgcagcgcctgtttggcgcgcacgcgccgctggtggccaccagcccgcgctcgttctccacgccgctgaccgccacgcccgtcgaccgcgcggcctccgcgccgggcggcggcgccctgcacagcaaggtgcgatggccccgggatgttggatgcttgggttgaggcaattcctgggggcagggttccgcctgagatcgtgctcccgggtccagggcagagggtggtggcacgctgtctggtgtctgaccgagcggacgtgtcaatgccacccgcctgcgccgcactcgccgtcgcgctcccaaggcaggccggtgactggcaattccagttgctgcttcacttcgtgcaaaccccctgggcaccatccccttgcagcagnnnnnnnnnncgacgggcaattccagttgctgcttcacttcatgcgaaccccctgggcaccatccccttgcagcagccgcaacagcgcctggactcggcgcccgggctggagtcgcctgggctggacgactttgcacacatgggcctgatcaacgacctgctggagtgatggctggtgcacgcggcgtgcaacgtagccctggtgcctgcttcccacgatgccagcagcgcccttgagccgtgcccccccttccctgtgaccctgccgcaagcttgctccctggatcagcagcctgtaccccccagctcgcccgtgtgtaacgctagcgacccggatgggtatatgggctagagtgggggccgaggggagagctgggcaccagcatctcctaccgaaagatggctggcgatgnnnnnnnnnnggcgacccggatggggatatgggctagagtggggggcgaggggagagctgggcgagtgcatctcctaccgaaagatggctggcgatgcccaccagcgaggctccactctcatgggcagcgcagggcaattgcgcccctctaacaccatctcgagcaccctctcgttcagacacgaggcttgcnnnnnnnnnnccatgggcagcgcagggcaattgggcccctcttacaccatctcaagcaccctctcgttcagacacgaggcttgccaatagtaatccagaaagttcatgggccaacatgtctgctcgagaggcgaggacctccagcgaggcctgcaacgaagttggtgcccctggccagcattgtttcccaacacgccgatgcaacctccacaacacacaagatccagccaatccccagcccgctgtcagcatactggcacacagcgcgagcaggggtcggatgttacagcaggtgcgagggaagtggatcacttcttgaccttgcgcagcagggtggacatctcctccctcttccgcttggcacgcaggtgggtgccgagctgcaggggggtggagggggaagtgtgaggcacgagtgacctgcaggtgacacccggtggctggagcaccccagcctacgcaacaatccagcgtacgcaaccccctagcctgcgcaaatccccagcctgcgcaaaccctccaccctccctggcactcccgtccgtcgtcctgctcaccttgcgcttgcagagcttgagggcgcgcttgtccttgcccaccttcagcagctccatgacgcgcttctcgtagggggcctggccggcaacctccttgatgatgtcgcgcacaaactttacacgcttggaggcacgctgtggggaaggggaggagtgcagggtggagtgagaattcaatgcctggacccgcagagggctgcgcccgttcgtgtgtctggcgacacagcgcagactgtaaaacgacactgtggcatcgcctgcgattcgnnnnnnnnnnagggaggagtgcagggtggagtgagaatccaatgccaggacccgcagagggctgcgcccgtttgtgtgtctggcgacacagcgcagactataaacgacactgtggcatcgcctgcgattcgccggggtggcagcgtcaggcgtgctgctgagcccaggatgccagtgcacccctgccggtcagagcgctgccggagcatcgctgtattctacgcgcaggtatgcgtaaggacatgcgccaggctgcctcaggtgggacccaacgcgaccaggcnnnnnnnnnncgctatattttacgcgcaggtatgcgtaagaatatgcgccagattgcctcaggtgggacccaacgcgaccaggccagcccctctcccgggccttgcagctcacccccttgcgctcagcgggccgggcgaccttctcgcgcttggtgacgacatggcccttggccaagccgactgcgattcctgccttcgccatgctgacaggaagtctctgccaaagaggcaccttgagaccgtgggcggtgtgaaggcagttcgccgcccgatgccgtactttctatttgggccccttcggaggggggaggggagggtgtccgagcgaggggggcgctaccattgtcgtccccgggaccctccgctcaccctctttctaaagggcccaagtgggaaagtaggcttggaaagcccggccgttctaaaaggaatagcattcgtttccacgaatgcgagctgtctgaggtctgcttaaagccggaagcagcttcacgaccagcttcgactgtgagctcacccacgtcgaggccacctttacaggccctcgggaggcgtcagagcgttcccggacctcaccagaggagggaatgacggacgagcacggcggtgcgacagatgacccgtcacgcgggccggaggcctaccatcccatgatgcaggcgctgggcaccctcacgaacttggctcatctgataaccggatcgggcaggggtccaggcggggaggagctgcaccagggcgagggtgcacaggacgatgtttccgtcaagcggcaggccggtgcgtggcatggcctgcgtcctcgggcagtcacattttcgaatttgccgttggagagtgcatcgtttggggtggtgggcaggtgtccctcgccccagcctgccccttgtttggtagcgagcatggtcaggcccagtaaacttcgaaacccacccccctcacccctccccgtggtgcccacagaagaggagaacttcgtcgaggagaagcgacggcgcgtcgtgggcgcagacgacctggcagcgcacaatgggtcccacatgcacctccacatgcaacagtctggggaccagggtggggtgtctgagatgcagcagcagcagcagcagcagcagcacctgcaggcctacgccatgcacatgtctggcgcgcacgacggcagcggcggccccacctcggaggagctggcggccgccgggctttcctcctccggcctgggcctgtcccactccatttttggcggcgcgtcgcacctgctgccccacctctcgcagctgggccccccggggtccaaccccggcggacccgccggccccggtaacgccatggccctgctcccgggcctgggcttgggtgcactgccgccagggacaagccccgaggccctgctggccttgcacaacgcccagatcgcggcgctgcaggcgcacggcggcgcggggcagatgggcctgagcgcagagatgctggcggccgccgcgtccggcggtttcgccatggccggtggcgagcacggccaattcccgaccctgggcccggacatgcagcccatggggctggaccccgcgaccctggcggcggtggcgggggcccagggcggccagatggccatcccgctcgacttcctgagcctgccgcacctctccccggagctgctgcagtccatccaggccggcaacctgcccttcaacatgctgcccgcggggtacggcatggcccccatgggcagccccacggagcagcaacccaccgccgacccaaacatggtgtacaagaactggtgggacgaggaggacgagaaggtgagggcagccatgtggccggctgacggtgttgtgcggggggggggtacatgggattagaggtagcgagggcagatggaggcgtgtgcattcgctgggtgnnnnnnnnnnaatgtggccggctgacgttgttgtgcgtcgggggtacatgggaatagaggtggcgagtgcagatggaggcgtgtgcattcgctgggtgtctgcagtctgtgaccagcgagaggaagcctgtggagcaggtgactcaggtctgagcttgagcagtgaaatccgaactcgggtcgagtctcagagggggccctgcgatcaccaatgatggccagggcacaccagctccctgttgatggccagtcgtggaagggctccaggaggagtcggccacaccctgttccctgaaatgctcccctcctcctcgtcctccccaggagctgctgaggtttgtgggggatggcgagtaccgccgcctgaagctgnnnnnnnnnngccctgttccctgaattgccccccccccccctccgtcctccccaggagctgctgaggtttgttggggatggcgagtaccgccgcctgaagctgggcagcgaggagttggactggcaggcgctggaggcccacttccggcgctcccagaacgcgctgcgcaagaagtactggatgctgagcaaggcgcccatgccggggacgatggaggccacgcccaagcagcgcgccgagcgcaagaactggacggaggaggagaccgcggagctgaagcggctggtagccgcgcagtcgggcgcggatggggagtccgtggactgggagaagctggcggcgcactttggcaccagcgtgcagacggtgaagcgcaagcaccggcacgcccaggagcacctgagcctggcctcgggcaccccggcatccacggagaagggtgcgtggcggttgtgccgtgctttcttacttggggaacccgtgtggtggagggggcccgaggggacgggcgtgcggatgaggtcatgcgtgcctgggcgctgctttgatggtggggaggcgtgcctgcctggcgctcacgtggtggaccagccccctccgctgaggggagcggttgtgctctgccgccagcctcccatgtccgtcctggcagtgtttggagcactgcaaccatgcctcaccctccgccatcctggaccctccccagccctccctcaaaacccacccctgcagcaggcaagcgccagcaccaccgcaagaatgtgccgtaccgatggatgatcgtgtatgcgctgagccagctgcccggcctggagggcacggcgctgcagattttcgacgtcatcgagggctacgccccctttgtcgaccagctggatacgcgcatcatgccggggacaaagcacgtgcccaggtgtgcaccgcaaggtttggagacggtcgtcggcacgtgaggcgagcgccggctcgccgggggctgcctgatgcggagggcctcgtgcctggccgctgtggctgaccccgacacccggttcctccccctccaccccccactcccccc

SEQ ID NO: 35326 - DNA, 114 bp, Chlorella protothecoides
agggaccagcttctgggcgctggcctcgctcaatgtcgccatggccacggtgctaaagaacctgaccaacctcttcacgctggcgggggactacgtgctgcacgggcgcaccta

SEQ ID NO: 35327 - DNA, 124 bp, Chlorella protothecoides
ataccttagagagagccgagatgcctgtgtcagtactccctgccttcgcatcaatgccaggtcctcagatctccaatcctcgacatgaccccctcacactatctcccgacaaccccccaaaccc

SEQ ID NO: 35328 - DNA, 61 bp, Chlorella protothecoides
aggacggccgcggcgcgccgggcgacgctgacgaggacgacgctgacgaggacatgctcct

SEQ ID NO: 35329 - DNA, 61 bp, Chlorella protothecoides
ctcggccaggcgcgcggcgtgcccgcgctcaaactcggcctccgccgccgccttggccgcc

SEQ ID NO: 35330 - DNA, 76 bp, Chlorella protothecoides
gggcttgggtcagaggctcagaggttatggcaagtatcccgctcaaccacatacaacttgtaacccatgcatgact

SEQ ID NO: 35331 - DNA, 65 bp, Chlorella protothecoides
agaatcactgaaaccctccccaccctccaccacgtcgctccagttcaaggatgaccagctatcaa

SEQ ID NO: 35332 - DNA, 78 bp, Chlorella protothecoides
gttacaccacccatccacccttgcgcccttccacacacacacacacaccccggctgcacatctgtcggcagggctttg

SEQ ID NO: 35333 - DNA, 68 bp, Chlorella protothecoides
gttgatgcccgggctcgggatcgcaggacaaggaagtgggagtctcggccacgaacatggcgccgcac

SEQ ID NO: 35334 - DNA, 61 bp, Chlorella protothecoides
catgtgcagacccgggcttggggaggtcctggggactgtagctggtccaacatgctcgcga

SEQ ID NO: 35335 - DNA, 79 bp, Chlorella protothecoides
gaactcgctggggcccttgcccgggatgggtaggatccagtgggcgacacggggtccaaagtcgcgggcggggttggcg

SEQ ID NO: 35336 - DNA, 69 bp, Chlorella protothecoides
taggatcgtgcagtctgtgcaagggcccgaccatgcatatcccatgtcgaacctcgtcatgcgcgagtg

SEQ ID NO: 35337 - DNA, 76 bp, Chlorella protothecoides
cctggccaaagggtgcaccagcaagcagtatgggcatgcacattggcctgtggcagcgactgaagtagagacaagg

SEQ ID NO: 35338 - DNA, 12852 bp, Chlorella protothecoides
  modified_base (208)..(217): a, c, t, g, unknown or other
  modified_base (714)..(723): a, c, t, g, unknown or other
  modified_base (1080)..(1089): a, c, t, g, unknown or other
  modified_base (2254)..(2263): a, c, t, g, unknown or other
  modified_base (2647)..(2656): a, c, t, g, unknown or other
  modified_base (3499)..(3508): a, c, t, g, unknown or other
  modified_base (4564)..(4573): a, c, t, g, unknown or other
  modified_base (4745)..(4754): a, c, t, g, unknown or other
  modified_base (4918)..(4927): a, c, t, g, unknown or other
  modified_base (5282)..(5291): a, c, t, g, unknown or other
  modified_base (5868)..(5877): a, c, t, g, unknown or other
  modified_base (6623)..(6633): a, c, t, g, unknown or other
  modified_base (6920)..(6929): a, c, t, g, unknown or other
  modified_base (7578)..(7587): a, c, t, g, unknown or other
  modified_base (9354)..(9363): a, c, t, g, unknown or other
  modified_base (10508)..(10517): a, c, t, g, unknown or other
  modified_base (11053)..(11062): a, c, t, g, unknown or other
  modified_base (12152)..(12161): a, c, t, g, unknown or other
  modified_base (12276)..(12285): a, c, t, g, unknown or other
gcggagagtgtagtggtgcaggccagggggatgtaggctgcacgagccttgcgatgggaatgtgatgaatacattgatttggatgctggacgccgctccaccaccccacaaacactgtttcccctacgagtccaccacaccctctcacgcactgacctcagcacttgaataccccactccacagatcttcagccacgtggcgacgggnnnnnnnnnngtgtaggctgcacgagtcttgcgatgggaatgcgacgaatacattgattccgacgctggacgccgctccaccaccccacaatcactgtttcccctactagtccaccacaccctctcactcactgacctcagcacttgaatactccaatccacagatcttcagccacgtggcgacggggttcaccgacggcaacccctacctgcgggagctgacgctgaagagcatggttatcctggggcccaagctgagccagaagacgctcaaccaggtcctgctcaagcacctggccaagctgcaggtggggtgtctcggtgtggggtggaaagggcggaggcgagcatcgcgctttggtgatgatcaggggtcccgcccagtggcacatcgtcagggtcttgagtttctcgacccgcatcagccctctgcaatgtcctgcccccaacccactcccctgccctggtaaaccttcccgcccacacccctgccatctctcacccctnnnnnnnnnngtcgtcagggtcttgagttcctcgacccgcatcggccctctgcaatgtctcgcccccaacccactcccctgccctggtaacccttaccgcccacacccctgccatctctcacccctccccacctgttttatccgtcccttccaggtggacgaggagccctccatccgggccaacaccacggtcctgctgggcacgctggccactcacctgtccgaggcgacgtgccgcaaggtgctgctcaacgccttcacgcgcgcgctgcgggacgggttcccgcctgcccgtgcggcagggctcagggtgaggagaaggtggatgggagccgtgtggaatgtaggtatgaggggggaggcagtnnnnnnnnnntccgcccgcccgtgcggcagggctcagggtgaggtgaaggtggatgggagccaggtggaatgtaggtatgaggggggaggcagtgcagaggagtcgggcagggcatgtcagcctgcggatgccctatcacagcgcagccctgacccacccactcctccgcaatccccccaggccatcatcgccacggccaagttccactcgccggaggacgcggccaccaggatcctgcccgccattggccccttgtgcatcgaccccgtggccgaggcgcgtggagggggagggcgaggaaaggcattccaacagccggttgttcccccatgccgcaatggggggtatgacgagcgcccggccctttccctgaaacataccttttctcacccccccccaaagtccccctttccatcaaacccctcccaccaccaataggttcgtgcctcggccctggactgcctggagcacttttctgcggtgctcaaggcccaccagcaggatctgacggcccgagcggaggccagcacggcgaccggcggcggccccaccgcctcctcctccggcgccggcagcgccacggctggcgggggccggatgacttccctgggctgggccgcctccagcctgggcctggccagggccggcgcagcgtcccctgtccccaccgcggcgggtggatcgggccaagtgggaggcccggcggcgggtggatcgggccaagtgggaggcccggcggcgggtggatcgggaagtggggccggggcgcgcgctgcgccggcgggccccacgccatccgagcggccgcgaagctcggcagcgcccccctcgccgcccgacacctcggcctccgcaagatctcagcagccgctgggagcagacgagggctgggacgaggacgacgccgatggcctggcggagcatggtgggtggcgcaaaagtgtgtgtctgttggggagcggaagggggagtttggccgcttctgcgttccaggttggctgcctggcgctcgcatcaccagggactggcgctcaccgccgcgacctgcccggtgcagaggaggagctggcggcccggcgacggctcgccagcgccagcctgcgccccgcgccgcgcgcgcccgtgcaggcaaagccgcggggtccgccgagccacgtggcggccccggcccccnnnnnnnnnnttgcgccctgcgccccgcgcgcccgtgcaggcaaagccgaggggcccgccgagccacgtggcggccccggccccctccagcggcgacgactggttcgaccagcccgccgcgggggccgcgccccggccgcgcgccgcgcttgcgccccggagggcagcggggacggcggctgcggcgccacgcaggtcgggggcggggggaggcatgaagctgggggtgtccaagctggcctctgacgccaagcccgccgactttgacgagtggtgaatcgctgcatggaattgttgaaacccgaacctggcgatgagaggagcaggggatgattgggtgaggtcctgtcgccagggttgtgtgtcctcctgagccatccggccacgcgggtgnnnnnnnnnngccctgcatggcgttgttgaaacccgaacttggcgatgagaggagcaggggatgattgggtgacgtcctgtcgccagggttgtgtgcaggggcatgggtcctcctgagccatccggccacgcgggtggtggttccgacataatccaccatgcggcaagactcgctccacaatcgccgcactctgagccctcgaggcgccgttaactcttgaaacctccgagactcctgttcggacttggagcgaggcccacaaccgccccaccctcccccacctcgactttcggaggcccgaccacccgccctgccctcgggtatagcagggcaccgcccccggggcccggcccccggccctcagcatggcaaaatccccggagaagaagaagtttgcacacgagctgctgcacctgtccttcaaccaggatcagggttgtttcgcggtgggcaccagcaacggcttccgggtgcacaactgcgaacccttcaaggagacggtgcgccgggatgctcggcctgggccggcagcctttagggacagcgttcgtgggtgctgttccttctggggccgcgtccatgccggccaggattctgagggggggaatggggagggtgcacacaggaagcaaggacatggtgcctgccaggaggggcaggtggcatcgtgctccgtcctcccactctgcaactcgttccatcccgaagctgcattgccggtggcatgctcacctctacctgaaggcctcgtcttggacagacacaagtcgcacagccccgcactcgccccaccaacccacgatgaacgtccgccatgcccgcgcagttccggcgggagttctccaacggcgnnnnnnnnnngccactctgcaactccttccatcccaaagccgcattgcccgtggctcacctctacctaaaggcctcgtcttggacagacacaagtcgcacagccccgcacttgccccacccacccgcgatgaatgtccgccacgcccacgcagttccggcgggagttctccaacggcggcatcggcatcgtggagatgctgttccgcagcaacatcctggccctggtggggggcgggcccctgccccgttacccgcccaacaaggtgatgctgtgggacgaccaccaggggcgctgcatcggcgagctctccttccgctcgcgcgtgcgccgcgtggccctgcgccgtgacctgctggccgtggccctggagcacaaggtcctggtctacgccttctccgacctgcgcctgaccgccagcgtggagaccgcggccaacgcgtcgggcctgctggcgctgtccaccggccccgacgccgcgctgctggcctgccccgggctgcacagcgggcaggtgcggctggaggcgtacgcgacgcggcgcacgcgcttcgtccaggcgcactctggcgcgctgggcgcgctgtgcctcacaccctcgggcaagcacctggccaccgcctcggagcgcggcacgctgctccgcgtctggagcaccgccgacggcacgcggctgcaggagctgcgccgcggcaccgacgccgcgcgcatccactccctggccttcagcggggggaggggggcactggccgccgcgcccccggagtggctggcggtcaccagcgaccgcggcaccgcgcacgtcttctccctgcgccgggggcagggcgtggggccggcgggggatcgggccgatggcggcggcggcgcgcagcagcagcagcagccggaggggagggccaaccccacctccaagctcgcctttgtcagcgtgagtcgggggctgggtgaagtgactcaaagtctgggcccggggtcctggtgggacttgcgcatgcaaatgccctgggctgcattcctgtggctcctcatgccggcgcagggctcgacaatgtacgtgctgcccnnnnnnnnnnttcaaagtctgggccaggggtcctggtgggacttgcgcacacaaatgctctgggctgcattcctgtggctccccatgccagcgcagggctcgacaatgtacgtgctgcccagtgcctcgttgccaactgggttcaacccaaacccctgcccacccctccctccgccatcagnnnnnnnnnnccgccaactgggtgcaacccacacccctgcccacccctccctccgccatcagtcgtacctgcccctcgccgcgggctacttctcctctgagcgctcctttgcccagttccaccttcccgacggagcgccgacagtagtggggtttgggcaggagccggggaccnnnnnnnnnnggagcgctcctttgcccagttccacctccccgacggcgcgccgaccgtagtggggtttgggcaggagccggggaccctgctcctgctctcctcctcgggcctcttctacaacctggtgttcgaccccctagtggggggggcctgcgagcaggtgtcctgcgtgcagttcatggaggaggccccacgccagggtgggggctattgaccctggggactgtggtttgaagggtggcccgacgggtgcctgcacagtgcctgggccccgccgctccgagccctttgcccctggggcctgtccttggtgcgtggcggtgctgaccccaaccagccgctgcacaccaagcgccggtgcacnnnnnnnnnntcgagccctttgcccgtggggcctattcttggtgtgtggcggtgctgaccccggccagccgctgcacaccaagcgccggtgcacttccatacatgcttgtgtacaacagctccccttattggggtggaggcaatgatgaccttgacacagcacggccgtgccacgcggacgttgctgcagtgtaagataagctacaggagcagctggtctgggacaaacgcgttcgcaaggaggatccctcgaatgaattcaaacaggtggatgctgcgtcaaggggcgtattccttccaggcgccgccgtgcgccagctggcagatgccgtcgatgtccagctccgcgctctggccccaccctttccatgccgggcggaagtgttcgtacagggggtagcacgccttgcccagctcggcctctggcacggctgacgccaggcgggccatcgcgtcctgtgagggcaaaggaggcggaaaaggagggtaccaacattgctgcagcgtatccttcttcatccaatgtgcatgctctgcttggccacagtctgcacaccttcgatcaaatgctttggacaccaccacannnnnnnnnntggaaaaggagggtaccaacattgctgcaacgtatccttcttcatccaatgtacatgctctgcttggcctcagtctgcacaacttcgatcaaatgctttggacaccaccacaacttatcctcaagggtccatccagggcagcaaccacccctacacgccaggccctgcgccaggtcagcatcctcaccttgacatcctccaggtggtccttaaaggcgtggctcaggtaggtctttgcggaggccggcgcgagggtgctgccctgactgaaggcgaggtggtgccgacccttcttcctcacagggatggacatgccaaaggcgtcgacatgctcgacacccatgttcctgtctcgctccctcctcgcctccctgtcctcctcggtcacaggagagtcgtggtacaagcccaggctcttccccttgctgtgagccagcactcccgctatgtacctggcatgattgggcgggttgtcatcatgagcctccaggtgcggacaaatgtacactccagcgtgagcaacagcctctttctcaaactcacttgccaatcgtcactgcctcgtcccaatgaaatccctgcttctctgccaccacagccgcccacaaggtgaggactggggcccgattaattttcagaggaggtctggagctcactgctgcagagtggatgtgtgattctggggcatgagcgagtagcaatgctctgacatccgaccagaatgctcctgccctcgtcctaaattnnnnnnnnnnngtgatagagccctcctggtgtcccccactccatcctcactctttgcatgagacgtagtctcggcctgcagtgggcatgcatgagtctcctggtggtggacattgttctgtggtaataccctgctaggatctgcaggatcactcagcagacatcctgcatggctcaaatggaattcctctctttaaagtcttccctgacatagttgggcatgcacaagatctcaccttgttgctcggggaggccttgtgagcatcagcttcctttgggtcgacgtcctccgtgtgatnnnnnnnnnncctcctggtggtgggcattgttctgtggtaataccctgctaggacctgcaggatcactcagcagacatcctgcgtggctcgatggaactcctcccttaaaagtcttccctaacattgttgggcatgcacaagatctcaccttagtgctcggggaggccttatgagcatcaacttcctttgggtcgacgtcctccgtgtgatcgtcaggttcagcctctgcctgcagcgaggcatgggaatttcgtcagcatcatgtcggtcccatgagcagccacatgccctggtttccgacacttgccttcacagctcgcgatgccttatctgcctcgtcggttggcggagccttgcgctttggcatcttgtttttgaaatttcatgtccgcatggacagggtaaggctttccacggacccgttactgcgcctcatgtatgttttgcatgtccgtgcggcgcatgccctgcaatggatctgaaagcagatcggacatggacactcccttggctgagcataaactgccgactgagggcacaggagcactattatgtaaacttgctgtgattcaccctcctaataaccatattgagctgtatgaggcaggacggcgctacgatttgactcgagcacttcttggacgccaggaagattgcnnnnnnnnnngtgctgtgattcaccctcctaacaaccatgttgagctgtatgaggcaggacggcgcacggtttgacacgagcacttcttggacgccaggaagattgcatagcccctgatcagtgcctggcacctccaggattctacacaagcttgcagcccagaattcctagtgccagcgtccttaataaatctcaaggtacaacttttcacaaggaatataacaggagttcgacggggccccctttacgtgggaaacatctgagtcgcacaatcggatcttgtgaagagatatgggaggcaagatattaacctgattggatggttgagacccttttcaaatcagcgaagaattgaaccacttcaggaactttagccagaaagtagtttcctagacaaaggatgacagaatcagagagctcggcctcggttggattgacttcagtgggggtgctgtcacgtaggggtgtatcttatctagaggggaggttcagtgtcgagtgtttaggtctcccgcagaacgcgcttgagagtaagataatgcaagggttccccacgcgaggccattgacactaataataccccgaccaaaagatatataaaatcttggagacccacagcgcatgggatacaatggcaagcttccccctccggcactgtctcgaggatcaccctgtgacgagctgaacagacagtcgccctcagccccgaggcatctcgccatcccctgcgcttgtcacactttggcctgaagtatcggagggagcctcgcagggataccgctccgtctcgcatgcagtctgggtacagacctccaggtaaccagcacgactgggatgcgcggccatgcctccgcggtgccaggaaccggctggggctagctccaggcgtgcagcgacggctcgccaagcactcaatccaccctccttggcgcaggagcaccccaactggtctgttcgtggtgccgcaccctgctgacctacccccaggcaagcctgcagcatgccctggccgcaaggcccagtgctgccatgattgcaacacagcacctgaatgcgtgactccgcccattgcccatgcagggcgctcaacatgtgcgctgtgcgtgctgccaccacatcaccgaggtcccgcgccagccccagccggcggccgggcccagctccgcgccgcaggccgcgcaggacatggcgcagctcacgtgcaccaacccgcggtgccgggtgacgctgacctacccgcggggcgcctcacaggtgcactgcgccatgtgcggcacgctcaacgacgccgcgcaggtggggccgggactggcggcaccaggggggtttgcctgtgtggtcaagggagacgggttctcacggatcggccagggtcccagctgtgccctgccccgaccctctctgcgccaatggtcgcttccagggtcctgcgccctggcatgccggcaggccctattcctctcagtgcagctggggatctacatcttcacacacgcacacacacacacacacacatccttatgtatcacaggccaacctgctgggccacatcgtgtgcggggggtgccagataaccctgtcgtacgcgtacggcgcttgctccgtgaagtgcgcggtgtgcaaccacgtgaccccggtccccggcgcgccggagccgtcggcgccacgcactcaggcggtgatcgtggaaaatccctcgtccgtcgacgaggcggggttcgaggtgcggcaggggaggaacatgtctgtgtaccccttgctctcgtggcgcagggnnnnnnnnnntgtggagaatccctcgtccgttgacgaggctgggttcgaggtgcggcaggggaggaacatgcctgtgtaccccttgctctcgtggcgcaggggagccattggcacgaggtgtgggttggggcgggggctgaggcgcagcccggcgtctgggaggccaccatgccagcccaccactcgagcctcgcatgccacgccccgcagatcccaaacatggcactgggagtcacgagcgaacgatcgcagcgcccctgatgcccgcctccccttgaacgacgttgaatgtacccaaaccgctgcagcatggtgcggggacaggtaaatatagcacttggaacatgtagaaaccccacttggcatatgcttaatctccattgccgcgatgagtctgtacagaggcgcagcgaataaggacaagtagcaaggcagaaaggtgtaccatggaaaagacatgtacatggcggcattcagcttccagtcatcgatggagtcttgtcgccgcggagctggtgcctctcaaggcagtcctgcattgttgcagcaagtatcggcctgtaaacatgtcgaggacgtgcatcgaccagtgccgatcctcctgcggtgcaaggagagggacgtgaggcaaagggaaaccagagggattaataaccctgacactcccgtgtccggcgcacgccccggatgggacacacctcatcctcctcctgagactctctggccttccgccgctccgaggtgcgcgagaatgcgactatgaagatggatcccgccagcagggcagacaccgcggcgaggacgacccgcatgggacagaccatggttgcaggggccgtgtaccagcccctgtacggcgcgtttcaagctcgaggtacccagcacggtgcgagcgattttctttactctgctgaatataaattgtgggtgaaccgagcttggcaagtactcttggtggccagggatgatgtcaatctggcttggctggcctgggtaaccggcttccggtcgcacgtgagcgaatttgtttgcgccctgagcagaatttaaagcaacagctcctgaagtgtcgccggacgatggcacgcgtggcgagacaggctcactggtcgttgcggtgccatggttgccttgtgcaagggccatggaatgcnnnnnnnnnnattgcgagacaggctcactggtcgttgttgtgacttggttgccttgtgcaagggccatggaatgcatccttcctgcacaggtcttatttctggcctgcaagtgctcacgtccgtgacggcatgtggaggtgcgctccctccaccacactcgcatgccaaacagctggcatgccctctccattgcctatcaatcctcctcctccctgtcacgaggggcattgttgttacatggggctgcagcacggttcaggacccgtaccggtgtctgtgaaggggtgctggcatgctgcgccgcgcctccgaccaggactgctcgacctgtgggacgaggaacgagcaagtgctgtgaggacggggtgggaggaggccagctccctggcacagccgctgcggcatcctgccacccaggctgacgtgctctgtatcaggccaccacacgctgcacattcagatacccaccccccctccgtactcaccaccaggaggtcagagggcgaaacaaaggtcaagtccaggaggatgtcgctgctctgcannnnnnnnnntaccacacgctgcatgttcagatacccacccaccctccgtactcaccacgaggaggtcagagggcgaaacaaagatcaagtccaggaggatgtcgctgctctgcagcaggcgatggtttgaccccggagggcgggggggcgggggccccggcgcgcgcctccagcgcttgggctccggggtcgggggcttgcgcgggtccagcacgcacaccttggggtatcgtggtggggggcggaatgtggccggagatcacgaggtgacggtgggtgtgctgtgagcgcacggaaagagtccagccccaggaactctcgggaaggagtgggcatgcatcccgttgccccatgcgctggccaccagcaatcatgatcacttccccaccaccaacacacgccggctcaccccggtgctggagtgcaggaggaagacggagggcagggtggggtgggcagacacgccctgcaagccaccccccagctgctgcagcgccgccttcagcgccttcctgccgtgctcctcccccgggacgacctccccgccgggcacgctgtgcatgcacacctcgccgctcagcgagagactgagcagggtagaggagtcgcaggagaaggcgaggcccacgatcggcgcgccggcctcgcccgacgagacgggggccggcgccaccagctcgccgcgcgccacgttgatcagctggatgcgccgccggaaggtgagcgccaggaacctgccgggagttagaggggtgggttggggggggccatggaaggctggcggccgcagggtgtgggcgacatggcgacgggcggcgacagtccagctgcaggtatcaggtgtcgcgtccagcccaacacgcaggagagggtggcacctcgccctcccgcctggcaggttggtgcagtgtcccatcctcccaacagtcggtgcacgagctgcctgcaacatctggtcgtccctccccaccggatttgccctctttcatccaggacagcgttcgccccaacctccctggacccgccccaggcaggctctgcgtgccacccaccccctccggctcaataaaacgctctcgcacctcccgtcggggctggnnnnnnnnnnagagaaggtggcacctcgccctcccgcctggcagggtggcgcagtgtcccatcctcccaacactcggtgcacgggctgcctgcgacatctggtcgtccctccccaccggatttgnnnnnnnnnntctctgcgtgccacccaccccctccggctcgacgaaacgctctcgcacctcccgtcggggctggcgaccaggtgttgcgccaccggctccagagcccgggccgcgctcagctggcgctcgcgcatggaccaggggcggtggcggagatcgtgcacggcgcgcacggcgcggactgccgacggggtcgacgccagatcgacgaggtgcaggctgccgtccaggctcacgctggccaacgtggcggtgccggggacaaaggccagcaggtgcgcggcgggcagcgccgcgggcagggggatgggggcaaagcccgcgcgcggcgcggcggcctcgggccctggtgcagcgctgcccacgcgcaggcatacggtccgctgcgcatccgagaaggccagcagcgcgccgtcggaggagagcgcggcagcgcgcacgtggcgccctgccggcgtgctgatgctggccagacgctccgggccgggggcgaggccgggatctgcgtcgggcgcggcccggggcagggcccagaggtcgaggtcgccgcgcagcgcgcacaccgccagcgctgcc

SEQ ID NO: 35339 - DNA, 65 bp, Chlorella protothecoides
gctcgcagctttgcagctgcactcatcataggggcctccagacggtccctgaaagtccttcaacg

SEQ ID NO: 35340 - DNA, 115 bp, Chlorella protothecoides
cctcggcccgccagtccgagacggggcatgagctcccgtcgatccaagcatgatggacgtgcaggcgacggggttctggagggcccagggagctcggagcggggaagtgcgcacc

SEQ ID NO: 35341 - DNA, 78 bp, Chlorella protothecoides
gggtgcatcgcgcctgaaatggtgggggtgggaaggttgaaaagggggggttgggatgatctggcaagcgggatcttg

SEQ ID NO: 35342 - DNA, 133 bp, Chlorella protothecoides
agactgcacgcccgggatgagaagaggtgtcggggggtggcacgtgacatgcatgggaaaggaaacgtggaccgtgtttccactctttctcatctacaccagcccggccagccttggcccaacagtctccaac

SEQ ID NO: 35343 - DNA, 66 bp, Chlorella protothecoides
atctagattacaagccagacgacctggcattagggtttgaaaacacacggtgacccaggccaaagc

SEQ ID NO: 35344 - DNA, 77 bp, Chlorella protothecoides
cgggctacgcctgggcggagtggctgcgcgtggaagtcctggatcaaatgggcgcggggtccggggcgctcaggctg

SEQ ID NO: 35345 - DNA, 32313 bp, Chlorella protothecoides
  modified_base (122)..(170): a, c, t, g, unknown or other
  modified_base (25301)..(25341): a, c, t, g, unknown or other
cccccccctccatgccctctctccctccctgttttatacaggcaagcgcgcgttctggaagctggccctgggctcgcccgtcaagtgctgggcctccatcggccactggctactctggcacnnnnnnnnnnnnnnnnnnnnnnnnnnnnnnnnnnnnnnnnnnnnnnnnncagcaagttcaccgccaagcagatgccgcgcgtgctggtctcatgggcggcggtggccgcctttgccgggttggccctccccgcgctggtcgccaccacgggctgggcggggctggtcaagtactggctcatgccctggctgggctatcacttctggatgagcaccttcacgctggtgcaccacaccgcgcagcacatccccttcaagcccgcggagagctggaatgcggcccaggcccagctggcgggcacggtgcactgcgactacccctggctggtggagttcctgtgccacgacatctcggtgcacgtccctcaccacgtgaactccaagatcccatggtacaacctgcgcgccgccaacgagtccctgcgagccaactggggccagtacatgaccgaggcgcggttcaactggcgcatgatgaagaacatcttcaccgagctgcacgagtacgacgaggccaacaactaccggccctttgacgccaaagcggagaggcccgacgccttcctggaggcccagcgcaagctgctgccggacagcatgtgaaggaggggagaggagtctgggagggcgctgtgcagtccacagcagagcaatggtgagcggggatacgcagcggcgcccaacctggggcgactgccgcctggcggggtggcgcatggcccaggatctcgcccagggccccagaagctgtccgaggcgataacggaacctggcggctgcatcctcccccgtgccccacgctaccccagcccccaacacaaagctctcttcattacggggatttgtttccccagcccccttcatattatttgtataaagtattcatttcgtttcctggagcgtctgggggtgggctgtggcgtttgcggcagagtgcttgctggggtgtcccaccccgtcagccccttgccagggtgcgtcttccggacacgcctcgccttcccctgcacctttatccaagcactggctttcactttgcttgatccccgactccctgaggaggcgggactgtacacagagcacacctggcatgtgatgggaggggaatgggcgaaaggggcaatccacttctgagccaagacacaggccccagcgttgatcacccacagcatgggatgctctgttccctgtgtgttcaccaagagacactctccaaagctctccttcacactggttgatcaggcagtgcctgccctcacccttccgcgccgaggacctggcgcccggcccacgtctccccgggcttcaaaacaacagggtcccgcgcggcatgcgccacctcgatgcacaagaaaccgtgccagtcgctgaggtccgccatgcccgaggccttggccccatccgggttccacaccacgacgtcggggaagccctgcttggccagtgtcagggtgcggcggccatcagccccatcctccaggaccagccggtcgggggcctggacatacagcctgtccacctggcagggggaaggattggtggggagggtgatgggcagcttggacggccagaccgctcgggatagcatgtgcaccagcagccctgatgggccacacggcgaaccggcggggggtgtagggattgtccagctgagggcttgcagcaaagggcatgtgaactgtagggaggtgctcactccacatcccactgatgcacaagaaaccctacctcggcctggatcacaaccacctcctcctcctcggtaagggcctggcccgggcgcgtgttgtcctggtactggagggccctgaggccccgcacccccgcggctctgatgtcgcgcacggcgaggtaggtgtgcagggcggtggtgaaggtgagatttgagtcgccgcgattcgtaactctcagctcctgggtcattgtcttatgccccagtctgacctggacaaggggcagggaaggtgctggtgggtaagcgtgtgcgcatgcacgcatgactgctcggatgccatgccccagcttgcatggcagagagtccaagaaggagtcccatcagcttcgcatgaccaaggagtgtgacacgcctctgtgaactccccatcccacctgaacacgtttgttcgcagattgtgcaaaccaaggttctcgagcacaccagataacaaccaggcgcacacacacctccatctccaggtggaaggcagctgtccagtcggcaggaagtgccgcggacgtctcgtccagggagaagaccacggaagcggtctcgcagctggcaagggtccatgtggatgttcgtgcgaatccatgctgctgggtaagcggtccccgcatcgcaaactggggccaacagatgggaacacccccacgaatggctgaacccgcctggtacttggccttgctgctgacaaaaagcctctcctgcgggggttgcagggagatgctgtgtggcagcagacagtgttcaaagatatgcatgtcgtgagatggctgaggtaagggattgaatgcacgatcagggaggggtgcaaggtaggcatctaatttgcatggaggagccacctgaatatgacccttgagtcaaacaagtggtggccgtccacactgcttgattttgcttgcccctcactacatcattcatcgtcgcccaaacactccttacgcagatatcacactcactactccgtctggcgtgatccaggaggtcagggtggctccttgtgcgtgaatcttggcgctggatccatctggtccctgaagctccaccaccagcaggggattgggggacgccatgattatagggagggacgacgagcgcagacggatcacagctggatttcacagcgatgttcgcctagatcgacgaaaatgttgtgtgatcgccaatggaatgctccttgcgagtccaaacattgattttgagcgccaaaatcatgtaagtggaccttcacttggtgttagaagcaggtcatgtatggagttcccatatgtccgcaagatttattgatgcaagtaccacatgccagatccacttgcgtgcatgttttgctggaaaggatgacgcactccgtgccctcgaaagtctttccctctctgccttcctcccactgttgtgggaaacctttagagaaactcggaaatctgctgccaaacttttgtgctaggggctagtcttccggaggatgtcgggtgctgccaaggtcgccaggaccgcctcgcgcgcggtccgctccttcacatctagctccaaggccgcttccggaggtcacgtacgtctgggtatcggtcgtgagatgttgaatctgtcgcgtggcggggtcacagttgttcagccacttcccgtcccctgcgcagcacgagcccgactacgtccatgccccctctatgtacaacctgcccgccgtgagtcatcagagggagggtgtgcgtgacagcaggatgcagcgcgctctacaacgtggctattggggcggtggtctctctgtgatgcctctcaacatgatgaatcccaacagttctgcctgttcctcaaccacagatgaagaaccgcaaactgaagtttggtctcagcgtgggtggtgttgtggccctcggcatcgcgctcccagtggtgagtcgtggggagcacacgtccagtgactcacacgcgatatgggctggggtgattggaagcagggtagtgggcttccggcatgctgcagaggattttgcggatgcgagtgtggccaagcactcaatcacaccactccactaaaccaactcttgcagattgcatgccagtggcaggtagggttgcgagacctttcggtggggctaaaatgtgtatgacagtgttccaagcacctggactgtcttttgggggaggagtgcgctcctctgtcccctactctgctgtccattcatgccagcctgtcactgaccacttctctcctcccgtttgctgcagcaaattcgcgctcgtggatgaacatcccgtcctagactgcgtacaaggtacttgctgtaaatgccacatgtggctcccagattgaagaagagaagggaacttggagcacgatctaaggcgtctggtttgcacagggcctcacgacctgcattgctcaatgaaggccagggtgaccttctcagcctcagcctcggtgggggcactttcaagctcgctctctgcaagatgggagttcaggggaaaggtggctgatgaagggagcaaccaacaagtcgtggtcactacgcgcgcacatggcggccagacaaggtacccaccgagacgggcgccaggccccccttccgtccagtggatgagcgtggggatgacgcgcagtttggtacggctatcctggcggagggcatgatctggggacctccactcaggcttgtcacccactgccacacgcaacagcgctcctccggtcttgctcacagcctgctccactcccttattggtccggagacagtcaccacaccacgagcctatgtttaaagatgatcgagcgtgaaatacgttaaagggagcccttagttcttacgtcgggagaatggctgctgagcaccttggaagtggacaaagtggggaccagtccgggccaagagggacttcagtccagtgtcaaaggtcgctgtggcgcacgacaacattttgtattaagatgtggggccctaagggatgtgggcgcagaataaggccaatggggagggggtgacttgcagaggtcgctgttagtcagcaagacgttttggtcgactgtgatgcgccaagatacgtagagctggcgtcggcgacagacccggcaaaggcaatcccaaatttcgaccaggcacggaggatgcctgttacagatgtcatcatgctctgtgcatatttgttcaggcttccgacccgcgttccgatggacagcattgcgtatctctccgctcccagccgatgcgcgcccgggacagattaatcgccaggtcagcttgatgcaaggagttctggaatttgttgcatcattcacgcatatgttgccatgttcaaattaatcccacattcagtctagctacaggacgatggcatggaaggcagtggcctcggtgagcgacgggctttcagggcatacacccaacattgtactttaaccatcaccttgtgcaaagatgcttcacttcacattcctcaccgcagttcctggacgggttgtctgtgaccgccatttctcgtcgactcgacaaacgcaagctgcagctagagctcgacacacagagactctttctcctcacgacccactaccgatcaccagacctccaaggtcagcaaaagagccatgtctgcccgcaataactcgtgaacgtgattcatgacactgtgtcgagggcctgccgacgcatttcccataagcagtctctcgtaaaggagtccagttttgcatggccttccacaggtgcatccccagaggcttacgccgaggagctggcccgtcggggcaccgcacttgcctttgaggtgaggacgctggacctaccggagtgttagtatggtgaaggatggtttccatatgttccgcctgattttgtgatatagaagactgtgggtcgtcttccctctccactacctgacacacctctgccttgtcctcagggcatgtgtagggcagtggctgacaatctccagacccagctagagacactgacagcaggcctgcatgctgtaaaccccgactctgcggcagcagccaggctgagcttgccacaagaacaaggatctggtgcaggaaggcccaagagatttggtctgggctccctcagtcatgatgcccagccgcatgagcatacacaaggacccccctcccccatccttgaccctccgactcccacatttgcgctggaaattgctcccagcagcatccagcatgcatccgcgggccgaggcgtgtggctgcgtggccatgctgccactggacaggtggatacctgctgttgatggctgagagaaagagttgattgcagatgcctgtgtgcatggtagggttccccaatgggtcctgtcactactttcttcctgtacagattcaaatacaatgacagagcggtcatttttcctgaatatttgttgcttagcgtaacttcagccgccaatgcggtggtctcgccggcaagttcgacccgaggcggccactcttcaatgcaaatatccctcacaaccttggtcccctcagatagtggcgctgtatcccggcgtagcgtacaggccgcttcatcatcgtgcaattcccggctaccccatggtgggtcgggacaacgaattcctcctctcacgctttgacggtgtggcgttggacggcaagccatggggccttggggctgcgcttgaaagacggtggccccccctcccgcctcacaacctcgctgaggaggcacttggctgcctagaggcaagacctgggagttgttattaggatgggggagggggagggcgggggcatgcctgtttctcaatggtattatttcctggagtgtccgatatacccaggtgcatgatcaggcaacccaaggcctgatctttcggcattatggctcttacccacaattcccttgtcaaactgccatcgtcgaaccctcccccacatccgcgcagggtgggaacaacctcgcggccgggcacctggtaaatcatcccccagcaggcaccctgccgaatgttgctgttgcaagttttgactggcataccccaggtgaggctagtctggcaacgacaatcttacggggctggaatgggagagccctgccacagaaaggggtgacggtccttgaagtcactggcattcaccgcacggcctgacaccagctgctgagctgtgctgtctggatgactgacagcaagtaccgggacacagcttcaccgagtctattaatcttccgttcttcatgctcacctccctagcagggtcacagtcttatcttcgagcatacatccccaacatcgagtacacctcccgcccagcactacagacacttggctcggtgcctggcctggcacttgttgccctgcgggacattgctgaagaggagctatttctgaactaccgactgaaccccaacttgcccaacctgccggagtggtacacagccgtggatgcagacgaggatgctcgcaggtggaattgagatcttgcgggtcaagttttaaaatgaatcgcacagataccttacatgagttccctcagctagcattgagactcgtcatgcctctggatgattgggagctctgtgccatgagcgcacgggatcatcgtgagatggggcccgggggtactgcttgcgaggcaagggatcagggcactcagcctgacgggtctgaggtaatctgcgtgacctgactctgtccatgtgcaacatatactacagatggtccagggcaaggtgctcacactgatgctccctggcatcttgtatcaaatcggcaaggagaggatgatctggtgctgacggctacccaacgggagtgtgctgtgcatgacaggcacccccgttgcacattgcgcgccttgagtccccttcccacccacccttgttgctggtccagtcaggtctgggtacgtgtcgattgccatactttatattgacaaagtcggtgtcagacagaaaatcgaacatggtgtgctgaagagggctgtgatggaaatcactaacctccttgcccatgggcatgatcagtccaggagcagtcagggggatgcgatcaaggcatcgaggtcatagatctatacattctacccaacagacatctggaatggcatctgaggcggatgtcgaggaggaggatgtatcggcgacagcagaaaatgtttccgacgaaatcctcatgtgggaggaggacgcgctacagcgactctgggacgaaatcccccttcatgggtacctcggaggtgggcagagtgggtgcatgaggcaacatcttgctcctcattcgcgcactcctgcatgcgcctgctctggcgcgggttgtctgacgggtgctcaacaggcttgccccccgtgtcttcatcctgccatgacatctccggacgtgcttcactccagagcttcaagaccaggtgtgcgagagacctctcctcccgtaccgcgagtttgagctgccctatttcagatgtggtgcgtgccggctatggcttgctgggggtccgcgccacggtgtatgccagttgggtcggcttgcttcactcatccgccacgaaccaacatgggacacaccggtcgtgacatccctgccacatgccacaacacaccagagacggactgcctgatgttcccgggcgcccgcatgggttttacatttgaggctcgacaggtccgaatcatgcagcaagccctggagcagccgccgcccttgactggcctcctcgtggtggtgagcaatcttgcatggcagtgactctgggagcggtgcaggctggcaggcagggcacacgttttgcaagagccagatcttgctccctgggcgtgcagggaagcggcagcgccccggtacagcacctagaccctggcccggctaggcagtcgccctatggctgcatcgtttgcattgagcggaggagggagggggcggcaagcggtattttcagaggtgagggcagggctcaggcagcagggtttgtttctctgcaagaccccgtcttggaccttgtagggtgattttggcgcgacgcggaaaccatagggagcggcagcttgtgtgtcgctcccggcccttacgaccgccaccccctgccacctccctgtccagccctgcagcgctgcatggtgttggaaaagccgggggattaccaggctcagccgtgcaggtctgtcctgccactccctgacgacgtctgcgtgccgtgggaggtggcagagggcctgacgccctggcaccccagcctcttcgccttcaaccgcggtgaggatctcctggcagaaagggccctggagctggcacagaggctcgtcccccgggtgagtgcaatgaatggaagacgagggtgggaggggtgctggtgcgagatcagttgagagcacaaccctgcagggaccccttctgtcgcgtcacaagtgggggcaggattgcaggcaggtgctgtgtggagggccaaggccccagcgcctacgcccttcccttgccctccctctcgctgtgcagggaatcaggggtgtgcgagtgggtgacccggccagctacattgcaaactggttggccaacaacgtgccgatcagctggatagaccaggtcaagatgttcactgcccagaccagtgagtggcaggggctgaggtgtgtggaggggtactgcctgttgccaggcggatattccctggtcctgctgcagctttcccatgttgccgttgattaagcaccgacccaccatcgccactgaagcttcggagcggctggagatcgctgccgaggcgctgggcagaatgggggctgtccgctgcgcccggtgcgggcacagagtgagctggcgagtgttctgtgcggtggacctggggcgatgacccttgcatgcccgtcgccctttgccgactcggacggcggggcagtggatgggggctggtagacagacccacacccatgtttcttgcgcagctggagaggaatgtccagctggtggaactcagctcggatggtataacacacagatttgtcaatcctcaatgcatgcacataccggcaagttggacgggcgttgatgcggtgggccctgcaccgggatcgcagctgtcacgccattggggacatggcgtgctgaacgctcaggcagggccgagctgtggcatcgcctgtgtgcaggtttcatctctgcacagggagccgtgccatcggcgaggtagccccgcagccacccttcaatagtgtacctgacgatccctgcccaaacctccccttcacgcaggtgatcttcatgatggcagaacgaccctccacggaatggaatgggccgctgggatccggactgcactcctggctccctggctatgtgagtccctgcctgagttttcaaggaggaggcaaaccccggtcacatggggggcgtaggtgctgctgcactgtggcccaaaacatactggccggcacagacaacaaatacccacaggtctgtgccagccccctagcttaacatacaccgttgctcaccctcttgtgccacctcatgcacagggctggctgaccacggcatgcatggggtgtcatctcatgctgggctgggtgttcgtccccatgcatggccagtaccctcacaggatctgggccatcatgcgcgatcatgtgggcctcacatctgggaggtaatgcggcaagcaggaactccagtgggcttcagctgaccagattgtaggatatccgggagaaagacgtgtcactgttgcattcaggctcgcaggaatgacccttgatgagatgcaccatttgcagcagcagttgaggtcctctgacgcgagctttgccttgacgtcgcccttctcttcacattcgatatgcctgcaaaagcattgcacgtatgcacccatggattgtagccctctagggcctgcctgtattaggataccacaagagtgcatactattgcttccgtgaaatgagatgctgggaccttgtcgatcgagctatgcccaacagggacaggaatgcgaaccggggtgatcgtcgggacatacagctcgatcacataaaccccaagctgcaagagaaggaaacccttcatgacccttcgtttgtattgaactttcgctgtcctactctgcgaacctgtgcacaagtccatttgggctgcaatctgagtaccaacagggatccatgacgaccgcagcatcaccggaccccattcgagtgggcgtgatcggtgccggcagcaataccaagctgtatcacatcccgaatctacaaaagcatgccggggtgacggttgaggtcgtctgtaatcggacagtcgagagcgctcaggctgtagccaaggaatttggcatcccaaaggtggcaagccacacgcttgggtttcgcaagttgggtctgttggcagcggtgtcagaggtgtgtcttgaccaatcgtaaccagcagaccgtgcgcgatcgccacctgatcgcacccctctccacaccaggcggtggctgactggacatctgtaataatggaccccaccttggatgccatcgtcattgggacatggccaaacatgcacaaacccttggtgctggcagcactacaagctgggaaacatgtgctctgcgaagccaggatggtgagctgtgaagtgtccacagttgtagaacaagggagcctgctcataatgctggactagaccttgacagcctgaccagatccaatctcccaggccctgaactggggagaggcactggagatgctggaagagtcgcgcaggcgcccaccccaggttgcgcagatcgtcccttcgcccctaacccttcgctatgatgccgccatccaggaaacaatcaagtaagtcttccccagtgtgacagggtgggggtgagaggtgagaaagcattctttcagaagtgtccacattatattttgaagtgcaaggttcccacgcagggggccctcggtgttcctctcacgggcttctccacaatcaccactcactctcataggtctggggtcctggggcagctgacctacatcacggtgaggggggtgtcgggctggcccgaggccaacggcgcccccatgaccttccgccaggacgcagagctgtccggggacaacatcctcttcctgggcatcatgtacgaggccctggccaggtgagcggtcgccgcgcgccggcgtgctctccaaagtgtgccacgggggggcgcaccctttcccagcccctctgagctgtgcacaagcaccctggactcaacacgcgcccgacggtgtgcaggtgggtcggccacgccagcagcgtcatggcgatgggccaaaccgtggtcaagtggcgcacagaccccgccacgtcagcgctgcgcggcgtggaggttccagaccacctggacgtcctggcccgcatggcctgcggcgcccaggcccacctccttctcagcgccgtggcgggcggcagcgaccgccccgccctggagttctggctgcatggatctcagggggcgctgcacctggacctcaccgccggcgccctgaccctgagccggccggacgtggaggggggggcgccccagccggtgaccctggcgcaccccggggcatggcgggtggaggaggagtttgtgggggccatccgggggaaggagcgggtgcgcctgaccgacttccccaccgccgcccgctacatggagttcaccaccgccgtggcgaggagcctgcgcagcggccacagcgtgggcatgcccctggtgtagtcgcgacgtgctgtggggctggagggcgggtgcacaggagcacgtgggaagccgggtggagggctgcccctccggcggcctcacccacctcgagcctgggcatgccagctggaacgttgtgcaacaaaagctgttacacggggtcgagggaagggactatcaagggatgggcagggcgccgagggaacccgcactctcgaggagaggggcaggcacagggccaggtagattgaagtaggacactggtgcggcttgttacatacgccgacctcgttttccacgaggcaggaaggggcacggcgggggcgcgcctacagcttggaggactctgcatccttgcaggcggagcaggtgaggtagctgcccacatccgcggagccggtgttcatgctgccgacgttggctgcgaggcaagtaagaaaggggagagaagatgctggtgagcaacatcggtgcatcacgagtgcaccatcgaaagcagaagattctctgggcaagaagacaggggcataccccctttccgaattcctgggcccaagccagtccagctcaaggccactcaccagagccgaggttgaaatcgcccacgttggctgcgcaagttgggcgggagaaattgtgggtgagctgagtcagcctgggacgctgatttgcagaagggcagcaagacagtgcacagcactctactcctgccactcatttgatcagaggcagcgtaccagagccgttgttgaagttgccgacgttggagttgccgatgttgccgaagctgcaggagtgtgggggttatcaggggttgttgagagatactgagaacccaggtgtcatgagtggcttcaggatgtcgccaccgcccagttcagcatccaatatcataccaagacagctgcccagccctccttacccattgttgtcggttccactcagctggtgcagcttcttgccgcagcccgccttcgcggtgcccctgacgcactcgatgaacttgaaagcggtacacttgccgggggtgcccttgcagatgtcacctgggttcagaacatgattgaacatgactcggctgttggcccctgcagggaggggttccccacccgagcagggttccctcaaacagcccgccagaggcacaacccaccagatccgatctgcagggagcggacgacggtgcccgcagagaagtcgctgagctggaagctggcagccttctcgagcccctggcgcctggaaaggaaggagggaaccagatccaggcggtgagcattcagtttgggagagtgaaatgctctagctgctccatgcaggacatggcttgaaggttgtgggctgaacgcaagatgtaattatttgtgcagcggcaaatggcctggtcctagccactctctggacccctctaacaagctgctcactggcaccaggcgttggccaccagcttgcccttggtcttgtcctcctcatcagcggtcgtggcaatctggtaggtggcgtcctcgtacacgagtgtgatcgcaggctgggggaatatccagcagtctgggtagctgctccagccagttatgttcaacacattgtacagtgctgcgaatgtgtgcaggggagcaaggttgagggcaagctggagagtgagttcaccagagtttgaccttgatatttgactgatcgcatgcacatgcccagcgacacggaatccggacgagcacggcaaccccgtccggcatccactcacgctccagctcgtacagcacggggaactcctcctcaacagcggacgccgtcgccgccagggcgatgatcaggaaggcaccgaagctcatcatcctgtgtgtgacagaggaaacccttcctaacaaagcaggagggtccggccaaggctcacgcagacgggggaaaagctccgcgccctcgcttcacagacgagctctcagaagtcctcatacgatcccttctggaaatctgcactccaaccaagctggaaaaggcccgatgtgccgccgcgcaaggggtgtcaataccagcagcgcacctgatgaggggacgcggatcttggagatttggcggcgagtccacgaaattctctcacaaactggtggaagagtaataagatctcgttcctggtggtgcgtacaccattctaggcagctcaaaattttaactcgacgcgtcggccgggaacgacggagaaagcgagcgcacgcgcccccaaaccccacagatgtagcctcacttcaggctcttcttaagagattggccaaacctccagcacacatcgagaaatttgcattagattgaatattaaaagaaccttacttaaagcgtaggagtcgatgccacctgggtcatcattccagcgcaaaggaacagttgcagtatcgggtgagcacgggtggcgccctgggtgccatttgagtccgtgctattccttgcacatcccatggctgtatttcatgggagacccacattacctgagcaattttcgcccttgcgcagatccacgcacccgtcccggtcagcatggtcagacagtcatatcaagcggcttggcagatgtggatgccatctttggaggtggctaccccctaggctccttgatcctgttgctagaagatggctccacccacctacatcacttactggtgcaatacttccttgcagaaggcgtcgtcagtggacaggtggccatgggtgggcgcctggcatctgggtaggctatgctgctccagagatcccgccgcatgactgccgcaacatgataaatcccatcaccacacagagggtgctgctgggccacggagagcaagggccagccccatccctggctacctggctgcccgctcagcttcagaccaaggacaaggcaagcgttgtagaacccggcatgtttggacgtgaacatggctgtggaccacaacttgccatgttgttgattacctgacagccgcctcacgctggcccgacacctgaccactcccccgcatccccgcgtcccctgcaggagccgccgggcgtcgaagcggagggcgatgccggcctgcgcatcgcctggcagtaccgacggtacatcaccaaggcccagcagcagcaggagggtattgggacggcggtgggacgcgggagcggattggggccatccagcagcggcgccattgccacggcaggcagggcagcccctcccagcaagccccggccctgggccaccgcctttgacctcaggaaagcagcgggcgccgaggcgctggatgcccacaggcaccgcgtcgtgagtctgtgctgcgaggaaggcacagcgccaggcacccatgagcccgtcgaccccgctcgtgcattgctcagggaggctggaagcttcgttgccgacctgcgcgacgcgtccgcggcccctgctcccggcgggccgaccggcgctggccctgcgccgccgggaggggagtgcagtgcgtcaggcctggcgacccccaccccaagcggcgcgcctctagccctgcccgcccccagcaccccgacggcgccccgcgcccccctgcccccgcgcagcgcggaggccgtggggcgcctggtcttcacgggactggccggaggcagctggccggaaggtgccgaggcgggcttggcccccttgttgtcaggcatccgggcccgggtccgcgctgcggccgcggtggcgctggtcacgctgtcgccggcaggcctggcgccggccgtgctcgcccaggcacagcatgctgcggacgctgtgctggcgctggaaaccgtggccagcgacgctgagctggtgcgcatggtccctgaccccggctccattgcgggtttgctgtgcgtcaggcggcttccgctgggttcggccttgcagccgccggtccccgatgcccccctgcacctcatcaggtcggtgctttgggttggatagcgtgtcttttcttgtgttggcggggaacatgcagatcttggtatatagagcacaattcatcttggatcatgtgacctgcaccctgcacacaggcacctccgccgaaggctctccattcgaccagtggagctcgaccctactctggacttggatgaagcacaagggacctcagccttgagatccagtgcaacttctctctgtgctggcccgcagggcggaaccgcctctctagacttctgagttgtctgtgagactgtacaacatgagaggggtgtttttgcatgtgctgtgcattgcgccccatgcacgggggaatcttgtgacagcaaaccagatatggtcatcaaatcaaatgctatatctcctgatgatacttgtcggttgccacattggagaagcaagagacgagagggggaaggactcgtgctttcgtccatggcgggttgcagttgtacgaatctgtagtccccttgcatgctttgtcccaaaaagatgcgcattgcactgcgcaatccatataccaaaatcgacattgtgtccattgtatcgccccgatcagattacaggaggggattggtcgttgcccaaggggtagattgtggtcccaaactcagaggccgctgctcgaatattgaccgggcggtctgcaccgccagtcctcgaaacggctgtcggctgcctgtattcgccacaataaagggtaccacggcactaaacaactgcccagcgggcagtgggcgagctgcagcatgtcggatcacttgccggcacctgcagaccagttgctctcccctttccgcctgctcctcctcctctgcaccctgacggtggtcatctactttgacaagggagctatcgcctctaatggagtaaatggagcccagtccactaccgaacgccccggcttcggcattcaggcaggacttgcatgggtttgaagaggcaggcaaggcacaaccccatgggtgcactgagcagtacggctcaactatggccccccccacgactcacattccactcccccatgctctcagggtgactttgacttgagtatcgtgaaggatggattccttgcaactgctctcgtggtgggtgtggagtcatgcgatctggggagtctgagtgctgagagtttcctgattgtgggacatcttgatactcaggagcctcgccctctgtcgtctgcatacaggcgggcatcactctttcagcccctgtctccgcgcaatgggccaagtcccacaaccacctgcgcctcatcggcatggggatggtgctgtgggcggccggggcagcagcgtgctccctggcgccaaactatgcctgcttgctggcggcccgtgtcctcatgggggtcggcacaggccccttcatcgccgtgagcgcccccttggtcggtgaggtgcaaggggcaggggagtcgagtacagggtgggggttgctgccgcgagtatgagatgggctcaacatcccaaatcctggacccaagaatagagctcgcctgtctcatcgcccaccacacatcagaacccttcattttactggctctgccccacgagacaagatctcaatacccaagtattttccttttgctcaaccccttcccgtccagacgacacggctcccaaggagcgtaagtctctgtggctggcggccctcttcctatgcatcacactgggcttcgccctggggtttgtggttgggggcgtggccggcctgaggtttggatggcgggccgtgctggcaggcgaggcaattggcatgctgccctttgccctgtccctcctcctcgccgccgacgtgccacggagggcgcacagcgctcccagcagggcccaggctgaacagaggggggcgtggcatgaggcctgggcggacctccgtgccctgctttctttgcccatcgcctgcctcaccatcctggggctgtgcctctttgtgggagcactcggcacgctttccttttacggtaggtcctgttgtagggggatgtgcatgtgcagggtgacgcatcagctgacctatgaggatagctggaaatgaaggcgggctccaaccttgcatacctggcaacgctgcaggacagatccccccacctgtttggtctccctgcaggccccaaggccgcgagagccatcctggagatctcccccgaagtggccgacattggattcgggatcgtcacgctcgtggcaggttggttgggcacggtatagggctgatcagccgagggccttgggtgcatcatggctgtcagatatgctgcatctgcatcgtgccatacccctcctgcaatgccctttccctgcgccctctggacctccccagggtcggtgggcactgtcgtggggggcctcctgctggatgccatcggggccagcctcaggaatgccctcctcgtctgtgccacggccgtcttcctgggctccagcatcgtgatggccggctttgcgtttgtgtccaaccttcctgctttcttcatcacccttactgccggcaacctcctcctcttcatcatcggggtgaggcatgggcaagggggctgtccatgggcaggaaggtggggtcgcctcggatatcaacaacggtggctcgcagctcccagtcaatactgtcaccctgctcttctccgaccaggccccctccctgggcgtgctcctgtggagctgccctccccaaatgcggccctttgtcctcagcgcgagcgaggtggcgcagcacgtgctgggggacgtgccgacgccgcccctcatgggcgccctgcagcagtggaagggcgactggcggctgaccatggtcgctagcacgggcctgatctgggtcagcaccttcttgtatgtcgcgggggtgttcctcgttcgcagggcgcccctgcagcccaaaaccgtggaaggcctggatggcagcgagggcgaggacgagcagctggcacaagggctgttggaggtcgttgacgcacgcctcgtcggcgtcctccctgtgtaaaaacatgcctgtatgtgatgacagtgtggtggaggcagtgctgcctcatgcagcttgtacaactaaatcatttccttatactgtttcccaaaggatgccttgtggcagtatcatggacagaatgaggctacagtgtgctacgtctgcattaggggccttgggcagtgttggaatccgctgcagcttgcagcatgcacaacgcgagatattcgcctcgtacttgagcatacccgcagtggacaccacacacaggccaacagattcgcactctcacagtattcatgtagtataaagccatgctattgccttgtctcgttcctgctggctccagtgccctatagacctcgccctcccctggccactagttcgagtttcgatccggcgcatggagccaggcccatcgtcttcagacccacccggtcgcctcgcccaccatccagcgccttaatgtcgctaactgtgcaatgggctcccaggttgggctgcatgagatgtgtggcgaggcaggcgcgatccgcgacggccagaggccgaggcctcggtgccagccggcatgccagcagcggcactcaggtggatcagccagaccctggccctgtcctggaacgccatgagtttgtggtccaccccagagatgtcctgtccgcggaccaggtgggcgtgcttggggctagagaggaggagcaggacgtcgtcctccatgggtggcgcagcccaccctcctaccatccacgcgcccatgcgttcctccgaccccacccccctcacttccacaggtccgcatgcgcctggacgcctacctctccaagatgctgcccggcgccagccgggcgcgcctggtctcctgcatccggtcggggctggtgggcgtcaacggcgcgcccccgcccaagccctccacccccgtccgcgccggcgacgtcatcagctgcgggctggccccgctccctgcctcccgcgccctgccccaggacatcccgctggacatcgtgtacgaggacgcccacctcctcgtcctgaacaaggcggcagggatcgtggtgcacccctccgcgggccacgccgacggcacgctggtcaacgcgctgctgcaccactgcggcgtgcgcggcctggagctggagccggggcacgccgcccccacggccctactgggtggggctgcgggcgcggcagaggacgccgaggacgaggacgacgacagcgacgtggaggacgaggtggcgtccttgctgggggatggggggggagcgctgcggggcaacggtgccggagacacacctggggtgtctctgcaaaaccataccagccatcaaccaggcgtcatccggcccggcatcgtgcatcggctggacaagggcaccaccggcctcctggttgtcgccaagacagaggcggcacgagtgggcctggtcgagcaggcgagtggggaggtggtgatgggtacggtcagtggacacccccctgcatccatcgcgacccgcccaaggcctttgcatgccttccactcctcaccatcgtcgtcagcctcggatggaacatatcgttgatgccgccagatgcatcgcgctgcgcctgcgtgcctgggaacggccaaaaggcccctccaccacttccagccccgtgagtactgcatcccccgccgtctcaacagcagtgtcaccacaagaaccctctccccctccccccactctccctcacccagttccgcgctcgcacggtgcagcggctgtacctgtcggtaacgctcaacaccccccacccggcccggggccggctggagaccaacgtcgggcgcgactgcgcgagccgcatgcgcatggccacctttgccgcggcctcctcgcgcggccgcctggccatcagcacctgggccgtggagcgcgagctggcggggggcggcgcggcgctgacgcgctggcggctgggcacggggcgcacacaccagatcagggtgcatgcgcgacacctgggctgcccgctgctgggcgacgaggcctacggcggcggcgcgggcgccagcggcgcggcgctgggcagggggcgccgcttcctgacggagcgcggcgcggcggtggcgcgcgcgctgggccgccccgcgctgcatgccgcgacgctgggcttcacacacccagccacgggcgaggcgctggccttccaggcggccctgccacgggactttgaggagctgctggcgcggctggaggacccggtctggcaggaggcggcgaggcggtgagggtgcggcccggcgtgcgcgcctcgtgctgagagcacacagctgggtaggggcgaccgcctgcctcccagtgcgtcacactcacaaccggaccccttcagactgctctcgttccagctatgcctcgggtttcatgtacaccagggtcttgtcagcattgtcattgtatacaaggggggaagggggtaattgaaaggcaaggggcacactgccgcctcggctggcaagagacatgaaggggaggagggctcaaccctcctgcatcatgtcgtcgtctggaagagccatacctccctcaaaacctttctccaaatcagtttccgctgcctgtgccgggccagagacgacaatcaacgaatgagtggcaagtctgttgaatcaagcatcgatgagactcacgacccagaagcaagcccgtggtagactctctgcagattccttaccctggcggggtcaaagggcacgatggccatggagtggtaggccggtgtggggccgcagttcagcaccgggtagctggccaggagcatgtggggtggcggcatcagctgggcacgggcattgcagtccctcgctggcggctggggtgcctgggcgtgactgacgtcatcctctgggccccgctttcttccctgcccaacgtgagcctggagggagacgggctcctgacgctgtgcgctgctgtctgctcgccccaaggctgccgcgccaggcgccgggaagctcaggtgggagagcctgtgctgagcatcctcgacctcgaactccagtgaagcagggaaagtggtgtcggcccatctcagcagctccagaccctgcaggtaaatcaaatgccgttgagcaccattgcctcactcatatggttcgcatgaagagagtgtgcttgcatttcagccgctgctccaaccccttccccttgcagaaggttcaagagtccccagcttgcctgctttcgggcacgcttcctgcgacactccgtgatgtctccccattcctgttccgagggacgccctccaaggacagagctgccctgccttggctcaggcaggacgtgcggggccgcacaggcaattgggaatagcgtcgtcatgagggtccgagagctcgtcgggaggggtcgacacccgagacgacacgagtgtccgaacctggggatgaaccctcacagacgtcttgaagtgggttaagcaggtattcaatggaggactggggtcgctacagaagcttatgcagcaggagggttgagcactgcttgtggcgaaggatttgcgagagtgacgtcacgatctgcgactcaagaggatcactcaattcccagctccgaattttagatattctatctttgatcgagggtcaagtgaaagactgcacaatgttcaggacgcgcgtatcagacatggaggcgagttgcgatagcttctgggagattctcgaccatcatctggggagtggtgggcggtgtcctcctcccggatggtctagctcgcccaacattcccgcacgcggcgtaggtagtcttaatcagatgtccacgcatccgcttcacccaacgacccagcatcgccagaatttaccccatatctcctgagatctgagtgcttaagaggggcaatggcgccctgggcagcatatggacgatagaaactatcggcaagaatacagcgcgcttgatgaggtagccgttttgtctaataactaatctttcatttagaaattataacagagtaggccgtttcccgctgtcaatgtcgtgttaacgctgtctgcaagcgtgctcatctcgcccaaatcagcattggtctcttgcatttgacagcataaagcatcggcatataattgcgtcggtactggaataagtctctctggtatacatagagcaatgacgtctgcggaggtggccacttctgagcacgacttggcaccggtaaatacagaggcacggcagcatcgcgggccttggtggatcagcccacggatacagtgtccactgttcaaccaagttgtgttcttacatacattgagcagaagcatgagctgcggctggaggtcggctgggagaacagtgtcaccctcacggtgggtcctggcctccacactggcaagatcgctgctgcaattgatctagccattggccatgccatagtgcgtaataccaggccagtcatcgcttccctgaggtgtactacctatgcagctcaaacgaggggaggcagaggtgtttgggacggcgctggtgctcggggacaccctcaccctgaccggtcagaagattgcagtcttcacttgggaggggtgcaagctggcgatcacagggcagccagacatactgttgagtgacgttgctggtgtctcggctgggcaggttctgctctgggctgtcaataggtttggcgacctgccaatgtccatatggctgataagaattcctgtctgacgacttaaacctgctctcaaccctgcccaggtacacatcggaagacacccccatgcagagctatgtgaacgtccacgatgttctagaggctcgccggcagcaggctctgaccgagcagcggcgcggacccacgaccgtggtatgtttcaggagctggtgtacttgtggggtgtgatgttttgctgcgtctgccatgcaagtttcgcaagcgcagtgcatgtgcaacctgctgggcctctgtccccggcatccagatcgttgggcctaccgacgccgggaagagcacgctgtgcaagattctgatcaactatgccatccggtgccgctggactccagcgttggtcgacctggacataggtcggtagcatgaggggttgggggggggggaaggcgcttttctgtttcatgtcacgctcaccattgcaggagaggggtcgcccaaccttgtgggtgagggtaggcatgcactccagaggcagggtgccgtccatactggctcaagtttcatcgctcgctccccatgactcacccctctggtccacaggtcaaggcagcatcacagtcccaggctgcatcgctgcgacctccgtggaggcgcccatcgacgtagaggagggcttccccgtggatgccccgctggtctactatgcaggaacggtggccggcggagagaacattgccctgtatcagcatctcgtggaacgggtggctgatgccctggagcgaagagctgggacggatgccaaggtgatcagggtattggccgtgggctcacaatgttgtcgagcatagccgtcggcgcccatgcaggctgcccctgcaaatatctgttccagccctgcctgctctagaaccctaagtccctcagtgccagagccgcgcctcctcacccttcacatgcccaggtcgctgcctccggcatgatggtcaacaccatgggctggatagagggcgatggctacagcctgttgcgacacaccattgcatctctggcggccgatgttgtgcttgtggtgggcagcgatcgcctgcactcccagctctcttctgacctggccaccagctcgccaggtgtagtgtggggagctcacgcctgctgcacagctgtggtgactgagctgggcggcaatgggttcatagactgcttcaggttctttgggtgcatgggaagcagtcacaaagtttttgaacccagcatacacccagcatgtcctctccctacaacccccgccccccccccccccccccannnnnnnnnnnnnnnnnnnnnnnnnnnnnnnnnnnnnnnnngcagccatttcggtggtgaagcttgccaagtcgggcggggtggtgacgcggacgcgcgagctccgccaggaagcgcgcaaggtgggggcgggttcaagaggtgtttctctcggacgcttcctgtgtcagttcaatgcatgggcttccgcccaatgagtgctttgcacatcgtggaggagccagcggctgcgcattcgtcccctggctgccctgccatcccagccaggtattgatgcctcaccccccgccaagccccctgcaacccctcgtgcaggtccgggtggaggagtacttttacgggcccacccgctctctggcccccgcgtcccagacgctgaagctggagggggtggaggtgtaccgggtgggcggcggccccaaggccccaccctccgccctgcccatcggcgcgacctccgtggccgaccccctgaagctggcgcgggtgaccaacccccaggagctgctctacacggtgctgggggtgagtcatgcacccggcccggacctcctcctctccgcctccgtggcggggtttgtgtatgtccaggatgtggacctggccaagggcagcatgagcgtcctggcaccgcggccggggcccctgcccggctcgctgctgctggccgggaacttcaaggtgtacctggactgaagcgactcccccgccactgtggtttgtacaccagagaaataggagtgggttgggaaagggtggtgtttgggaagggatgcaaggggtgcagcagaagacaaggaggtgccacagggtactacactcgtgggcttgtcccaggagacatgcagaatggggaagcaccagtggagggggtgtgaggatgggtgtgaagcatgtgtagcaatgcaagattgaagggtgctcgggtcacataggaagctgtggtccctggtcataggggatctttgcccagaacaccgtgcagagcttgtgttgacgtgtggtcacgccaccccgcgcgtcagttggtgctcgtcagttggtgcctgtcaggcggatgtagtcgaccaggagggtcgtgggaaggggggtgctggcgttgacggggccggcccagttccctcccagggccaggttcctgtggtttcaaagggatcggagtgaggtcatggtcactgatgcaatcaggaaggtgcaggcacgaggctggctcgtgtatcaggctcgcttgctgtcctttgatgcttggagggttggtacccatcgtcacaagagaagaatcctcagaggagcaccagggcccatatcaaggtctcaggcccgccctcccccccagaccttggcacccacaatatcatgtagaagggtacgtcgaatggtgcattgggggttttgttggaggccgaggtaaaccagccgtcaccgctcacgctcgagctctgcagcgtcctgatgtcattgccattgatggagactgcgaagcacaggatggggtggtatgggattttagccagcatgtatcccttgaaacttgaaggcgccgaggatgcaggttgatgccatgcctcctgctcgacacaaacatcgtcaccataatgaaaaggcattgggcatccatcaccatacatgtacgttcctagacacctctagaatatccacagatgaatcgccctgctcacaggtaatgctggtagacgtccatgtcacagcaaaggtgttgaaagcgctcgaccagctcttgtcagcgtctgattttgtgtagaatgtgttcttgattgcgcctgagctgcccttgccatagtgcaagccctgggttgccctcgtcatggcattgatggactccagaacatcaatctggggtttgaggggagcggagtgggatgctcagatcaaggagttcctgcacctaacctcttccagcacccacacacttgatggccattcattggccagcactgagatgggagactgcctcaatgatgggttacagagacttttatgttctcctggtgatcatcgctcactccaatccccccctcaacctacctctcctgacatgggccaggcaccgtaggtgagggtggtgggaagcagccagaatgctggccactgcccttgccctgtgggtggaggatagcagggaagactcagacatggagctatagagaatcgaggccgaaaagatatgttcattggacaacagagcacataggaggcggtgtcagtgcttggtggaacctgatatctgaaaattgtgaagaccagccatgcaagcttggggctgcctttgacatgcaagctggcaaccacaatcaggcgcagtccccccaccctccctcgacataccaccacccaatattaccagcgacagacctggcgcaggggtctgaaggaagacctccagcttgagggtgctgtaggtcttccccgatgagtccgcgacgcccgggcagaaacccaccagaccctggctgttgatgcggccggaggtgtaactgaagccattcacggtctcgcgctttgcggttatttgcagctggccgttctgtacagccacattgtcggtggtgtagtactcctcctcgccattaccccagcccctgttgaaagggcgagaaggagatgggacagtgacggtgcccagcatttgaagggagggtttgaaagaaaataggcatcaccccccagcatgccaatcggcattcaatacgacagcacaaacccctgtgcagggccaggggtccctgcatgccagctcaccagttaccattgccgacatcatactgccaaaagttggagtcgagactgtccccctcaaactcttcccaccacagcgcagtccagcctggaagacaggaggcacatgagagtgaggttgttgaggggcagtgccagtctatggccagattcgggcctgcacgtcaggaggggcatcaccgagcttggcctcctgtagcaaggcctccccccccacccacccgacggcacggtaaaggggacgtcgccagagggagtgggcacgacgtttgaggaggacccggggggcggcgggaagccaggggaaggggatggactcggcgagcctttgcccgggggtggtgggctgtacttcttcccggggggcaatggtggcagcggtggtggtgaaaacgctggggggctcgggggccctgggctggtggaagccgagttggtcttcgtttttagagccatcgtcacagacagtcccaccgccgcaccaaccaggaggattgctccaagggcacacagcgcaagcttgaacttgatgcctagtgtaaactgggaggttgcggtctcatcctgccacgttttgtcgatgcagatctttgggggacctgatggagggatagaggtgacgggaagcgcacccccctgcgccattgctgttgccgcttcgcttgttggtcgcggaggcgacttgcaggcttcaccgcctggtagcgaaagacctcaagtgtcacaagccggtggaagtatacgtcggattacgggcttcgctactcataaagtacccatgtctatgtatttgcaggtcgtgatcatgaaagatgcccgcgtgtcacgaaggtcgctcggcagatctagccacaccactccgcagtccgacaccctaggcgaattagcactgatccagtgtgttgcatgtgaatgatgggcgatgcctgtatgatgtggtgcgtcatgtattcgtgtcttgtgagaccgagaccagcaattggatgtatgcgaactgacgcgcccttgtccgcgcgcgcgtacggtccgcgccggaccaatggtgaacgggaagggtagtaacctgatcaaggagccttgaccgcgttgttcgtgccagggctgtcagcactctgttgagaatactgtcggtgtggtctgtgttctctcagttgatctggttgccagggggggtcagccacccgcttgcttccacccccgcggagttgaatccctgggctcttggaatcccatcatggccgagaaactgggggccttcgcaacagatataaccgacgaagagagagagaaggtcgaacttcttcgggctgaggtgaagcccttcatcaaggtgtgcgcggggtgggtccgtgtacgtagtcaccgtgatcaggggatgcctgagctcattcctcgcctgcctccggccccacgccgaccccgcgtccccttccgcaacagaccgcggcagacgttgccttttgcaccgagggcacctatgtgaggtacctgcgtgccaggcactggcatgttcacaaggctgcaaggatgctggaggcgaccctgacctggtatgtgtcccatagcaacctcgccctgctctccagaatttgacagcagtggcccacaccaagcctgccagtccatttgcatccgcgcctccagcccatgtgtggacctgtacccctccctgcaggcgggcagagtacaaaccctatgagctacgctggtcgagggtgcagcatgatgtcgacaaggggaagctctacatcctgaagggcaccgataacgctggtcgtccggtgatcctcatgcgcccacggtgggtccatgggggttgtgggactgatcagttgcaagcgcgcctaggaggtcatggggaaggtgagaggtctccccatgcagcacaccttcatcggctcatcctgcaattgccttgctcaccccggggtccctccacctcccacctctcagattggaaaccattcaggacaacgaggctcgactgcgattcctcgtgtacacccttgaacgggctgcacaactaggcgacagctcacgtaaattttttggagaggacatgggattgctggggtggtccccgacccggccgtggcaaatgagcttccagccgtccgcaggatgtgcctgcatcctcaaggagatgcacaccctgaacatggccgatactcacccatactgcagccgatgggaagatgacatggcttctggacctggaagaatactctcgcaagaactccccacccattcggatggcccttcagaccctgcacatcctgcaaaatcacttcccggagcgtctgggcctggccgtctgctatcagactccgtttgtatttgaatgtgagtagagatggcgcagtcaggaggggctagggctggatgtttacatcgacttgtcttatctgcaattcatcctcagaccgcgtgtcagatctgggctgaaatgatgcactcctaccacctgcagtgcatgtgaactctgtcacctcgccttcgtgcagaggtcccgctgaaatcgacatgaaacgcgcctgcctgctgaacaaatcctcaatccgctcgttcccgctgcagggatgtggcgggctgtcaaggcctttgtcgatgtcaacaccaagaagaagctcgtcttcctccatgctcgcgaccccccaggcaagctcgatgcattcagatcgacaccgatgtcatccatcaccatccagttctctctgggaccgctgccttgcctccgcgtgcatgccatccactgatctcctctctacaccatacagagatcctgcgtgagtatttcaatccggagcacctggacgactccatgggcggtaaagttcccatcgacgatgcctggaacaccgaggcatatggaaagcgcatgtctgccctggactttgacgtcgacacagcgctcatgggtgctgacctggagctcaccagcatacggaacaaggcggcaggcgctgagtgagggacaggagcctgcaggccgcttgccttggtccccaccaatgtctggacgtattctttaaccgatagttgctcaagattgggtttgctcccggctaccactgatatttcacggcgcagttaacccttaccgcgaaaagtgatggcacaagacctttgcaagcagtggagaaatgggaaggcgcaacaactccgcgcccgcgcgcccttgcgtgcatcctcgtgaagacctccctcctccgcccttggcagcaccgatgcgaccttcatcgccatgatgctggctcatcctggagtagtgtgattatagcctagcatattgccaggtcctggccttgtgcgcccttggacacgggcggtatgtccctgggtcggctggttccctggcttgattgggcggaatggaggacggtgggcgaccagctatttgcagctgaagattcggagcgggatcttggagtagcaagggtgggagctggtgaacttatctcggttacaatgtggtcgtggagggctcgttggaggccgctgctcactgctgcgcacacacactcaccggatgccttgactgcacatccctccccctccccaggtcgtggcatggagggtgcgcgggcgggtccccctggctgtcgactccaccgccagtctcgtggagactcagctcatgtgcgttgctggatggtctgccggtctgggaagaagtatacattcttgtgcttgtgtggcggatgtgtagaggatctggacgctcacacttcaaaccttgccccatgtgcattccaaggcatgtgcagcccctgccctatcccctccctgggccccctcctcccccctttccagcgcctccccgcgccgccacccgccgcagggacgcgcgcggccagggctctgacgccgccctgcgcgcccagttctgcatggtcctggtccgcctggtcaacggcgtggcggactcggcgcagcgcggccgcgtcgcgtcctccgtcgcctccctcgccgccgcagccggcctgccccgtggcctggtggatctgcgccacgaggccgcgcacaacgagctgcccagcctggcggcggcgcgggcgggcgccggcgaagccctcgcttggctccgcgacttctactggctgcgccaggccgaccacctggcggcggggcgggcccaggtgctggtcctggcgcgctcttacctgggcctgcacctggcggcggcggcgggggcagccgccggggcccgcggcgaggacggcgaggaccgaggcggaaccggtgcggcggcgcgc

SEQ ID NO: 35346 - DNA, 73 bp, Chlorella protothecoides
gctcagcttcctggtgggcctggtggactctgactccatgccactcaacgtctcgcgcgagatgctgcagctg

SEQ ID NO: 35347 - DNA, 61 bp, Chlorella protothecoides
agcctccggagagggggcccccacaacacaagaccccaggcgtccactgtacccctgtatg

SEQ ID NO: 35348 - DNA, 96 bp, Chlorella protothecoides
atttcgtgcctggggttgacgattttggaggacctgcggtctctgtggcccgacctgccctgccggtcaagccacggtcaaactgaagcgtgttca

SEQ ID NO: 35349 - DNA, 5452 bp, Chlorella protothecoides
  modified_base (120)..(129): a, c, t, g, unknown or other
  modified_base (1888)..(1897): a, c, t, g, unknown or other
  modified_base (2096)..(2105): a, c, t, g, unknown or other
  modified_base (2713)..(2722): a, c, t, g, unknown or other
  modified_base (4218)..(4227): a, c, t, g, unknown or other
  modified_base (5090)..(5099): a, c, t, g, unknown or other
cgggcgacgcgtctgcaggcgcggcagcgatgggcgacgcgtctgcaggcacagctgccgtggcgcaggacgccgtggatggaggggcggcagcagggggcaccgtggcggatgccggannnnnnnnnntgcgtctgcaggcacggctgccgtggcgcaggacgccgcggatggaggggcagcagcagggggcaccgtggcggatgccggacctgcgaccggtggcggcgcggcagcagcagcggaggcgacgccaggagcggcgggcgtcggatcagccttggcaacggagacgacgcctggagcaaccggcggcacggcggtcggagtaggcggcacggcggtcgcagcgggtgacacagacgcggccacgacggctgaagggctgccacaggcaggcctcgatgccggcagccagccatccgctcctgtcgcagtgcagggcgcaggagtcgccggcgtggatgccgctggaggtggggtgacagcaggtgcagcagctgcctcggcagacccggcggcggctgggacggccggcacaggtgcggcgactgggacggctggggccgcagcggcggcccaggcagccggtgcagcagcggcagccgatgcagctggcgtggcagcagcggccaatacagcccacgtagatccggcaggaggagttgtgcccgccaacacggcggccggcactctggactcagcagcggcgggaggcgccgggcaggccgctcaggcggcgggcagcgctgccgacgctgccggtgcagccaggcgatgacatggcagccctcccgatggatcgcggccgctgaggaacgaggatgagcaccctgcgcaggctcggtagcgtcatgaaacctacccttgcgatgcctcggctcgcccacatgacctgggagcagccggattggcgtgcgctgacaagctgctgcatccgggcgtgagcggccagcggcgtcgcaggacatcgttcatgcctctctgtcgcctggttgatgccacgaaccccacctgaccccttgaccctgactccttgccggctgagtgattcaaccactgtcaccttgtctctctattcatgtgggcactcccttacttcctttgcccgctggagtgccattcctttgaggacccaacctgcctctggcagaggcctgtcagggcgggcggaccccccgatgtggtttcccgcgcgcaagatcaaccccctccctcatcagcgaggttgtgccagcttgcatgtccagaaactgggtacccccgaccccgacgccccaattctcgcgcattcccatccgaaccccatagctagcgaatcatgcaggcaagcatcctgagtacgacacggtgtggcccggcactggccggtgtgccaccagcccgtcccggcgccgtggcccgcggtcgctcgggccgtgtggccctgcgcaccgtcgccgcggtcaaggatgtcttcatgcctgccctatcctccaccatgacggagggcaagatcgtgagctggctgaagagccccggcgacaaggtggcaaagggggagtcgatcgtggtcgtcgagtcaggtgggtggcttttcatgctcatggggatcgcggccggaagagcacttttgaatggcttgtgttggttcatgggctttacctcctctgatcagcccctggtgggttggtaagtggctgcgggctctggaaccgagatcatgcactggtttgctgctagccagaggcccatatccgccttgtgagccttgggtttcctacgtgcacacacgatgccggaagatgctcggttgtctcatgcaaacctgcttccccaagcctcactcgctgtagcacaccccacctccacaccgcacagacaaggccgacatggacgtcgaggcgtnnnnnnnnnnacgctgtactacaccccacctctacaccgcgcagacaaggccgacatggacgtcgaggcgtttgcggagggcatcctgggctccatcaccgtgcccgagggcggcgtggctggcgtgggctcccccatcgcctacattgccgagacagaggctgacctggaggccgccaaggccaagggctccggcgccgcccccgccnnnnnnnnnngcagccgccgcccccgccgccgccccggcccctgccgccgcagctcctcccgccaccgccccggcccccgccgcagccgccccggctgcgcccaccgctccctcccccgtaaccaccgccgcaccgccgcctcccccccgcgccccacgcgccgatggcaggtgagtggcatgggtggtgaatcaagaaagagggcaattgcttgactgcttccctgtgcccggtgcgcctgttggagattccagctgctgccggacccaaacccattggacaccacccatgaccactcgtcactgcatcgagtgcctgttctctccatctctcatcccctcccccgcacatcatgcgcagggtgatcgccacgccgtatgccaagaagctggccaaggaactgggcgtggacctggccaccatcttcgggtccggccccaacggccgcgtgaccgccgctgacgtcgaggccgccaaggccggcgctgcggcccccgccgcgcccgcggctgcccccgcggccactcccgctgctgcagcggccgcgcccgcgcagggcaaggcggcgccgtccgcaccccctgcagccgccgccccggccaccaaggtctcggagnnnnnnnnnngctcctgctgctgcagcggccgcgcccaccgccgcgcccgcgcagggcaaggcggcgtcgtccgcatcccctgcggccgccgccccggccaccaaggtctcggagctgaagggcacgacggtgcccctcagcggcctacagcaggcggtgagcaagaacatgctggccagcctggcggtccccgagttccgggtgtccatgaccatcggcactggcgcgttcgatgccctgtaccgcaagctgaagggcaagggcgtgagcatgaccgcactgctgtccaaggcggtggcggtcgcgctggagtcgcaccccctgctctacgcctcggccaccgccgacggcagcggcgtgacctacgcggaacacatcaacatcgccaacgccgtggccatgcccgacggcggcctcatcacgcccgtgctggcggacgctgacgcggccgacatctacaccctctcccgctcctgggccgatctggtcaagcgcgcgcgcgccaagcagctgagccccaatgagtactccagcggcaccttcaccatctccaacctgggcatgtatggcgtggaggccttcgatgcggtgctgcccccaggcaccgccgccatcctggcggtggggggcagccgcccggtggtcactgccggcaccgacggccgcattggcgtggagaagcagatgaccgtcaacctcaccgcagaccaccgcatcgtctacggagcccaggcagcgggtatgctcaagggtggtgtttgttttcttggagaggagggcggggtgggagatttgcatgccctgcgcaccatggggctgagagtgggtatcactcctgacgttcttggtcgctcgtcaccatccccggccctgctcacctcatcctcaccaaaatcctctgacaacaacgccgcgcagagttcctggtgaccctcaaggccgtgatcgagtccccagagcagctggtatactgagccagcagcggcgccctgcggggtccagggaggtgtcccagagaattggaggagcagatagagcggcaagacttgtgcgggctctcgaggagctctgcaccagcagctttgatctggatcagttctgtcgccaggaggtgcaggcaagactcacgcctgcaggctcggtcgactcatcataccagatgcccaccctcaaaggcacttccagtgtgcatgcccggccctgatgcggacctttccctccccctttgcactggacatgcatgctgtcaatctctgttctgctatgctacctttccccgtgcccatgttgggagtgggcgctgatgccggggtcccgggctcctcctgtcctgccctcgccccacgccgagccttctcctacatgccgctgattgttcttcccctctgaaattcatatactggaagaagaagcgcatggtacgtacagcagagaggaacttttgatgtcctgcaagcctccacccctgggcctcccggagtgggttggctcctccggcccaccannnnnnnnnnagggaacttttgatgtcctgcaaggctccacccctgggccttccggagtgggttggctcctccggcccaccatccttccccgcgccggaaccttgagagcgcaaccaccagcaaaagtacgggttcggcatgacccaaacggattctttcgagtgaactcaagatgtgtggtcggtgatattcgggtcagcatgcagtccgggagtgcatgcctctccctgccactcgacaggcaggcgcggaatggaggccgggggagcaaggcgctccccctggcctccgccagatctcaattaccggtgctgacgacagtacaggagcctgtggcgggtctcgcggaggtagaggatccccagtgtcgcatctgctgggggggaagtgatctggagcctggtgagacggaagctgtggcggattgtcgcgagggcaacccatgcacggcatgccggcggagcttgttgcgagattgatgcacaagagtgctgatggtcctgactggattgtttgatgtgattggtatcgtcatgctcccccaaggggtgacccagagcttgccctgcccatgcttctcatggtcctgtgcatcactcacccagctccctctcgatcacgccaggtggtcgcctgctgaccccatgccaatgtcgggggagtgtggcccacgtccatgagcgatgcctgagcgagtggctcaatcaggccctgctggtgaaggccccccaccaggcctactcctgtgacctgtgccaggcatgttgcgcgtgcacgagcagtgtttcagatgctcctttcggctccattcaggataatatcatccacatggtggtgcatgcatcatgctcttcatgcttcccagccctcannnnnnnnnncctccttttggctccattccggatgatatcatccacatggtggtgcatacatcatgctcttcatgcttcccagccctcattgttaagcgcctcatgtccccttccttcacaccctcccatatccaggctccgtaccatgcgacccgctccgctttcctccctcagctcccgcccctgcggctgcccttccagggcctggcgcgggagctgacccgcccccgccccggacctcccctgctcgcgctctggtcaactgccgtcaacgcggtggcgctgggcgccgccctggacggcgcccagcgcgccatgcgcgccgcgccggtcgaggcgctggcggcgcgcggccggccgct

SEQ ID NO: 35350 - DNA, 80 bp, Chlorella protothecoides
ctggctcacaggtgtcgggctggaaccccgccccagtgccccgctgtgcggccggcttctgcccagcttctgtttgcgct

SEQ ID NO: 35351 - DNA, 61 bp, Chlorella protothecoides
gacccttggcaaggtgggtacggcgggggggtgtgccattctgcagactgcagagacctat

SEQ ID NO: 35352 - DNA, 61 bp, Chlorella protothecoides
gctgagatacagcgcatacactctactccatgccccatggccggcccatgcggtgaaggca

SEQ ID NO: 35353 - DNA, 68 bp, Chlorella protothecoides
ttccagccaactggaagaagagctggctctttcatcaaccccgcagggacgcgatgcagctggtgcgg

SEQ ID NO: 35354 - DNA, 78 bp, Chlorella protothecoides
cccacaactccgtccacgtctccacgccattgcagatccgcttgtgccggtgggcatgcagggtggtgtgacaggcgc

SEQ ID NO: 35355 - DNA, 61 bp, Chlorella protothecoides
cagtcgccactccagcgctcctgctcggcgacccgccgccataaggagagagcggcctcca

SEQ ID NO: 35356 - DNA, 77 bp, Chlorella protothecoides
cctttcttccccatccttggtggggaacgaacccggttcaaaccctggtcacagccacacggcgtagcgcatgttga

SEQ ID NO: 35357 - DNA, 103 bp, Chlorella protothecoides
cgagtgccctgtgtgttggtggtaagagggctgcttcatcaccgcaggccttgtgcgtgcgagacggaaggtgtgccctgcacaccgccatgagcagctgccg

SEQ ID NO: 35358 - DNA, 171 bp, Chlorella protothecoides
tgatgggagtggacactgtgggctttgctcgctgagggtcaggacggcaggtggggggattgcatggctgtacgggtcggcacgatgtggacatgtccaagtggcagcagcaagcgggccaggacgtccgccgggcagcaacagccctccccaccggcctgccgctcacca

SEQ ID NO: 35359 - DNA, 89 bp, Chlorella protothecoides
ggtcggtccagggacacccttaggagatcgcacgagtcggcaacacacatctgcggagtttatttgtcactcttacaattgtttcaggc

SEQ ID NO: 35360 - DNA, 164 bp, Chlorella protothecoides
aaggatctgcacatgcgtgaaggtggagaggatggtgaacatctctctcaaaccggcaaaacacgctcgcatgccatggagagatagcttcagtgctttgtgccgagctcagtcccaccaatcagaccgctgcgtgcctgtcggctgacacccgacccctcaaa

SEQ ID NO: 35361 - DNA, 79 bp, Chlorella protothecoides
gcgagccctgccacggcacccagtggtgcgccgatgagcgttgccaacaccatgatgagagcactcaatgaaatggata

SEQ ID NO: 35362 - DNA, 81 bp, Chlorella protothecoides
catgctcgccatccacgcgcggctcgcctgtgcaccgtgcatggatgggcaagatcctcgaggcaaggcaggctgagagcg

SEQ ID NO: 35363 - DNA, 95 bp, Chlorella protothecoides
ggccacactcctgcagccaggggtgagtgcagcatggcttggggcacgggatgggtacgtagcaggggcatcctagagaacatcaggagactgca

SEQ ID NO: 35364 - DNA, 36816 bp, Chlorella protothecoides
  modified_base (811)..(820): a, c, t, g, unknown or other
  modified_base (1325)..(1334): a, c, t, g, unknown or other
  modified_base (2256)..(2265): a, c, t, g, unknown or other
  modified_base (2982)..(2991): a, c, t, g, unknown or other
  modified_base (3136)..(3145): a, c, t, g, unknown or other
  modified_base (3375)..(3384): a, c, t, g, unknown or other
  modified_base (4178)..(4187): a, c, t, g, unknown or other
  modified_base (5088)..(5193): a, c, t, g, unknown or other
  modified_base (5746)..(5755): a, c, t, g, unknown or other
  modified_base (6457)..(6466): a, c, t, g, unknown or other
  modified_base (8693)..(8702): a, c, t, g, unknown or other
  modified_base (10061)..(10070): a, c, t, g, unknown or other
  modified_base (10575)..(10584): a, c, t, g, unknown or other
  modified_base (11322)..(11331): a, c, t, g, unknown or other
  modified_base (11699)..(11748): a, c, t, g, unknown or other
  modified_base (13158)..(13167): a, c, t, g, unknown or other
  modified_base (13903)..(13912): a, c, t, g, unknown or other
  modified_base (14490)..(14499): a, c, t, g, unknown or other
  modified_base (14961)..(14970): a, c, t, g, unknown or other
  modified_base (15967)..(16009): a, c, t, g, unknown or other
  modified_base (16487)..(16496): a, c, t, g, unknown or other
  modified_base (16654)..(16663): a, c, t, g, unknown or other
  modified_base (18081)..(18090): a, c, t, g, unknown or other
  modified_base (18747)..(18756): a, c, t, g, unknown or other
  modified_base (19678)..(19687): a, c, t, g, unknown or other
  modified_base (20946)..(20955): a, c, t, g, unknown or other
  modified_base (21745)..(21754): a, c, t, g, unknown or other
  modified_base (21973)..(21982): a, c, t, g, unknown or other
  modified_base (23751)..(23760): a, c, t, g, unknown or other
  modified_base (24338)..(24347): a, c, t, g, unknown or other
  modified_base (24871)..(24880): a, c, t, g, unknown or other
  modified_base (26337)..(26346): a, c, t, g, unknown or other
  modified_base (26788)..(26797): a, c, t, g, unknown or other
  modified_base (27439)..(27448): a, c, t, g, unknown or other
  modified_base (28266)..(28275): a, c, t, g, unknown or other
  modified_base (28950)..(28959): a, c, t, g, unknown or other
  modified_base (29612)..(29621): a, c, t, g, unknown or other
  modified_base (30051)..(30060): a, c, t, g, unknown or other
  modified_base (30369)..(30448): a, c, t, g, unknown or other
  modified_base (30702)..(30711): a, c, t, g, unknown or other
  modified_base (30863)..(30872): a, c, t, g, unknown or other
  modified_base (31200)..(31209): a, c, t, g, unknown or other
  modified_base (32023)..(32032): a, c, t, g, unknown or other
  modified_base (32540)..(32549): a, c, t, g, unknown or other
  modified_base (33419)..(33428): a, c, t, g, unknown or other
  modified_base (34767)..(34776): a, c, t, g, unknown or other
  modified_base (34956)..(34965): a, c, t, g, unknown or other
  modified_base (35388)..(35397): a, c, t, g, unknown or other
  modified_base (36261)..(36270): a, c, t, g, unknown or other
  modified_base (36486)..(36495): a, c, t, g, unknown or other
ggccggcgcccgtccccgccgcggcccagcagcaccagggtcgcgggggcccccagggtccaccgcgcggcgggcgcgggcgtggcggcgctgggcggccctggcagcagcagcaggtggcgggcgggcgtggcgaggggggcaggacctcctcgcagccgcagcctaagtgagtgtggagagggaagtgatggtcgaggcagggaaggggtgtgtgctcctgggggatgggtgccttgccgccacggcgacgccttgcattgcagcctggtcgtgctcatcggtgagcatggcccggaacccccgcgccccttccccgcccctcctgacgcccatccctcgtgcccgggtgcagggatggcagcggtggcaccagcgccgggcagccccgcgagcagcaggagggcggcgagccgctcccagccccagccccgcgccagaacaacggacgctggcgggggcagcgcgggcggggcggggctgcggccaaggcgcagcccgcacagcaggccgggggggagtgagggaagtctgtgttccagatcctcgcattcccgggaggtctgctgcagggtttcgcggcatgccctggcacagaagggctcggccctttgcccgtgccccacacattcccctccggcgctctctgaaacatgaagtgctgtgatgccaagactgtgacctctgcaccagttggccggcgagcttgggttagggggtcagtgttgagggatacgatcaggaggcccgggtccaggcgtgggcgcctgaagccaatgaagcatgcaggttgtggctacatgccgcgctnnnnnnnnnntggggggtcagtgttgagggatacaatcaggaagcccgggtttaggcgtgggcgcctgaagccaatgtagcatgcaggttgtggctacatgccgcgctggatcttggagtcgagcaataatgcagaatcgctgcgccctcaaatccgtcagagatcaccataccgtgaggggcagtcccgattctgagtcgatcatgaggccctggccgccgcctcacggcttgcatgaaaaatggctgcccaggcaagtgaagctcgccatccctccgccaggagctaagcatgtttcgtggatgttcgggactcggaaatgggtacctggaaccgaacatggctatctgtgtcgccaaggacggttagaagttcatgcaacagggtcatcctagaaggatgttacaggggtcgtctctgttaatctcctggagtccccttgctgcagcggcttctttcgaaccttttatcagggcatgccaagagacggagggcatggagcgaggccaagcannnnnnnnnncttcgaacctttcatcagggcatgtcatgagacggagggcatggagcgaggccaagcagatgagcaggctcccagacaacagagtatcagcttccgcctctcatgcaagggtaagagaaagcagtgttgcaatcccactcagcgcagacgtacggcagtcagaccttggagggaacaatgcagcgtgcccgggtctgcccagccgaggccgccatcctcgggctcagccgcctcctgggcggcccgctgagcctcctgccgggcaaactgccaggccatcagctgcttttgctcatcgggtcccagagccggctcacgcggcggcctgccggaggccttggggtgcacccagacgatggcagatgtcttttcattggtgcccagggctgtggagagggggagagcagggtccagtgtcttgccagcaaagaaaaggtgaactgcatctggatcgattggcgctgatgcgatgggtccagtctctcgtttggggtcggggagcgcgggtggatgaacaggctgggatttggttggactgatgcgggcctcatcgccaggcgccgccgtattcagcagggcaacgatggacctaagcgctgctccagcattctcccagacagacgcctcgtagggcagctccggccttccgtgacactacagtgtgatgcatacatgtttgtggatgtagtccgatacagctttggtatcggagatgccctttacggattctggctcaccttgacccgaagtttgaccatcgagccgaggaatggaatcgacgtcgctgaagagaaaaacagtctcctctaatcttgcggcggatatctatcgaatcccgagtcacatgtcaataaaccaatgtttcatgctccacttgcggtaaaagtgccgtggcgccgatgatggggttcattgggtacannnnnnnnnngtaccgagtcgcatgtcaataaactaatgtttcatgctccacttgcggtaaatgtgccatggcgccgatgatggggttcattgggtacacaacatcttgttcttgcagagtgtataggcatctggaaaagagggaatattgctatgtcggccgaattgctcagggtggcttgtgtcaccctcttggatatggagatacttgtcaggtgtaggttcccttgccaccgccctcgcatctttcggcagcctgggcgcgccttggaaacaattttgatgatcatgcgcactcagccgcagatactctgcggtctgacaaacgttaaaatgtaaaaatatactcggatcattcaccactatcaatgtgaaccccgattgctgtgtcagggcatggcctcgcaagtgccaccccggctcctggcatgctgggtgatcttgctggctgtgctgcttcgcgtgatcctgggccttcactcttattctggtgtgtggcttggagatgggatagctcgggaagcgaggctgaagtgaccattctccgcgagatcggatgtctcccttgtccccttgcaggtgcgggtgtcccacccaagtatggggactacgaggcccagaggcattggatggagatcaccatcaaccttccactgagccaatggtgagatgaatcaagaggtcatgcggcgtcgcgtcgggtatgccacgatcatccccccccccnnnnnnnnnnggccaatggtgagacgaatcaagaggtcatggggcgtcgcatcgggtatgccacgattatctcccccccctcttttgctgcctaatggaaagttgttccccacgcaggtacacaaattccacacagaatgaccttgcatactggnnnnnnnnnnagttgttcatccccacgcaggtacacgaattccacacagaatgaccttgcatactggggtctggactaccctcccctctctgcctaccaggtgggttgccctggcatgtgtcacatgataacaaggtcggcgggacaccgcctcccaccaagcaaacccactctcctgcaatgccgcacagagttgggtgcatggaaaggtgctgcagcggtgggtgcccgaagccgtgnnnnnnnnnncgcataccgcacagagctgggtgcatggcaaagtgctgcagcggtgggtgcccgaagccgtggccctggggtcctcgcgcggcatcgagaccccccggagcaagctggcgctgcgtcagacggtgctcgcctcggacctggccgtctacttcccggctgccgccttcctagccctgaccctgcatggcgccagaccgtcgcggcaggccgtcaccacgctggcccagctgctgcttggcccaggcctcatcctgatcgaccacgggcacttccagttcaactgcatcaatctgggcctgacggtgaggcagtttgatgggagggtttggcatgggccaggcctgatgtggctgtggacagagtgcgttcccagtcccaatagtacggctgtgacgacccaggcctgcactccccatggagagaaaggagccctcccgggagcaagctcgcctctcaacccctcacaccaccgcagctggcggctgtggcatgcacgctgcgaggcagcctccttgccggagccgccctattctgtgccgcactgaaccacaagcagatgatcctgtactttgcccccgccttcttcagccacatgctgggcacctgcctgcagcaaagatccgcctggggcaaggtgggaagtggggttgggggagggatgaccccaaccgagctgccgcgttgccagatgcctttcctcaggcttgcgcccgcgtgtacttcccatagctttccagctccccgcggccaccctcgcaccctgcctccgaactccgacctccaccccgcccacnnnnnnnnnncaccagatgcctttcctcaggcttgcgcccgcttgtacttcccataactttccagctccccgcggccacccgcgcaccctccctccgaactccgacctccaccccgcccacaccagctgttcctgctggcgtccatcggcggcgtcgtgctggcctcctttggcgtcgtgtgggtccccttcctcgcaaccccagggggggccctccccgtcctgcgccgcatcttccccaccgcgcgaggtctgttcgaggactacgtggccaacctgtggtgtgcaagctcgctggcgatcaagtggcgccgcctgctggccccctcccagctgctgcgcctctgcgcggccggcacgctggccgccgtcctgcccgccatggcctgccagctgcgccggcccacgcgccgcgccttcttgctgggcctggccaactcctccttggccttcttcctgctggcctaccaggtgcacgagaagtcggtgctgctgcccctggccgcgctgggcacactgggcgggcccgccgcagagctggcgcagtatgttggggtgtactccatgctgcccctgctgcgcaaggacggcctggccaccgcggccgcggccgtcgccgtcgcgtacgccgccgtgctgggcacgctgcgccccgccttgcccccggcctggcgcgcggcgcgggcggtcttcctggcgggggcagccgccatcacggttggcttctgggcggtgccgccgccgccgaggtaccctttcctggaggacgccgcctgcatggcgtggtgctgcaccgccctggtctgcctcttcggctacaccaacgtactacaggtacaggagtgctgggggccaggggcggcgcggcgcggccgccacggcaaaagaaagggcgcgtagagcgagtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcctcggaggcagacctcgccggtcctgcaggccccgccgcctgggtgggtggcggcgtgtagcccgaggtcggcagcgacgtgccgttcaggggcggggaggcaggcgaggcggcggagttgaaggggtctcgccgcccagacccgccgaggccgaatggctggtactctgtcgcgcccgcagcggagcctgcagtgtgagagggtggaggaaggatgaatggtgctcaagggatggccaaaggagaggcattgcatgccctccatggggcctgcgcctctgctgcgatgtgcagccttggagcacccttgactcccgcttctgttgcatctcacctgaggtggcctgcagccactggaaggcgttcaccaggctggctgccttcaccgtgagctggatgatggccagtacccaggctgccaggccgtggctgcctccgataagccaaaacacgtcggccacaatgaatgcgggggacaccacctgggaatgatggaggtggatggggagctgcatggaccccaaggacatggcaaggggtgatcacaannnnnnnnnncgcgggggacaccacctgggaatgatggaagagggtgggaaggtgcatggacccccaaggacatggcaaggggtgatcacaagagacactgtctctcatccctgaaccacgcagacgggggaacttgcgggggcatcgtcgcaccgcccggccatctgagcaaaacccaccaggaataaagacagcagttccctctgcgtccagaccactgcgacgaggcccagcaccgccacagccgctgcagagtcgctcaggaatgcactaaggcctagttgcacgaccagaagccacttgagccggtcgcccggggtatcgaagtccaggctgagatccagtacgctcgccatctcgccaggctggtcagggggcgtgagtccggctgcgtcaggcccgggatacgagatcggagctgtgcactgtagattccagaggttttcggtgttctgatgatgaggtgaagacgattcaagggcggcgtctcggcgagaagggtgctcccgtctgtcggatccgagttcctgtcgtcgcgcgcgcgctgcatgtttgttgcttacatgattaaggggaggcgcctcggcccttccccccggtgcattgggggaccacgaccagccctcataggccacccaatcccacgcacatggcccgccacccgactcaaaactccagtcagtatcactgcgccttggcggccgccagctnnnnnnnnnnaaatcccacgcacatggcccgccacccaactcaaaacttcagttagtatcactgcgccttggcggccgccagctcggcctgcagctgcgggatgacctcaaacaggtcccccaccaggccgtagtctgccacctcgaagatgggcgcgtccgcgtcggtgttcaccgccacgatggtcttggcgtccttgatcccggccacgtgctggatggcgccggagatgccaaaggccaggtacaggtccggggccaccaccttgcccgtctggccgacctggaggtcgttgggcacgtagccggcgtccaccgcggcacgcgaggcgcccaccgccccccccagcgcgtcggccagggcctccagcaacgcaaagttctccgcggagcgcagcgcgcgcccgccggagaccaccacccgggcctgtcccaggtcggggcgctccgaggtgcccacctcctcggacacccacgcggaggtgctggacgcgtcctggccagtgagttcggggggcgggatggcggggtcgttggggaaagggtggcgagggttccagcatctgcttggaagtgagggagccgtgcgcgggtgccacgccgcggcggatcacaagcgaagccgaagcccagactccagccaggcacgcaacccaccttggcggcttggagctcctcggcgctgacaggctcgatggccgctgggttcccggcccgggcgggggccggtgggaaggacgtcgtgcgcacctgcggaggagtcgagcaggggaatggtgccgagagattcgccacggtgctgtgtgacgctggcgtcgttgattcccacagcaccctgtgaatgaaaaccaaccgctcccacttactccagaagacaccaacccgcctcccacccccagcccctcctctcaccgtgagcatctgcagcccctccgcgggcgtctccaccgtggcgagggcgttgccggcgtagatggggcgcacaaaggtgcatggcccctggacctccaccacgtcggccaccgcttgcacgtccagcttggcagcagcgcgtggcagcaggttcctgccatgcgtgctgctgggcgccaggatgtgcgtgaaggacctcctgcttgtgtcgtgggttcaaggagcgggagggtggcatggtgctgtacacgcgcaggggtgcagcaggcagcgtacctataccgatcactccccctggtccccctgcttccttcacgatctgcagcggcaccctctgccctggaaactgcgagcacccccgatgcagtcgccctgacagaacaccccacctctgctgcaccgccacgatcagggctcccgcaggctcggccagctggtgatccagggcctcgtcatccgccgtcagcacggcggtcacgccctccagagccgcgccggcgctgggtgccccccccaggcccctgccggagaagaggagggtgacgggcccgcccaaggcgcgggcagcggagacggcctgtgcggtgctggggtccagcctcccccccttttgctcggccagaaccagggtgctcaagccctgggcacaggtgggaaggggcgaaggcaggtcaacaatacgaacatgaaaacgtgcacaggaggcgagatgtcagaacggcatgccacgcaccattctttgggagatggagcgccacaggcgggggacgctgcccatcatcgtcccggaagggcagcgaccgaagcgcatgcttgcaatccacgcgtcctacctatgcagaatatcgacgctgtatcatcaattgcaaagacaagcgggtggtttctgaaccgttcgctcctaagttgctgtcgatgtgggccgcgtggggcttgtgtcgggactcgcgcggacctctcggcaaccggatgccaggtcaacggaaggaaagttgcacgagttgaagaaggctgggccgacggatgaacaaaccactcaagtagttgaatgtagtttgaatccactgttcagtagtaaccatagtgtagggaatctgcatgactaagtttgctgaaattgctggacatactcagatcgggcatgcaatgtacatggccttaagcaaagaacctgctgggcctccttgtacactgctatgcacgtcaagtccaacatcattgtcatctattttcctgtattatcattttgaggtgatctctcaacctaaagttgctggggatgggaaagtgtgtggctggaaggtcagagttgtttgtatcctccnnnnnnnnnncgttcctgtattaacaatttgaggtgatctctcaacctcaagttgctggggatggtaaagtgtgtagctggaaggtcagagttgtttgtatcctcctgacatgatctttcagtagacaattcgcacggttatgatctccatgtagaacaaatgatcaaaccaaagtttgtcagtggatgcatgcacgtactgagaaactattggaatacacaatgcacatcactcccgaatgacacgtgggcgccaagttgaatttttggatcctcagaccagtgcacgatcgaacaagcctgaatcgccaaacaggagacactgacgccccgtacaactcctggctccgtcttgattgcccgtaaccctgtgcgatacgagcgccgcacttggaagattgctgggggtggcaatcggctcgcagcagcatgacgtcccctagagccctctgagagctcaacccttcgtagcatgtcggccgcccatgtcaagcggcccgcaacagtcatggaggggaaggagaacctcccttccaagcgccctgccccagaagtgggcccagaggtccccgcccctgtcccggacttctttgatgtgacggacgacgggccagaggtggtggaggagatcgaggagggtgccctcggcgaggccggcaggaactggccacgcccaccagccgctccactggatgccagcagggacaaacttggtgcgtctggtatttcatggggctggcttgccgggaatgggaagcagcctggcaatgtgcgctgcttgaacagcgtcatgcccaaaacccactgcagtgttccagcagctggagctggattacacctctgggccccccaacaagcggttttacaatgcgcagctgcgggaggtccccatcatccgcatgtttggagtcacagagctcggtgcggtggcgaggaggggtgtttttaatgcaccaggtcttgcctcacgccggcgctgacctgcgatcaggccttacgtcgcgacctgagactgctggactaaatgtgcgcatgctttgcgccaaatcgaccccatgctccactcctgtccgacccggcaatagggaacagcgtgtgcctctttgtgcacggcttcgagccctacttttacatcgagtcgccgagacccaccttcagccccgacgactgccaagcgcttgtcgagatgttcaacgtgcgtgcctgctctgaattgagaattcgaaggggccttgtggtgtggctggggcaggttggctggatgcccatgcaaggaggtgcttgcgcgcctgagtcgtggggccttgcacaagatactgctcgacagctttcccacctctcccctccccacagaacttgctggcgacgnnnnnnnnnngaggaggtgcttgcgcgcctgactcgtggggccttgcacaagatactgcccgacagctttcccacccctcccctccccacagaacttgctggcgacgaaggaccgcagcgggaatgcgcagtgctgcctgcgcattgaggtggtgcagaagcagagcatgatgtactatcagcctgcaaagtctcgggctttcctgaaagtggtcatggccctgcctggcctggttgctcccgcccgaggtagggtgatgggctatttgacagggtggcaggaggactgttgagtggttgacgagcacttgttcaacataaagtcccgaggacatgtaagtgcgctgcatgtctcctcccttgtgcccagagatgtgcgacggctatcagctggtcatacatgttctcctgcccctttttcatccaccgtccctgctacagtaatgagtaatataccccccccctttccctcctttcttcccaaccccacaggcctggtagaaggcggcctgtgnnnnnnnnnnggagatgtgcaacggctatcagctggtcagacatgttctccagcccctttttcatccaccccccctgctacagtaatgagtaatccccccccccccctttcctcctttcttcccaacccccacaggcctggtagaaggcggcctgtggctggagtggctggcctgccgcctgccgcagaccacgtacgagtccaacgtgctctacgccctgcgcttcatggtggacaccggcatcgtgggtgggaactgggtggagctgcccgcgggcaagtacgtgctcaccccgggcccctcccagctctcgcactgccagctggaggcgcacatcgccgccgcggacctcgtcagccacgcgcccgagggcgcgtgggccaagctcgcgcccttccgcatcctgtcggtggacatcgagtgccagggacgcaaggtgggcaggctgcataacagggagtgactgctgtggcggatggccaggcatgcgtgcttgcaagggaaagtggtgaggctgaagaacagtgccatgtgtgggcctgaggcccttcgaggaccatctgcgctcaccaagcagcaaccggacaccactgtcccactcagccggtgctgacgtgtcacgagttcctttccacaccacccgtccacccgttactcttcctttccagggccacttcccggaggctcagcacgaccccgtcatccagattgcgtctctggtgacagagatgggcaaggccacgcccnnnnnnnnnnacgtctgcgttcaccaagcagcgaccggccatcactgccccactcagccggtgctgacgtatcacgagttccttcccacaccacccattcacccgttactcttcccttccagggccacttcccggaggcccagcacgaccccgtcatccagatcgcgtccctggtgacagagatgggcaaggccacgcccgcggtgcgcaacgtcatgaccctgcgtgactgctcccccatcgccggtgccggtgagttggggacgggtgcggagggcgatagcgcccgcgcgcttcgcgccaccagccgcctggcctggctgctgccgccggattccccggtccactttcgctttgaaggatgcgcccagggccatnnnnnnnnnnnnnnnnnnnnnnnnnnnnnnnnnnnnnnnnnnnnnnnnnngaggacgagaaggacctgctgatgcgctggcgcgacctgatcatcgagaccgaccccgacgtcatcatcgggtacaacatcatcggcttcgacctgccctacctgctggaccgcgccaccgccctgggagtgccgcagttctgggcgtggggcaagctgcgcaaccggtgcgcacagggatgaggtggacctcgatctatcacctttaccagcaggagtagaaattgaggcactgcatgcagaacctgcacttgggacccaggtgcacacagttctccatcaacccgttggcgatggcccccacggacccaagccgaacagcacccctccccctccactccacccctccccacgtccaccccaggcggtgcaaggtcaaggacgcgcgcttcagctccaaggcctacggcacgcacgagtacaaggaggtgggtatcgaggggcgagtgcagttcgacctgctccaagccatccgccgggaccacaaccttagctcctactccctgaattcgggcgagtgcatgactgggttggattgtttgtggagtggggtaggcaggcctatcgggtgcgtctcctgtcggggactgaatcccgaagaggcgcagggcgggcgaggccgtgctgcaggagcggctgcgtgcagggtttctgacggcacacagggggcctggtcagctgcacatgcctcgcgacaagccgcccgagcactccacccaacacattcacctgaagaccttccagtgctgcgcctgcagcccacacgcatgcaatcaccacccctcatcccacagtgtctgcccacttcctgggggagcagaaggaggacgtgcaccactccgacatcagcaagctgcaggacgggaacagcgagacacggcgccgcctcgccatctactgcctcaaggtgccccacgagggtgtggtcgtgttgggtgaaggggtgggtgaagagcaagcccagcgagtgttgcagtgcacaagtgtcagtggggagctgcgcgtacatcttcccatggcctgccggctctgttccacactgctgcaggctgtcaggccccacagcgccctcctcgtggtgttgccctggtccctttgtttcccccacggacatttcctcatccccctctaaacttctctgttcccggccgcaggacgcatacctgccccagcggctgctggacaagttgatgtgcatgtacaactacatcgagatggctcgcgtgacgggcgtgcccatgtccttcctcctggcacgcggccagtccatcaaggtcttctcccagatcctgcgcaagacccgggccagggggctactggtgcccaacatgaaggcgaggggactggttctgtttgtgtcggagacgagaaggaagggaaatattgatatcataccccctttcagccacnnnnnnnnnntgaggggactggctctgtttgtgagggagacgagaaagaagggcaatattgatatcataccccctttcagccactcctcatacaagcacccactcctcgtgaacttcccacatgcccctcgcagaggggcggccagggggaggacggcgtggcgtacgagggtgccacggtactggagccaaaagctgggtactacgcgactccggtggccacgctggactttgccagcctgtatcccagcatcatgatggcgcacaacctgtgctacaccacgctgctgcctcggggcgcgcacgcttcgttcccggcgacgggggagggcgcgcgcgccgtggagtcgcccagcggcgagcgcttcgtcaagcccgagctgcaggcgggggtgctgccggagatcctgcgcgagctcctgtccgccaggaaaaggtgcggtgtacggtgtggagccgttgctgtctggtcatcgggtggtgaaagggttgaggtcgacggggtggtgtgcttgctgctgccccaggggcgaggtggaggggcgaggtggaggggcgcggtgggcgcctgtgggaactttgatgcagccggcatttcttgtgtctggccaaggatgggcgggttgataattccaccacggcagcgccgttcaggggacaacaaaagttaccgttttcttttccgctcgctacagggctcgtgccgacatggccgcggccaccgaccccttcctcaaggcagtgtnnnnnnnnnnagtgtgcttgctgctgccccaagggcgaggtggaggggcgcggtgggcgctcgtgggaactttgatgcagctggcatttcttgtgcctggccagggatgagcgggttgacaattccaccacggcagcgccgttcaggtgacaacaaaatttaccgttttcttttccgctcgctgcagggctcgtgccgacatggcctcggccaccgaccccttcctcaaggcagtgttcaatggccgtcagctggcactcaagatctccgcaaactcggtgtacggcttcacgggcgccaccgtgggcgccctgccctgcctcgagatctcctcctcggtcacgtcctttggcagggccatgatcgaggccacaaagtatgctggaggggttgttgttgtggttggtttggggtggacgggactgactgctctgccgagcgtgtgctggtgtctttcagcagacgaaggccctgcacaactcgctgccgttactgaacagggcagcccagtacgcgtcagatcctcttttcccaaaccccatatcctcaactctcattcccgccgccaggcaaaaggtgatgtcgacnnnnnnnnnncgctggtgtctcccagcagacgaaggccctgcaaaactcgctgccgttgctgaacaaggcagcccagtacgcgtcagatcctcttttcccaacccccatgccctcgactctcactcccgccgccaggcaaaaggtgatgtcgaccttcaacaaggccaacgggtatccagcagacgccgacgtcatctatggcgacaccgactcggtcatggtcaactttggggtgccggacacggccaccgccatggctctcggccaggaggccgcggatctggtgtccaagacctttgtgcagcccatcaagctggaattcgagaaggtatggatttgagggagggcaggagtgccgtgcttcaccccacgagccatcctgcaagcaccatgcctttcgcgacttcctgattttttcatccaaccccgtccctgcccttcccctcgccctccaccccaccccaccccccnnnnnnnnnncagcttgtcatccaaccccgtccctgcccaccccctcgccctccaccccaccccacccccccgccccccaaaggtgtacaacccctacctgttgatcagcaagaagcggtatgcgggcctgctgtggacccgggccgaggcctgggacaagatcgacaccaagggcatcgagacggttcgccgcgataactgcctgctggtgcgcaatgtgatcaccacctgcctggacatgatcctggtgcagcgcagtccggaaagggcggcggagtacgtcaagggcgtcatcgccgacctactcatgaacaagctggacctgagcttgctggtggtgtccaaggtgagcatactttgtggtggaatgggggggatggggtgtgtgtagatggagttgggagacacacgagcatccctttacctcattccctctccttgcctccgctaacacccagaagtatctcaccaccctgcacaagcatcaccccaccaccgtcccatcacagggcctgacccaggacgcggccgactacgagaccaaggccgcgcacgtggagctggcgaagaaaatgaagaagcgcgacccggcgacggcccccgccatgggcgaccgcgtgccctacgtcatcatcaaggcggcgcgaggggccaaggcttacgagaaggcggaggacccgctgtacgtgctgcgcaacaacctgcccatcgactcgcagcactacctggaccactacctggcccagccgctgatgcgcctgttcgaacccatcctgcggaacccgcgcgacctgctctgcggcgcccacactcgcgccatcctggtgtccacccccagctcaggatcgggggggatcatgcgatttgcgcagaagaaggtcacctgcctgggctgcaaggccgcgctggggcctggggagaagacggtgtgcaagcactgccagcccaaggtatgtgtgtgagtgtgtgaattgctaaaggggggggggggggggggggggggggnnnnnnnnnnnnnnnnnnnnnnnnnnnnnnnnnnnnnnnnnnnggctttgggagtggatgaagtgttggtctgggtagggaagtggactttgaaggagacaggactgacaggaatgcatcgcacctggcacccaccattcccgatcaacgcactctggaccccaaccgaataacatctgcaatcaggagggcgaggtgtactgcaagacggtggcggcggtgaacgacctggagatgcagtttgccgcgctgtggacgcagtgccagcggtgccaggggtcgctgcaccaggatgttctctgccgctcccgcgactgccccatcttctaccgccgcatgaaggtgcagaaggaggtaggggaggccgcggcctccctggccaggtttgacgagtggtgacgccgaccaaagggtggaagaaaaggatgctggacgctctcggcagagcctcgacagagcatgccgcagccctgctgcccactcgcaacatgtcactgctgtatgactccagcttgtctggnnnnnnnnnntgacagagcattgccgcagccctgctgcccactcgctacacgtcactgctgtatgactccagcttgtctggctggggctttgcacgatcctgtggggttgtataatctaaacagcaaggtgaatccacaaaggctttcctcctgcccagagatgggtnnnnnnnnnntctgtggggctgtataatccaaacaacaaggtgaatccagcaaaggctttcctcctgcccagagatgggtagacattgatcatccgaaatcgtcaggcaaagggctctggcattgggcatcctcactcacacatgatcaggcggagtttaaggggtcgtctctgtgaagcggcaagagggatagccgtaatggcattcgaatggagaggagtattcaatatagactgggagggcgttgaagtgaaagttgatacctggtgctgtttaggcaaaacttgttcccaagttagccatacttccaacccggatgtgcttccggaggatgctccgcgcgccatgactcacctccacgtaaggcgatctagtgtcgcaaacccgcgacgtgtctccctcggaattttggacacggccttctagatcccaggaacccgtttaaatgtataagaatagttgcaccggaacttcgagatcaaggccactgcccggcggtattgtttgagcaggacgccgggtgcccccgcggcacaacactcgacctcgatccccgcatctgggaaggaaatgagacggcacgtcccccttacccgtcgtatcgtggctgttctggccggttactccggaactggagtgcacagcgccacacccgcatgggccttggccttcagcaccagcggcccgacccgggatgccggcacctcgggccgtctcttcaacaagatcctggtggccaaccgaggggagattgccgtgcgcgtcatgaggacagccaagaagctgggtaagacagtgttcacattctgagccctcggctgcctggaaatgtctgccttcatagtcagcaaggcatccctggtctcttgcttctgcgcacctgacaatcccagtgatcacgagtgctcacctctcctgccccctgctggcccccaatcaccaggcattcccactgtggcggtgttcagtgatgcagatgcgtcggcggtgcacaccagattcgccgacgaggccatcaacatcggcccagccccctccactcagagctacttggacatgcacaagatcctggctgccatgaaggcaacgggtgccgacgcggttcaccccggctacggcttcctgtctgagaacgctgcgtttgcgcaggcggtggaggactcgggggcggccttcgtggggccaccccaccacgccgtgcacgctatgggcgacaaggttggttgggatggtcgggcatgttgctgcggggcaaatggggtttggaagttgttgagaatgtcgacctgcatgcccagttcctagcctcccagcctctcagtcaccacgggcgattaagcacgcagtaatcagtggaccccaccgcgttgatcggccgttcagccagcgcaacctgtaatcacccatcccctcacaccacctaccannnnnnnnnntattaagcacgcagtaatcagtgaaccccaccgcatggatcggccgttcagccagtgcaacctttaatcacccatcccctcacaccacctaccattcatgcccaggtggaaagcaagcgctttgcgcacgctgcgggcgtgaacaccattcccggctgggccggggtggtggaaagcgcggagcacgccattgagctggccaaggacatcgggtacccggtcatgatcaaggcgtccgcgggcggcggaggcaagggcatgcgcatcgcctgggacgaaaaggggctggcggagggctttgagctcgcgtctcaggaggccgcctcctcctttggcgactcccgcatgctcatcgagaagttcatcgaggagccccggcacattgagatccaggtggggggatgtggagagaggggctgatgggtgtggggtgccaatatagtgcgtgaggctgggtgggttgaatgaggggaacatgcctgggggcggggaaggggaaggggtgatgaggtgaggaaaggacaaccagagcatgtcagacccggtacagggatggcgccacgatatatcatagtatacctcaggggcactggatgcacctgcgctgggtctgtgttgtagataaagctgcatggcagagagtacctcccagaccannnnnnnnnngaaggacaaccagagcatgtgagacccggtacagggatggcgccatgatgcatcatagtatacctcaggggcgctggatgcacctgcgctggatctgtgtcgtaattatggctgcatggcagagagtacctcccagaccagacacctgcatgcctgtccactcaccctcaccttgtccctctttcttccaccgcaaccaggtcatgggcgacaagcacgggaacgtggtgttcttccccgagcgcgagtgctccatccagcgccgcaaccagaaggtgatcgaggaggcgcccagcccctttgttccccccgagctccgtgaagccatggggaagcaggcggttgcgctgtgccacgccgtcggctaccactcggccggcacctgcgagttcctggtcgacaagcaccgcaacttctacttcctgggtgggtgaatgggggatgggatgctatgatggcatcatcttacagatgtctgtgcgggcaatgtcgcgccattgctccaacttagtcaccagccttattcagggtagttggttccccaccctaagtactccacaccccgcgctttcctagagatgaacacgcgattgcaggtggagcacccggtgacggaggccatcacgcggcaggacctggtggagctcatgctgcgtgtggcagctggccagaagctggacgtcagccaggaggaggccaactgcgtgcacggctgggccatggagtcgcgagtgtatgctgaggaccctgccaggggtgaggttgtctggagaggagtgaagggcttggggagcctggtgccttgggatgccaggcgtcacatcatgaagtttgcagccaaccagctcagtcaggcgtgcattggtacctccagtcccattccaccctttatgaggtttcaccctgtctcaacaacagacannnnnnnnnngtgtttggagagcagtgaagggcttggggaggctggtgccttgggatgccaggcgccacatcgtgaaatgtgcggccaaccagctcagtcaggcgtgcactggtacctcgagtcccattccaccctttctgaggtttcaccctgtctcaacaacagacaccctgaccaagacccgtgcccatttcccccctcgtccttcctttctcaacaggcttcctgccctcgacgggtcgcctgatgcgctacgcccccccccgcggggaaggtgttcgtgtggatacgggggtgcaggaagggtcggagatcagcatgtactacgaccccatgatctgcaagctcatcacccacggtgctgaccgcccccaggccctgcagcgcatgcgccagtgcgacggggggctttgttggtggggggtggggttggtaacgagggtttggtctaggttttttgggggggggatggggcctgttgcgtttccactacatacagacgcccagcacttgggtgcacttggttcctgagttgtacacgctgatgttcaagacgcagcagtccattgcgatcgcaagattccccattgttccagttaccgtggtcggtcctcgacgagctcggcctcctgtggccgcggttcacaccgggtgcaaggccacaaagcctcgctgcctgacggtggcatggtctcatccacaacccatcctctccaacagctccctgcccagccccaacctgcacgatgcatccactccgcagggccctggactcgtacgtggttcgtggcgtgcagcacaacatcccgctccttcgatcggtcctggaccgccccgacttcgtcgccggcaccttctccaccgcattcctcgcccagcactaccccagccccgccgactcagcacctgcggtgctgcccctgacccgggcgcaggagcaggagctgctggcgctggcggccgtgttgcacgttctgcgctccactgcgcgcgccgggcgaggggacggtctgtcggtgagtctattgtctttgggcatttccttccttagggccaaggaaagtgcttgccgggctcaggagtccaatgtatctgcaggccacgatcctcgcgccacatcaagcagctctcacaagtacagccggccccttgttcgactgctttggtgactacacgaaacccttgacttgcaatactcttggcccctatcacccccaaattcatccgaccccaccccgccaatgcaccaggagcccgtggacctggtnnnnnnnnnngcaagcagctctcacaagtacagccgccccctttctcaactgctttggtgactacacaaaacccttgacttgcaatcctcttgccccccatcaaccccaaattcatccgaccccaccctgccaatgcaccaggagcccgtggacctggtgctgacgatgggcgaggagcagttcccagccaggctgcggccttccccggccggcctggtaccgtcatcttccgccgccgccgccggccccagcttccaggtggagctggcggagcgcgtgctgcaggtgaccccggaggcgggccccagcgagctggcgggcgtgctggcgcgtgccagcatcgacggcgtgcagatcgcggcgcaggtgctggagctgggcgcacgcgacgtggcgctgcaggtggcgggcgcgcagcggcgcgtgcgcgtggcgacgcccgcggccgctgcgctggcgcggctcatgccggagccagtgcgcgaggacttttctcgcgcggtgcgttcgcccatgcccggtacgctggtctcgctggcggtggcggtgggcgacgcggtgcgtcccggcgacgacgtggcggtggtggaggccatgaagatgcgcaacgttctacgcgccgaggtggagggcgtggtggcggccgtggaggccgcgccgggggacaccgtagccgccgaccaggtcctcctccgcttcgactgagaatgcttttttgtggggggggggatgttccctgtcgatgggctggcagatgtaatcaggcaacatcttcctacctccagaaagtccttgcagnnnnnnnnnntaccgtggccgccgaccaggtcctcctccggttcgactgagagtgttttctttttgggggggaaatgttccctgttgatgggctggcagatgtaatcaggcatcatcttcctacctccagaaagtccttgcaggcgcgtgctgtggtgcctgttgccatgcgaattgtgtgaagagtgaatggatcctgggggggagtgcacgtggttcagcagcgcannnnnnnnnnatgttgccatgcgaattgtgtgaaaaggaagtggatccggggggggagtgcacgtggttcagcagcgcagcagacgagcaggcaaaagtgccccactttgaaatgcagaccaaaaatacccaccacccccgccgagctcgggaggatccggatccagcattgctcatttagagcacctccagataggcccacccgatttcagcatgggtgggaaggacagcgtggaagtcacggtcaaggtcgctttcggacatgccgtccgggagggggccacggtgcagagcgcgaaagtcagccttgcctccgatggcagcgactccgtgcacgatctcaagtccaagaccgctgctgcgctggggggcagcgtgaccgcggaggatctgctgctctccttcgggcccaacgagcgtaagctgggcaggcagtacgtcggggaccccaccgtggacgagaaggccctgctcctcagcgcctacaccatcctcgcctggctacagcggttcccgcactggtacctcaccgcacggctcttgccacccccgcccccacccccaggtaggggagttgtgggacgcagggccagtcagatagaggatccggtgccacccctgctcgtgccaatgcacctcctccacgccacaccaaccctcgatgtggtacaggtgtggccatccagaaggcagctgcgacggcggagcagaaagatcccgacgccgctgtggccgatgctcgggccaaaggggacatcccaaagatcagcgacctgccgctgccctggggtcccaagccctttgtccccccccctgctgcagagctcattgctgcaggttacctccctccccggtacccagagtccagttccccgcttgtcgattgctgagttgcaacagttgtcgtggaaccttgcatcacattcattctgtatgggtaatgggccattggtgataggtatgagccaatgcagtaaggtatgtcagccgcgagacgagggttggcaggcgcccgctggcgtttaggggttgctaagggatgaggtgcagagcctggtgtgccaggtcgcccaaaatcaagcttcgtcaggcctccactccgggacagctcttgggcagggtcccatcctgcaggaagccttgcgtcagctgccgcgcccgtttggtcagcggcatgacatgcagcccccccacgccaggaaggtcgagcgtctgtggatggtgtggagggatgaggaggggtcggctgtctgcctgtggtgtggcaaggaaaccctcctccccaggtcccgtccagcctgccgagcctcacccgccgaatgaggtcggcgttccatgctctgactccctccgcatcctgactggccgggaagtcagccaggagctgtgcggcctcctcatcccccgcccctgccccgatgaggaacagccagaactccaggttggatagggaagtgatcagagggactcccagcacaatctgggtgaacgggcagggttgaaaatggaggagatccaggggaaagcagggctggacaataagcatgggacttgtgaagaacatgccaaggcgcccaagacaagatggtctggcaacggcccgcggtgtcaaaggccggccgcctgcggtacgttcaaatctgcccgccgcaggcaaggtttcgaccctccagacccattcacaaaatcccagtaccaaagctcatcaccccacccgagctcggtgcgtgaggccattctccgccgctctttccatccactcccggctccgccgccagnnnnnnnnnncgccccgatgaggaacagccaaaactccaggttggatcgggaagtgatcagagggactcccagcacgatctgggtgaacgggcagggttggacatggaggagatccagggggaagcagggctggacaattagcatgaaactcgtgaagaagatgtcaaggcgcccaagacaagatggtctgggaacggcccgcggtgtcaaaggccggccgcctgcagtacgttcaaatctgcccgccgcaggcaagctttcgaccctccagacccattcacagaatcccagtaccaaagctcgtcaccccacccgagctcggtgcgtgaggcctttctctgccgcgctttccatccactcccggctccgccgccagagcagcgggggctgggtcagcacggtgcttgcccccgcctccaccttggcggccaggcggtgcagcgtctcggacccagggttggccaccgcccagagacgggtgtcggcgggcagctcacctctggaccgggctgtgcctgcatctctcaacatgctcaggctgttgccaagaaagtgtggcacgatcggcagggtccgcacggggtggnnnnnnnnnngcctctggaccgggctgtgcccgcatctctaaacatgctcaggctgttgccaagaaagtgcggcacgatcggcagggtccgcacggggtggccgcccgagaggaggagcagggcctgcgctggggggtggccctcgctgccagcgacagctgccgccatgcgccgccgtaggtcctcccggctgcgcagctgagctgccacgctgcgaaccgtgatgcacccgggcggctgctgcggcgtgaggccggccggtgcacgacaagttgctggcggggctgtggtgggggactcggcgacatgaccgcccggcagccgcaaggcctgcgctgccagctggcgcagcgttgtcgcgggggggaggtcgggcaccacccccgcgccaaacgcgccgctgcgccagagctcctcgtcgctgcctgcttcgcgccctaccttcctctccagcgtcagcagcaggggtctgggtgaggggaccgcgtccccatcctgagggaatgatgtgctggccagtcgacgaatgaacnnnnnnnnnncaaggggaccgcgttcccatcctgaggtaatgatgtgctggccagtcgacgaatgaacctcgcactccgcgtatagagacggggccccacccgggaggcatgcatgcgagaaagggagtaaggggttggggacctgtgacgggaggtcacaccgcgccaattcatgacttcatgggaagaggagtgggaaagtcatctcgcttccttcgacaacccttgagtgccctccaattctcctccctcatccaacatgctgaccgaactaggccatacagggaatgccggtgcgctcatgacgggagcgcgcgcggactcaaacagctgtctagatctcctcttagcatgagcgtgtgccactcctgccgcggaggggcataacagctacagaaccgaaaatttcagctgtatttcagtgaaaaagcgtcgagctgtggcccgagcgaggctcggcccgcatgctgggcaccctccggcacgagcacctccaggataacgactcgaagagcaggagcagcccgtctgcactcatgctgcctcgcaccctcacaaggtcccaaattctgtactgaatcttcctctggcgtgatacaggcctggctgcgatgcgggcctcgctgccccgcctgcccctgttccgctttggcgcaagccagacgcaggggcaggagggtggctttggctcttccgatcacctcgacgtccaccgggacgttgtgctccgcctggagtgcatgacctccaacgaagtaatgtggcaggtcgtgatcaacatgagcttctccgtaataatcctgtggagcgccatcgggctggtcattgtgcagttcaaaggggtgagtggctcttgggcaaggtggctttctgagacgctcacagcagctcagcgtcccagcgcatggctcagtgcctgtgctgtggcgcagggtgttgcccattatgctgcggatctccctcaatgcctgcctaaaatcactatccttcaaatggaatcagcaccagcgaccaggcaacacactcttccattgctggcccccaactcccctgcacaggtcgacgccttgagcggctggaaccacaagcactacttcatttccactgtcaccatcggtgcgcttttcctggtcgcccttgccacgatgggcatcatctacctgcgccgcctgtggcatgctcggcgggcaggcctggcgtggtcgccccgcaggaagcggctcgccaccacagcgctcacgcttatcctattagaggtgtgtgttttgtgttgggggttctggggatggcaattcttcgtgctgcgtctggctttgcaccaggtggcgttgggttgcaccagattgctgtggatccaatccatccagccacgactggcaccggtcatctcccctcaacccccttttccctttcctttaccacacacccttagttcgtcaacctgtcgctgtgggtggggagttctnnnnnnnnnngtggcgttgggttgcaccaggttgctgtgcatccaatccatccagccacgaccggcgccggtcatctcccctcaaccccccttttcccttcctgtaccgcacatcctcagtttgtcaacctgtcgctgtgggtggggagttctgcataccaggcggccaacgtgtgcaactggctggcggtctgctccaacgtcattgggtacctgcagtggacgatcctcaactgcatcctcctggtcatcatctgcagcgcccacgacatgtgcatgtaccgaaaccccagggtcaaaggctacgtgcccacacctgcggtgctcgtcatggacgttggatggtgcggggcccaagtgtggtgtgtgggcctgaacccaacggcatgcggtgtgcatcggacctgctctccaagcaacagcgcatttcagtcaaacctggcccacctttnnnnnnnnnntgtcatggacgttggatggtgcggggcccgagtgcggtgtggggggctgaagccaatggcatgcagtgtgcatcggacctgctctccaagcaacggcgcatttcagtcaaacctggcccacctttgccacacattcgcgcagcgagccctctgatctgccctcctccgccccccacccaccccctacccctcacactccccacaccccatcctaccacaggtcggtgcacttccccaagctgattctctggtgcctgaatcaggcagtcatgtccgtcacctttggcctgctgctgcatcgcatcattgcatacaagcacaaccgcgcggcactctgcaacttccaggatgggagctgccatctgagcagggccgggatggtgacctttgccatcacggtgtgtgtcttatggtggggatggttgctgattatttctacggggaggggagggggtgatgggttggcgcatggagggacgggtggggatgggcaatggcaggtgcctcattgggtcgggctcagagggtgaatcaggtcggggggagtatggtcactgtcctccctcctgcgtggggtcggggtgtgacgctgaggggtgacaaggtgacgtgctgctagtgggagggagtcaggccatggcnnnnnnnnnnatgcctcatcgggtcgggctcagagggtgagtcaggtccaggggagtatggtcactgtcttccctcctgcgtggggtcggggtgtgacgtcgagaggtgacaaggtgacgcgctgctagtgggagggagtcaggccatggcccctcggccatcccacacccacccactcacacccagcctggtctacagaagcccgtcgtctttctcaactttgtgtacgccctccacctgtacccgccacaggtgtccttcatcatcgtgtacctcatcatatacctagtgagcctgtggcgtaccagcaaggacctcagcacccgggcttactcagagatgcgcatcgcacgcacgctgtggtatcttcaggcgagcggctgggcctttgggggaggagaggtcaaggctgcgctgccctttctgggatcctgaccgtcgacctggtcatgctccgagcatggccatcccaccctttgctgtagctctcctccctcaccaccccacccacgccccacacatgcacacatgcagtcgagatacaccatcatgatcttcttcaccctggcagtcaccctctttgtgctcatgatcccaaagctgggatcctgctggaactacatcctgatctggtgggtcggctgggggttgcgaggtggaggcgccgtgacgtgccaaatccccgtcagccctgcccgcgggctgtgccaaaggcacaagaggctgcgggctcccacctgccgtgcatctctggtaccacctccccttgacaacccaccctctgcgccacacaccgcactgcctcaggctgggggctgtgcccatgnnnnnnnnnntggctggggggtcgcgaggtggaggcgccgtgacgtgccagatccctatcagccctgcccgcgggctgtgccaagggcacaagaggctgcgggctcccgcctgccgtgcatctctggaaccacctcccccatgacaacccaccccctgcgcggcacaccacactgcctcaggctgggggctgtgcccatgcacgcctcgctgacgcagaccgccgtgggcatcggcttcgccttcctgccagagaacgccaagcgcgaaggccacattccccagatctggctccaggagtttgcctggagcgaggagacgaagccggcgtgcctggccaggcgggacgcccacatgcgcgaccatgccgacctgggcaagcagcccatgttctgcatggagacctgcctcaagctgctgtactggtcaaacctgatctacgacctggagtcggtgggtcatcctttggggggggggcctgcattgcatgaggacaggggtgtgctgatcccagacagtgtgatctggaaatgcatggtacgggaggtcgctcagactgtgtgttgggcggtatggcttgcaaagcaatagaggtttggactcaggatgggaggtcacactgcgctgcgtgcatgcacctgcgctccttcccagtcgtgcttcactgggggtcgggacagtgccannnnnnnnnnacgtgcatgaagctgcgctccttcccagccgtgcttcactgggggtcgggacagtgccaaccattctttctaccaatccctcttttccgcctcctgctctaggtggtgggcgggctggcgaccctggagacagccacgtccctctactcccagcactcgcacgagctgctctgggacctggagacagacaccaaggcggtggttgcctggggcacatcgcatgttgttgtcgcctttgctggcacctccagcatggccaatgtgctgacaaacctcaaggtgaaagctgggaggcggcgtggtatgtgccagtggggaggaggagccgttttggggggtaagatacacatgtctctctgcagtcttgagaagcagccatcaggaacccaaggtctgccagtatggataccaccgcagttggccaccacgctgcatcctccaaagagaaagaaggaaggaactcgatttggtggatacatgagggtacaccagggtgagttgtaaagcaaagagaagacggatacaatacaatcttactttgaataagagacctctcagcctctccttcctctctgggaggcagcacccacatcatcgcgtgcctcatgaatggcccaccattcacgacccaaacccatatcacccgacaccannnnnnnnnncaaagcaaagagaagacggatacaatacattcttactttgagtaagaggcctctcagcctctccttcctctctgggaggcagtacccacatcatcgcgtgcctcttgaatggcccgtcatccacgacccaaacccatatcacccgacaccaggcttctacctggcgtacaccaagaacgactacaacctgaaactcatgacaaagctcctggacatcaaggccagctcgtccaaccctgataccctgaccttcctattcaccggtgaggatgaactcatgtggagaaatggggggcccccccatatcaagcagtaagcaagcggatagaggagggtgcacctgtctgtctgtatgactgcagggatccaccctccttccaatatcccacaggccactccctgggcggggccctagccaccctggcggcannnnnnnnnnaagcaagcgtatagaggagcgtgcacctggctgtctgtatgactgcaaggatccaacctccttccaacatcccacaggccactctctgggcggggccctagccaccctggcggcacacgagtttgtgcagcgcagtcccaagaaccctctcatcacgtacacggtgtgagggattggtggcttcatgggtggggagaggtgcaggggctggaaacgtcaccggactgctgtctgtgctgacctatgtctgtactgtggaccgttcttcctcctgcctgctaccccaaagactggtgtttgttgattacnnnnnnnnnnnnnnnnnnnnnnnnnnnnnnnnnnnnnnnnnnnnnnnnnnnnnnnnnnnnnnnnnnnnnnnnnnnnnnnnggagcacatcccctccgttcctgtatgagccatcctttcttccaccatgcagtatggagccccaagggtcggcactcggagctgggccaacgagtacaataccctcatcagggaccactttgccatcatctgcgaccaggtgggatcgttggagcgaggggtttccctttgtgtgtgtagggcgggctgagggaatgggttcatgcattgggtcgctacctcacctgctcggctaccctgcctccagaagcgcnnnnnnnnnngtgcatggggtccctacctaccctgctcggctaccctgcctccagaagcgcactgcagcccctcccacaggccccagtgtgtccaacaccaagccattctccctttctatcttaggaccctgtgccccgcgtgcccaagggcttcagctacnnnnnnnnnncccccagagtgtccaacaccaagccatcccccctttctatcttaggaccccgtgccccgcgtgcccaagggcttcagctacaagcgcgtgggggagcgggtggtctgcgacctgcgtggcaacctgatgatccggccctcgcccctggagagctccatgtggaactacaagggtgcggtagagggaggggaatggcactggggagggggcgtgcctgccagtgcctgggcccttggacgcctcggagccgcgccgcccgtggtgctgctctggcccactgcgcccccctcacctccgcgacctccacgccctgccttccccaggtggnnnnnnnnnnaccgcccgtggtgctgctctggcccactgaacccccctcacctccacgacctccacgccctgccttccccaggtggctacatcgtggaccacctgctgacgcagcaccgcctggcattcgccagcatcatcaaggcgcagtttgggcatgcggcgctgaagggcgggatgcagggcgtggaggccctcgccaaaaccctggacctggacgcggtcctgctggccaagaactgcgacctggagagcctgcgggatccggggtcaaagcctgttcccctggaggtggctgcacgcatggcccaggtgacggcgggaggggcccctagaggtgggacgcgggtgcgccattcccctcgcagcacagcgtgcacgaggttaccgactgccaaaggccgtgccccgctcaagtaatgactggtgctggttgccaccaagtttcagagctggcgcagcccccacctgccccttgaatcaaccagctattcatccacatgctcctcagccccaccccttcccaacatccttctcacccacagccgccgctgtacaacaccctcctgggctgcataatgtgctcggccacagcaggccaggccaccgcggagggcgaggaggtcgtcgctgtgaaagccggcccgctgctcccgctcgcgaatgaggcgggcacggccgtggtcctgccgggcgccacggaatcggtccttcccgtgggcagcctggacttggcaacagagggtgaggcgctcgaggcgtcaccccatgctgcaagaaacgaaacgctcgtgggcccgattcccacatccgcacccgggcgnnnnnnnnnntgtggtcctgccgggcaccacgggattggtcgttcccgtgggcagcctggacttggcaacagagggtaaggcgcttgaggcgtcaccccatgctgcaaggaacgaaacgctcgggggcccgattcccacatccgcacccgggcggcaggagggcgtacacggcgtgacatgcaaggcaggccaaacgtgaagcgtcttgacgaatcgtgcagggactaagtgcccgacgaccagcccctctgcccacgcaagcttcggcaggctgctggtgtctcagcccgcgaccatgttgacatcaaccataacacgtgcccgctgtatctccccctgtacttgcttgcaccccccttcagccttgggaatgatcgctccggtggttccaccactcccatgctcctgatcattctcgctgggggccaacccccctctcctgtagatgattatttttacgagcgcttggtcagaatctttgcagcaattcagggacggcagtttggattgatctgannnnnnnnnnctttttatgagcgcttggtcagaatccttgcagcgattcagggacggcagtttggattgatctgagattgcataggcagcacttgcgggcagtctcgatctgcagttttctttgtgtaagagcatcaatggggcctgggtggtgccccacgcatgtcgtaggcacccctgatgccgggcagtgtcacttgggaagattgctgcctgctgcttgggagctcattcagacctaagattccaacctaggcagtaagctgccctgggaagcactcagcaaacgtctgcaaggccgtggagtggagaaaggtcgcttggaacaagcatgggttggtcagatatgcacagaacatacaagtcgattgccctggcttacgttcttcgggtgcttgttgtctgagtgctccttcagctttgcctcagtggaggtacagatgaatgtggaccggcaaatgttgcactgcgaggtgagaggggttgcgatgctgttctgaccgtgactcgggggcgcccagtacacccacccgccaacccccgacattgctacgagcgactgcgcgtgcaacctcgactcaccacaatgttggacgccgcagagttgaccttcaactggctgacgccgcccttcctcttcttgtccatttcctgcttcttggcacgtgccatggctgtcttctgagcatttccgccgcccattttcgtttgtggctcacgagctttatggtgtatgagtaaatgtacctgtttataaatttggatgttgtcagatttggaagtggaatagtgtatgggactccccgaattcttgtgaaggattacagtctagtggggcgccagcgccgatgatggagcacagcggttggaaaggacgtcnnnnnnnnnngacctgtttataggtttggatgttgtcagatttggaagtggaacagtgtatgggactccctgaattcttgtggaagattacagtctagtggggcgccagcgccggtgatggagcacagcggttggaaaggacgtcggagacttgtaacatgggtcagtcgaaaagcatgggcatgggagcctgtgggcatgctgccgcagggacgcagccttgcatggatcgctacaccccacttacacgtcatgctggccttgcacggtcgcgtgacactccgcactccaccccatgccccgtcggggtggaccggccgatctagctcggcatgggttttggcccagccatcgaccccgcccagcaggggtcggtgtgcccacagaacacgagcaacgagtgtcacagccacggatgcggcgtccgaaacgagcactccccctccactgcgttatggcgtgtccctgacgcagggtccaagggaggaaatggaggatgtggcgcaagtgatccccgacgcctgctgtggattccttgtggcatgtgagtctgccagggatagatgaaggatgagtgcacctgtgtgtagctttgaaactgctttgccatggttgcctccatgcaaacctgcgccatgcacttgggaagcgaaagctacccggtgtgactgctgggggcgcaaggtagattccttgcacccactgctgaccccctgtgcggcaaattcccttcaccagctgtatttgacggtcatggcggccgactggcggccgactacctcgagaagaatctctacaatgttttcaacgacatcctcaaggaagacaccatcagcctgacctgcagtgtcaaaggtgtgagggtacaggtgatcgtcagggcatgaaatgtgccctctgtgatcatgagtgtacccagtaggactaggccggtgggcggcaactgcttaatctgggcttctaccccgtccctcccgacagagcgggattcgagtgggctgtgctgtcccctggagctcacccccctcctccgcagcagcttcaaaaagacagacgaacagcttttgcagtacctccatggtgacaggcggggaatgcctggtgatttgggttccctttactgtcagaggcgccagaaggatcgctgggggggttcgatgcctctcgcatcgcctctttgaatccgcctggcctgcacattcacaccctacggtcctctggaaagggatcaggacctcagaacagattccctcctctcctcttcagacctaggggacgaggacgcactgacctgcggctgcaccgccaccacagtgctggttcaccccgaccgcctcatcgtggcgaannnnnnnnnnggaggggaggccctggtcctctccactgagcaccgcatccccgaggacggctccgagaacgaggagaccgcccggatacgagcggtaggtgggtgggtgaaagggggaggaagggcgaatgatgccacgcgcggggcgtctgaaagagacgagggaggcggcggtgtggtatgttgcatnnnnnnnnnnttgatgccatgtgcggggcgtctgagagagtcgagggaggcggcggtgtggtatgttgcatgccggcgctgtgcttcacacaagccaggcgacgggtggcccttccccaaacatttttacactcccacggggccacctgcatcccccctgcaggccgggggctgggtggaagatgagcgtgtatgtggcatgctggccgtcacccgcgccttcggggacccggaattcaagggcgagggcctgcagaagctgctgcgccgcggtgtggaggagggcttctggacccaggaggaagccgatcagaggtgttgggggactggtgtcggcagggtatctgaagccagggtcccggcagctgtggtttttcaacatcatcagtgcccaaccgcccaggcatccccctccagcctgcacctcgatgtnnnnnnnnnncctgaagccagggtcctggcaggctgtgggttttcatcatcatcaattccccaccgcccgggcatccccctccagcctgcacctcgatgtcagaccagctcccctcccgtcccacccacacgacgaacccccacaggcacttcagcgcagaccccgtgacggcgctgccggacgtgacggcgctggtgcgcactcctgacgacgaattcctggtggtggccagcgacgggctgtgggatgtgctgagcagcgcggaggtgctcaaggcagcgcggcagggcctgcggaagggcctgtccttgcaggtgctggttgggagcggggggacacggctctagtgttacaagggggggccaggcgcaagggagtgagtgatgcccttgcatgatcaagggaccacaaaggaatatcagttgttgatgaaatggctagcgacgaggggtgccaccacgaagcagagcacatgggagcctgatgcccccccacgcccaaaacttcaccctgcaggcagtggccgacacgttggcggaccgcgcgctgcgccgccacacctacgacaatgtggccgtggtggtggtggacatgggcggtgggcggcagggctggaagccgcaggccaagggcctactgcgcggcctgttttccagcagctgaggcctttgattgaagcaatggcgacagaaaggggggggggccgcgggcgggcagagctcgcgtccggactgggcatagctgcttgcagtgctcgagggcttgagcttgctgaaggcaccgcgccggctgcccttttggaagaagaccagggcagagagggactgattggagggtcccacggtgtggggtatccagcatgtgacgggaggnnnnnnnnnntgcttgctgaaggcaccgcgtcggctgctcttttggaagaagaccagggcacagagggactgattggagggtcccaaggtgtggggtatccagcatgtgacgggaggaggaccccagtatgctcagacgcggttcaaaaagaggtcgcgtgaccggcggcatccacgccgccccaggtccctccagatcactgcgcgtgccagtgcttgatgcccnnnnnnnnnnctcaaaaggaggtcgcatgaccggcagcatccacgccgccccaggtccctccggatcactgcgcgtgccagtgcttgatgccctcgtaggaggacaggacgatggcgcaggcaggcgcagccttggcggcgcgcgcgctccagccgcggaacagccctgccgcgccttcctcccgcgcgatgctgaccagcgtgcccagcaggcgccggcgcggcatgggtgaggcggccgagtcgccgcccggccgcacctccacgcccagctgcacgcgcgtcttgaccacgtccaggggcgtggtagccgcccccgccagcgcccccg

SEQ ID NO: 35365 - DNA, 972 bp, Chlorella protothecoides
  modified_base (132)..(340): a, c, t, g, unknown or other
cgccgtggcggccctcctggccacgctggactccccggctagggggtctccgggcgcggcgccggccaccgacggcgcgtcgtcgacacccgccggccacgccgaccccgcggcgccccaggtgacgtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgctgggccatgattgggccgcgcagcacgcgggcgcggggcgcgggcgcaagggcgcgccgccgccgccgccgcagctgcagcagctgctggccgacggccgactcaaggagtgggtggcgggcgcgccgggggctgccgcgccgtttcgcgaggagctcgtcgctgcgctgctctacgtcctgctcacccatgaccgcgtggcgggcgggtttgcggacgcgcgcgccgacaagggcgcgggaggcgccgtgggcgaggccgccgccctgcaggccctgctctcaggtatgaggaattgttttggctggggagtttcggggtcttgggaaggggtcctgtaagggcgatgcaggtcggcacgcccggcaatgatgaaatcaggggatgatgttgccacacggtcacagtccgcccatcccctcctcctcttgcagcggtggagtggctgggggcggcggtgaccgcgctgaagggcaccaagccgtgcctgggctggggcaggatggcgtcggccgcctcgcccggcgccagcgcggtggtggacctctggctccagctcctgctggccgcgctgcgcgtggccgccggcgtggagcgcgcgctggcggtgcgcgagccgccgccgcc

SEQ ID NO: 35366 - DNA, 109 bp, Chlorella protothecoides
agggcggagggaagtggaccccccgagggatgaccggcggcggcgcgacgaatatgatgacagaagagcggtggacgccagggatgaccggcggggacgggattacatc

SEQ ID NO: 35367 - DNA, 109 bp, Chlorella protothecoides
gaacaagaaacatggaatattggggtttcgttgctactattctacttttgtgggtaaaacttggcccagaaacggcctatatgctcatctggaacgggtaaagcatgca

SEQ ID NO: 35368 - DNA, 68 bp, Chlorella protothecoides
tcccaagcaggcgggagatgcatcccagcgcccagcgcctgaggcaatcatcctccccgccctcaaca

SEQ ID NO: 35369 - DNA, 66 bp, Chlorella protothecoides
ccagccagtatgtggtctgcagacggcgcatgagggccaggtacgccgggaagactgcgaggacta

SEQ ID NO: 35370 - DNA, 420 bp, Chlorella protothecoides
  modified_base (88)..(343): a, c, t, g, unknown or other
ctgccttgcagctcacgcgatctccttgttagtgatcgaggaatctctttggtgcaaatttgggtggtgttgctggaaggccaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaggctcgtctgcccttcgcgctggctggcgctgttcttctccaaccactcaggtttgcccggaccacgggcgca

SEQ ID NO: 35371 - DNA, 7822 bp, Chlorella protothecoides
  modified_base (247)..(331): a, c, t, g, unknown or other
  modified_base (773)..(782): a, c, t, g, unknown or other
  modified_base (4866)..(4875): a, c, t, g, unknown or other
  modified_base (5435)..(5444): a, c, t, g, unknown or other
  modified_base (5500)..(5524): a, c, t, g, unknown or other
  modified_base (5939)..(6086): a, c, t, g, unknown or other
gccgcccgcggcgcagcaggatcggtcggtggcgggcgcggccgaccccgccgcctgggcggccgcggcgcaggcggccagccccacggcggtgccgttgccggtggccagctggcacgccagcgtgcgggtctgcaggcaggagtcggcgtcgcaggcgctccagggccccagtgcccaggcgtaggcggagccgccaatggactgcagggtcacagctgccggcgggggcgggggctggctgggnnnnnnnnnnnnnnnnnnnnnnnnnnnnnnnnnnnnnnnnnnnnnnnnnnnnnnnnnnnnnnnnnnnnnnnnnnnnnnnnnnnnnggacgtggagccggcggggggcgggaagccggcgggcggcggcgccacgcctgtcgccaggctctgcagcagcaggttgggcgtctgggaggcggagaaggtccaggtggagccggagctggacagcacccccttcgtggcgccgtcccgcagcagcgaggccaccgcggcgggggccaggctgggctggtcctgcagcaccagcgccgccgcccccgccacaaagggcaccgcctggctcgtgcccgaccggtacctatgcaggcagtgagtatcggggaggggggtggctaggtgtacatgaggtagaggtgctgaggagccagttcagtctcaacatgggcaggcatgggttgacccagggtgcgggacacaagttggcgacgggcggtgcctagcgtgggcctgcaaagtacccatgctttccaggctgagcgtgcannnnnnnnnnaaaaatgggcaggcatgggttgacccagggtgctggacacaagttggcgacgggcggtgcccagtgtgggcctgcagagtacccatgctttccaggctgagcgtgcaccgcctcgatggtcacctttcctttgtcgctccgctctgatccccggaccccccttggttgttcgcacccgacacactcccctgaacccagccagtacattccccaatccccatcctcaatcctccccccccacccatgcacaactcacgccgacgcggtgtccgaggtgatgcccgcgctctggatgtttgaccccggcgcaaacaggtcgacgcaggcgccatagttgctcgccacgccgtcgccggcgtacaggcggcggtcgcgctcgtcggaggcgccgacgatgagcgcggcggtggcgcgcccggggctgacgctgcaggcgtcgacgtcgccattgccggccgcggcgacgacgtgcagccccgcggccacggcggcggccaccgcttggtccagcgccacgctttccaccccggacagcgacaacgtgaccaccgcggggcgcaccgcgttgtcggccagccagtccagcgcggccaccgcatcggacaccagcccctgcccctggcagtccagcatgcgcaccgccctcagcgcgacacccttcgccacgccgtaggagagcccgcccaccacgcccgccacgtgcgtgccgtggccctgacagtccgagcccggggtaccggaggagagcgtggtgtacgcctccgccgcgcggctggtggagttgccgctcgaggaccggaactcctcgtggctggccaggatgccggtgtccacgacgtacacggtgaccgtggccgcgtcgtccgcgtagtggtagagcccgtccaggggcagcgcggactggtccacacggtccaggccccaccgccccgcccgcgactcggcgccggccgccagctggtcggcgtcgccgcccaccgactggacatgcgcgtcagccacggagacggtcgagtcggcgtgcagggccgccagcgcggcgccgtgcacggccaggaaggaggccaggccggcgcggggcaggcgcgccgccgcgccggagagcacgcgcgagaagcgcaggccgcagtcgctggcggcgcaggctgccgcggctgcctcggagctggcgttgcgccactgcaagatccagcggtctgtacccgaggggttgggaggtggggggggctggcccgactgcagggagctggcctggacctccacgaccgaagggctggagctggagccagagggcctgggggagttggggtgagggcggtggtgaggggtgcaggtgctgcggatggtcctggcttcatccagcaggacattgcacttggcatgcaatccaatctcgaagaggcaaagggagccctgtgaaatacggggcacagttgagcctccctcttccagggctccttcacccccctccactactataccacacaacaactccccgctcaatcttgcctgcagaagccgaggacaggaggaaggcccgacaggccttgaagctcaggaatgtcctggcagctgactaggccggtagctggggcccttggcaggcaagccgcggccatgcacagaaggagtgcgaccttgacatgggcgcaagggctgatggcacccctgcaccgtctgcgcctgccaaacatgtcgtcgatccttttgtttatgtcactacgacattgaatctgaggtgccagtctcgtgggaccgcatcgacgaggtgggaataacctcgatctagcctacaagaccctcgcgcagcagcttcccatggtctggatatacatgccgcccgaaggcctcaaatttacccccaactggtgagtccgaagggcagtaatgcggcatcgcggtgtgaaatgccaattctcatcggctctccccaggcgggggccaatggcccactttcgagcacgtgggcggactcacccccggcagctgtgcaacccaacttacttcatcttcaggcggcggtaattttctcaaacctcaagtcagggagtcacaaaggggatgtatctgggtcttcatctgggtctggagcgcttctggcctacctcttgcttcacctcagccctcctggcagctccatctgatcgctctgtcttgacagactgcagctcctccagcctgttattgagaacaggggtaagaatcactgagatgccagggacatcattactagctccgggcgccatccacatatttgtgtcccttcagcccacctggatgcgaggtcagcatcggacactgttgccccagcgtcgtccactgcctcttccctaacccctgtagcagccttcgctgaggatcggcgcgcctcagcctcgaccgccgtgttctgccctccgaagctgacccggttgtggccacgctgtgacagcggtgggtctcccccaaagaccacgacacagcgctgggcagcattcgctttcacccaatgggcctatgggggcggtgggtaattcaagttggcccgacttgtggagcagcacgggagcagttggtcttgaagaacatgtcgaacaccccacccagcaagctcacgtcctcagatggctgcgaggattctgtcgcagcgctttggactgcttctttgtgtgcagcccgctgcatgaatttgagacccatcaacttgctggacagagcaggctttggggcctttgcagcatccttggaggttgccatcgcacccgatgtaactgtcgcaagtcgcaaggaaacagtaccgtagaccgcttgcaccaatgtcacaagctagaaacacgaatgcctcgcccaaaggggggaaggctggatggtgcagcaatgctcggcaagttttgcgcgcgcggtgcggagatccgtatgctacatcaagcccgatgtcggtgtcagaaacgccgtgcttttgcgtgtagacgacagatttccgtttcttcccaggtggtgctcgagctcttgagtaatatcgagtaacttggggcccgctgctggctcggcgaagtgttcagggagcgcaggtcctccaagatagacaccaccagccccggcgcgatgacgagtcggagcagaagagagcggaagccctcttcccgattagagcttggtgggtgcctctcgtgcggtgggggcgttcatcagcagtacctcgacgtccgagcggtttcccaccgagcaccctccccaatcctggtgcagccatagagggcagctcccgagaggccccaccaaaggtaatgtacgtctaccgtctgatgaagccgtcagagatcaagtctaccctggtcagccgcacggtgcgtcccctgtgggcttgcgggctggcaggggatgcccggcatccttgcctcgagcgcaaactgcagtgttgtgacccagcgccgcgccaggcagtaggcagatacccacccggtcacctttatctacacaagcaggtgtacgtcctgtggccggacgaggagcaggccaatgcgacgtggtacagggctcgcgtggacgagtgcaaggtggcgtccaagaaaggcgacctgtactatgaggacaccgacgagctggaaaccggggctgaccttgctgacctggtgtatcagggtcacatagcctttcgtgagtctgccggcgtgtggcacaggccctcaaaccgtgctgtatgtttttcacatgggtgtgcttccaaggtcacgagtatgaggcggggcagagcccctgttcaccgagccggcggcggcacaaacgaaagtataagggattcacatggggaaatcaccctgcagaaaatacagcctgcctgccttaaatgactgcaggtgagcctcgaccccttcatcacgatctggggagggacgaggtgggcctcgacgcgccttacacagggcgggcactggaggagaggctgggccacctgcccgtcacggcagccagtgcaagccccgagagcagcatctcagacgcaggggcgcgtgacaacagcgcagaagactcaggtgacgcgggggtctgggcatttgaagggtcaggtgtaatggggcctatattgtgttgcggcaacatgcannnnnnnnnnacatttgaagggtcaggtaggatgggggagggggcctatattgtgttgcggcaacatgcatgttgccggggcaagctgcaaagcccagtgtctgcacctttgacaccatgcatcccccctttcttcatcagatttcgaggtggaggcggccagggagcggcagagcggctcaaagcgccgtagggcctccactggggaggaagattctgatggggaacaggtgggcagcccctctccccctgaggtgtggctcgacaggggctgggacgagtgggcggtgggctggcgaagacggcctcagacacccagcccacgggctggcgatggcaggcccgcagtgcacacccccaccaggcattccccgggggtgctcagatgctgagccgctcgcccacgtgagctccttgctcacagtcctgtgctttgcaccaggtctgccaccctcccaaacatcacgcaggatgaagacgccgatggctctggctcggacgaggtcccactcgtggctcgggcggccaagatggagcggcggcgagcctcccggggcggggcaagggggnnnnnnnnnnaatcatgcaggatgacgacgccgacggctctggctcggacgaggtcccactcgtgnnnnnnnnnnnnnnnnnnnnnnnnngcggcacagaaactgctccggcaggcgcaggggggcgcgtcgggcacgccgcgcagcaagccccagagcccctctgacttctacgggtctggcacgccccgacggcaccaggcagaccacctgtcggatgcgggcgtccaggagaaggcaagtgctagggctgggtcaaagtctgtgctgacaggctctgagttgtgagaggagagggcgtcgtcgacatgcgatgcggaggagagtggtgggcaggaccttccctttgttgtttgaggattcttggtaaagtgtccatccctcccccagcattactcgctgtgtattgcttgttcctcttgccaggagacactggttgcatcttcagcaatgcttctgcaatgccatggagctagagggttatcctggtccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccggctgcacggcgggacatcgcgtgagtacaagacccggtaccgcacgctccagttcaacctgaaggaccccgccaacccagatctgcgtggcgaggtgatggcggggcgcctggccccggagaagctggtcacgctgtctgccaccgagctggccaacaaggtgcggaggtgggggaggaggttggaggtgccatgcatcgtctgctgggttgccggccggcatgcagtcgcgggcatcagctccaattcatgaacgaccgcggctcaggtgtgatcatggcatccccaggcgctccacacactcagccttcacacccccaacctggcccccccccaatatgtgcccacacccacaggagctgaccgagtaccgtcggaggaaggaggaggaggctctgaagatggcggtgctggacgccgaggcggcggccaggttctccacggccgccgcgctggagacgcgggagagccagccgcgaaaggaggcgcaggaggcggccgtgcgcgaggctcgcggcggcgaggcagcccgggccgtgggcgaggccgccgaggcaccggacgcaggctccagcccgcctgcggaggagcctggcgccggaggcgccgcaggcgatgctgtcgccggcgccgccagcatggatgccggcgtgctggaccacgaccgcaaccccgtgccggagctggagccgggggccgacgtggcccagtccccgcccgcccggcccgccccgagcttggactgggcgcagatcaaggccagcgcggtggagtcggcggcggcggaggacgcggccgaggacgcggccgaggagctggagggctttgacgggtggacagcggggcgagaggaggaggaggggccgggcgacgcggcggcgcgcggcgccggccaaaccgacggcgccttgccgccgcccccgccctcgcccctggcgcacctcttctcggccgccactgccggctcctccccggcccccggcgcctggcggtcaaacctggtgctgcccggcgagggctccgtgctggtgaccctggagggcctggcgggggccgtatcccctgccctcctcctgggggatcgtgacgtggaggtgcgtggccgcgtgaccctggcgcggctggaggagttcctgctggacctgcgccactcgcgccaccgcgccgtcagcgcgggcgtggcggggctggcaccgggggcctcgccccgcgaggccggcctctgggccgacctgctggccctgtaccgcgcgcgggggcgcaccggggtcgcggcgccgcagccgggggtggaggcctacgtgctggcggcgggggacctggccgcgcgcgtgctggaggtggcggctgggagcggcggggcgggggctgcaggagcgctgcgggacgaccaggccctggtcctgctcatccacaaaaaggtgcctgtccaggggaggtggtgggggtgggggtggaggtcgaattttgtcatggggggggttgtcgggggagttgggggttgaacgaggaggatgaagcaagattgagcagggcatcagggagacgttgctgtgtgaccgaggcaccgctttcctcaccacagccacgccacaccaaagtctcagccgtgcatgacccctcgcgccaccgcaggactggcggcccgagcccggggccagggtgccggtgatccgggggcgggccgcgccggaccctgggcgcgacgacgcaggcgtggcgccgccggcc

SEQ ID NO: 35372 - DNA, 73 bp, Chlorella protothecoides
ccgcctcgtccagcgccttgaactcctgccgaagtgtgtgtgtaaagggggggggggggggggggggggcggg

SEQ ID NO: 35373 - DNA, 61 bp, Chlorella protothecoides
gacaccatccccaggccgggcagcggaatagggtatgcatttccatcgggcccagttccgc

SEQ ID NO: 35374 - DNA, 61 bp, Chlorella protothecoides
ggcagacccaagagtcagacccccctggtgggccacggacacaccagaccaatcgtggatc

SEQ ID NO: 35375 - DNA, 61 bp, Chlorella protothecoides
ttgctggttcatgatgttggttgtggaggggttggttgtcgcctctttcccgactccatct

SEQ ID NO: 35376 - DNA, 79 bp, Chlorella protothecoides
ggagctcatacgatcctaagacggtaatgactctcacgctatcgtaattaatacaatatacgtccttcttccctggatg

SEQ ID NO: 35377 - DNA, 67 bp, Chlorella protothecoides
gcagtcccaaggtgctcaaccacgttggtgtttgcggcctctcgggagggtgctcggagggtccaaa

SEQ ID NO: 35378 - DNA, 5059 bp, Chlorella protothecoides
  modified_base (323)..(332): a, c, t, g, unknown or other
  modified_base (833)..(842): a, c, t, g, unknown or other
  modified_base (1566)..(1575): a, c, t, g, unknown or other
  modified_base (1880)..(1889): a, c, t, g, unknown or other
  modified_base (2284)..(2402): a, c, t, g, unknown or other
  modified_base (2916)..(2925): a, c, t, g, unknown or other
  modified_base (3036)..(3045): a, c, t, g, unknown or other
  modified_base (4063)..(4072): a, c, t, g, unknown or other
ggcgcggtggccgccgccgagcgcgggcgcgcgggcgcgccgcgccgccgcttcgtggacctggcctgcgttgagcccaccgcgccgctgagcaccgcgttgcgcctgctgctggagacgggcgtgtcctgcctgcccgtggtcgacgacgcgcgcactctgctggacgtctacgcccgcgccgacatctgcatgctcgccaaggtcggatgtgggttgcttttccgttctagggtggggtgggggttgatatccgatggagaggggggggcttgggttgtgaaaggtaggtgagggttgagacagactctgaaagccagtgnnnnnnnnnntttttccgttctagggtggggtggggattgatattcgatggagagggggggggctggattgtgaaaggtaggcgagggttgagacagactctgaaagccagtgcagctgcactgaccacgtcgtgcctgcggagcggacagggagcgccggccctgcggtgcggagtggtaaacatccgacgctctgtctgctgcacggcgtggaagacgcaggacccacatccagcataccaacccatgccccccctcctgtcgcgtgtgcagggcaatgcctacagccggctgcagcaggaggacgtgacggtagggcaggcgctgactctggcctcggcccccactgcgcccacccaggtgtcggcctggtcgcagcaggtgggtgtggggtgggaggatgtgtgtatgagtgtgtgggggagcagagggatgagtttgtacgttttgctgttctttggaggggtgggtgttgaaaatgctcggtatatgactgattgggggtggcannnnnnnnnntgtgacggtggggcaggcgctgaccctggcctcggctcccaccgcgcccacccaggtgtcggcctggtcgcagcaggtgggtttggggtgggaggatgtgtgtatgtgtgtgtgtgcatgtgtgggggcagagggatgagtttatacgtgttgctgttctttggaggggtgagtgttgaaagtgctcggtatatgactgattgggggtggcatctattgccgaaaaagtaccatgcttgaagcatgtgcagaaatggggcacttgatttgaaggttggttaccaaaactgccactgcatcggcatagcatcaagccaagtgagcaggacaatcaacgggacagacggccaccattctcctgccgtccaccttctcacacgcgcagtcgcagcacctgggcccaaagcagcgcgtctggatctgcacggcggacgactcgctccgcaccgtcgtggagaggctggctgtcccaggcgtgcgccgcctggtggtggtggatggagccacccaccgcgtggagggcatcgtgtccctctccgacgtcgccaccttcctcatggtctagcgagggagggcggggtgtgctgcggagatgcaagggccaggcacccacctccacatggtgcaacatgccagggggcccctacgcccagctagtgtggagccatgaacctgtaacgggtgttccgctttgttgaatctcacaggcagcgtggtcacggcnnnnnnnnnnttgccagggggccccaacgcccgcctagtgtggagccaagaacctgtaacgggtgttccgcttggttgaatctcacaggcagcgtggtcacggcgggggcggggccggggacacttgaacgccatggctccccccgatgtagtggggagcgaaccgagctcgccgagagccctggaagggcgcagtgatcactggcattcacaggaaaatcacccccgttcgagcctctccagaactagatgtcctcgctccacggcatggccggcattccaagacgctgttcgcgttgtccttaggcagcgtcnnnnnnnnnnaagcctctccagaactagatctcctggctccacggcatggcctgcattccaatacgctgttcgcgttgtccttaggcagcgtcgcccgggatgcaggacagcctgcgctcgcacctgcgctctctgggcacggtgctgggccaggccaccaagaccgcgaccaatgcggcaatggaggtgtctcgagccgtcgcgacggaggttgggggggcacggtgcctgcaggactatgccctccaagcccaggtcgccactggtggaccccagggcctgtggaggatctactccgcccaggccaagaaatcaggtggggctggatgtctgaagacatatcagagtcatgttttgccttccatacctcttctgcggtctgcaggggtgtgtacctcatgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgaagatgccccgtttcaggtggtcagtgcatggatcctcgacaagcgggctctcacggaatctgacgcgggcggcggggggcgccagggcggcctcacccgcccgtccacaaagagactggaggccttcctggagcaatgcaggcgggatgtgcaggtgacttaatcatcagaagctagttgtgtggtcgcagactgttattcgtccatcattgcattttctctttcggcactgctggtcttccgctgattgtctctttgcgcaagggtggtttgcggagttctcaccgcagcgcctgtctgggatgtccacctctgcgcccctgcttcccgttccgcacagcacctggctagactgaagcacccactggtgctgcggctcttgtcgcccctggaggaaacgcgcacccagatggtgtttgtgacggaggctgtggttacgtcgctggcagactatctggctgcctgcgagggtcccccaccgcccctgtcagtgagccacccaggcaatnnnnnnnnnngattcgtccaacattgcagattctcttgcggcactgctggtcttctgctggttgtctctttgcgcaagggtggtttgcgcagttctcaccgcagcgcctgtctgggatgtnnnnnnnnnntcgtcgctggcagactatctggctgcctgcaatggtcctcccccgcccctgtcagtgagccacccaggcaatcagtccagcccgtccgccgtgcgcatgagtgagctggagctgaagcatggcgtgctgcagatggctgacgccatccacttcctccactctggcgccagcatggcacatcgcggcatctgcccgcacgccgtcttcattgcccgagcgggtggggtggcagggccgttctttgagggggaaaggtggtggggccacggtgatcacgggcacccagggctcctctgctggcgtcagcagcagtctcctccttgattcttgcttctgttcagttccctgcccttgataaactacaggcggctggaagctggcatgtttcgcctttgccacgcccttggactttcgagacggcgaggcatctggtggattcgacttctcggaccgtcacccctcaatgctggccgcagccctcaaggtaagatggaggtgctggcttttgctagacgtcagtggggtatgttgggagggctgagggcttgagcatacagtgccaggttgtttggggccggccgttgcctctctgcctgccaggtcacccgtccatacggaccctcaatggcctccttgacaccccaatcccacagccatcgttggcatactgcgctccggagttggtggcgagtggcgcggcctctgcggggggcatgctgtcggcctgcgacgccttctccatggctgcgctcacctacgagctctttgcacacagacagctgctcccagtaggctcggacctcatcagtgagtcgtctgctgggcttgaagtagtggcctgcgcatcgcagctgtcatcagaaggcatcacatcagactttcccgactctctcctcgtccacctttgctgcatcgccatcctgtgactcacctcagtaagcctcctcttccctccctcacatcacagcctatgagtcccacatccggtcgctgactcagcgtgatctcgacggcgtgnnnnnnnnnnctcagagtttcccgtctctctcctggtccacctttgctgcatcgccatcctgtggctcaccccagcaagcctcctcttccctccaccacatcacagcctatgagtcctacatccgatcgctgactcagcgtgatctcgacggcgtgcccatggagttgtggggcccgctgcggggcatgctggcacccatcccatccgctagaactcccgtggaagccttcaccgccagcgcatacttccaggtgggcagcacctgtgcaaggtgttggggacaggcgcagagcgctcctgcaaggctcggggttgctgcttgccggggaggcttgcagagcgtcaatgactccgtggccgccctgcaccaacatcttaaaacccctcacgccccactggccgccgcagggcgacactcggctgcgtgccctgaggttcctgggcaccctgatgcagcgggaacctgcgcagaaggcggccttcttcaaggatctggagaccatgctgggcagcctggacggccgggtgctgcggaccctggtgaggggagggattggatttggctggacggcggaggggtgttggcgtttgctcccaaacggttcctcccaatggtctgcgttgtcgcatccattctagaaacaagggcgccacgggtccagctgccccgctcgagaggcaaggggtgcccacctgtttccaccttgcctcgatcagcatccaaccccggtgtccatccaaacctgactcccccccctttccaattccaccctcaaggtcctccctccagtgctgggggagctgcacaacgcggccctggccccgaccctggtccccctggtcatgcgcctgatggcgagccagagccccgaggaggcggcggaggtgacgctgcccgcgctgcggccgctggccaggggcgcgacgggtgcgaccctgggcgcgctggtggcggccgcacccgcgctgcaggcggcgctgcccagggccgcggcc

SEQ ID NO: 35379 - DNA, 74 bp, Chlorella protothecoides
gaagtctactccgtccctccccgacgccttccggacccccttttctacttgcgccggcggttggtggccacgtg

SEQ ID NO: 35380 - DNA, 61 bp, Chlorella protothecoides
gtccccccttggctcactcctcatggcaggggcgccaactggagaccgatgcgcagaaaga

SEQ ID NO: 35381 - DNA, 109 bp, Chlorella protothecoides
ggccacggaggatccgggtgagtggcgcactgggcgagcgcggcgggaggggtgtgtgatgggatgtctatgtggaacgatggaggtcagggtgggcacagaggtaccc

SEQ ID NO: 35382 - DNA, 108 bp, Chlorella protothecoides
gcggatccggccgcgcccccctccccgcgctcgggcctgggcctgcgccgccgcaacggcccgggccctgatgccgacgatgaccggggtctagactcccaggcccag

SEQ ID NO: 35383 - DNA, 6223 bp, Chlorella protothecoides
  modified_base (186)..(296): a, c, t, g, unknown or other
  modified_base (1877)..(1886): a, c, t, g, unknown or other
  modified_base (2537)..(2633): a, c, t, g, unknown or other
  modified_base (3369)..(3378): a, c, t, g, unknown or other
  modified_base (4075)..(4084): a, c, t, g, unknown or other
  modified_base (4809)..(4818): a, c, t, g, unknown or other
  modified_base (5241)..(5250): a, c, t, g, unknown or other
agcgagcagctggccgctgcggccgcggcggccgcgcacgtcggcgaggcacggcatgccgaggccgggcgccagctggcgcaggacgaggagcgcgccgctgccctccaggctctcaacgccgccaccgacgccgcactgcgcgagacggcggcgaccgtcggcgacggcttggcggcggggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacagggtgccgacagggcgcgagggtggttgccgccctcccactggaacagaggctcatcaccgaccccggacacccctcacactcccaccctcctgctccctctcccaggtgcggtgccgtgcaagaggacgcggtgggtcccctccgccggccaggtggcagacctgcgcactccggcccacccccagctgctggccgccctccacgcggcgcggggcggggtcgctgggaccgagtcccagggcgcggcctcggtgccggccacgcaggaggtcgtgccgctggaggcagagccctcctcgtcgccgcgggaatccgaggaggggagcgaggaggctgcgcagggggagggcatgcacggcgaggacgaccccggggaggagaaccgcgacgcaggtgtgtgtctgtgcgtttcggggggtcgccgccccgtggcacttgcgtctgcagaccgagggtcgtcgggcagaggcccccagcatgggtgtgccgcgcgtagcgcagtgcagcgtggcggcaggtgtgcagcatccctcacccacccaccccaccctccgccccaggcaacgcactgccggcgctgggcgtcgacctgccgaccacggggctcaagctccccaccgtcgtgtcgcccggggtgtccggggtcaagaggggccgcccgggcacctccagcggcgccgccaccccggtgaaggggcgtgcctccccgagggccagggtgacctcgcggcgtggcacgcgccgcgccgcctttgaggtctgaggcgcaccttgacctttcggctggaccaagtttccccggcggcaatggcgcctcccggccagacctcgactccccaggaatggccctcccggacactcaggcgatggctgcggcggcaaagggtccccattcccatccctgaacaatcttgcgagatacatccacaaacgctctggaccctccatgcggtgcctcacagtgccctgcacgacccactcttgctttgttgacacaccccacgtccctgactgcctcccacggtcgacagctcgcctgaaggggcatgtaccattgcttcacaaaatgccgcccaggagcagacgagggtaagctggacaggcgcagggaccgccaggcactacttcttcttcttctgcttgggcttgaccacgggcttggcggccaccgctacaccctcatcatcactgtcgtcatccagcgtggcggggcgggcgccgccctttccaccaatcaccgtctcgcctccggagatcttattgagcgcctccaggcccgcaaagcgcttccggaaccggctgacgcggccctcgtctgttaccatggtcgagttgacgccccggtagaaggggtggttgccagaccagatctccactgcacacgaggggcagggcttttttttttggcaaatgtgggatgtcgtgctgcctccctctcgtcactggctctcacattgcaatacttggtggaaggccaacgacattgatagatgaaagagcatcatgcacatcaccttcccactaccaaggcatgcgtcggcgatgtgccacatgtgccaagctaatctcaccnnnnnnnnnnaatgaaagggcaacatgcacattaccttccccctaccaaggcatgcgtctgcaatgtgccacatgtgccaagctaatctcacctgtgtagttaggcttcgtgccgctggtcacaaggacctcctctccgttgcagatgacccgggattcctcaaaccattcgggatggatgttcttcttggcgcaggctacgtgagacggcacacaccgtccctgcgggggaggtcccgtggaagcagagtcggcacgaatgcgtacagcgagagggacgtcaacgcaccacatacacagcacatactcacccgtggcgccgtgtgcactttggtaggccgaagcgcaagcgcatggctgctgccgaaggccaccgcctgctgcatatcttatcctgaggtggcactcccccttccgccgcttcccgagcttggccccggcagattatcagagttttgtttgaagtcgcgtggcggagccgacttcgtcgcggtaatgcggtggtgggtgtgcagtattacgatcgtgcggtgggatgcgacacccccctcatcccacctcgcgcgcgcgatcggcccggccatcaagcggactgcaggactgcatgaggagtacccttcgacaaagctgaaacaagttcttcgagtgcaggtgcagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtggtggacacccgtctccaggctgggaggggggaggacttctctgcggcgaggaagaggagggagatcgatgagctggccgagctcgcaaacctggacgatgacgacttcaggtcttggcatgattccagtctcggagagtccttcgacacctgctggcagggtcttccgggacccctatgtcagaaccgatgccaccccttcccagaggccagtcccatgaacatccctagtacctccatgcgtcaccacgccccacgaccccatgcaggcttccgatggatcacaggatagaggacggcatggactggagtgccacccagcgcatctccctggccgaacccctcccggcccacaacctgggctaccgcctgctagagcgcatgggctggagggggggcggcttgggggcgcggggccagggccgcgcggagcccatccccctggaagccggggacaacggcgtgcgggcggggctgggacgcggcgaggtagactcacagtacacaagcgtttcaagccgccgcgcactagaggtggagatacaggcagacgaggacgaagggcgccgaatacggagggaggtgcgctgagaactgacgttacgtcttgggtgtgggtttcatgttggtgaagtcctacggtggtggtggtctctgggccagctaggctggagattccttggaggtgtggttgacctcgtgttcaagacaccctctccatctctcacaatnnnnnnnnnncaaagtcctacggtggtagtggtctctgggccagccaggctggagattccttggaggtggggttgacctcgggttcaagacaccctctccatctctcacaatctttgcctggctgggcgctcttggtccctcccccacacatcccctctctcgcccccacaggccgagtcggagcgcgtgcagctgatccgggaggaagtggtcgacatcctgcgcaccttcttctgcgaggtgctgtgcgacggcggtctgcatcgaaggagggtttctgcgcattgaaagcggtcaaagatcccgccgaccaagtggtcacatgagcctctggatgcccagcatgcgactcctgccaggaggcacggccagaccgtggcccccccattcagaaatgtcctcccttcctcctgcggtcccagatatgcaacaagcagtaccagaccgccatgcagctagacgagcacctttcctcctacgaccaccaccaccgcaagcgcatggcggagacgcacgccatgctggccgcgcgcgggaagaaggaccgtgacaggcggcgaaggaaggaggccgacagggagctggcggccctgacggagcagtgagtgggtcagcgccgaggtgataatcatgtgtctactccagcacgtgcgtgtgtcttgtggcgggacaacaatgcccctgcccaacactccccgcacgcatnnnnnnnnnnaacggagcagtgagtgggacagcgccgaggtgataattatatgtctactccagcatgtgcgtgtgtcttgtggcgggacaacgatgcccctgcccaacactccccgcacgcatcgccacacaggtctttggcggcagccagggcggctggcctatcaggggctgctccgccttcgcacccagcagcgtcagggccggagactgcatccgaagcttctcttccccacccaccctccacagctgcgcacgacatgcctcctctgccctccgaccccgacgcttcccccttgcctcctataccaccacctcctaccctcccaacacccccgccccccagcctgcccgcggagccaccccccgcccccatgcccggcctcagcttcaaggcaaagggcgctctgggccgtaaggcccttcccaagaaggcggtttttggtcctgactccgactctgactagtcaatgttccaaaaatgggtggcagtgaatgctagggagcacacgctaatggggaggcatctctaagcgcaagtacagagcgaggagcagcggggactgagagctgtcggcgcgggggcactctcggattgcattgagcagggggggaagccaggcacggcggctggcaccggggaccgaggtccccatatctagaggagaacgacccggcggtgcctgctgtccgcgccgtgccgtgccccctccacacactcacaggatgaatgcnnnnnnnnnnagggaccgaggtcgccacatccagaggagaacgaccctgcggtgcctgctgtccgcgccgcgccgcgccccctccacacactcacaggatgaatgcaccgggtgggaagaaagggtgtctcgctgagggacgcaaaaaggagacgaggaaaacgaggggggcacatcacagggcggttccacggggagggagcggcgcctggggagcgcatgatcccaagggattcagtgtgttctcggggactggactgggtctgcccgccacgtggggtgtcggtcaggcgctgcacacccaggccggtgcatggcaagaaaggtcgacaagtggtacgattggaggaacgtcgacgcgggcaggcatcgatgcacactcagatggcggcggcgtgttgcccgccaccgcctcgctgctcgctcttattcnnnnnnnnnntcgccgcacacccaggtcggtgcatggcaaggagggtcgacaagtggtacggttggaggaacgtcgacactggcaggcatcgatgcacactcggatggcggcggcgtgttggccgccaccgcctcgctgctcgctcttattcatgcaggtcgctgctcgttcgtctgggaggcccatggacggacgtggacctaaggggccgaaaaattccccgtggctccacctccgatctcagggcgccacgacgtccaggcccagggaggagggcagcgcgccgcggcgcgccagctggcgcgcgcggctgccgcccgacccggacccctggcgcgacatgcgcgccgcgacgcgccggcggcgcgccagcggcgtcagccccgccagcacgttggcactgtcgtctgtgcaggcgtgtgcggaggcggctgcaaggccagccgcctccgcgccgcccggcgcggtgcgctcctccagcagcggcaggcagtcctccgccgcatcgtacagctcgtcggcgcagggcggcgggggggcgcccgccgcctccggtaagcgcaggctcggcgagcgctgcggaaccgccgcgctttctagcgccacgaagctgaccgagcgcgagcgcggtgcagagcgcggcgtcgatgggttcttgccgtttgcgtggagggactccggcaccggggggtctgcaccacctgcagggcggtgttcagcccgcgcccctgaccccgccagcgcctcggctgcattggcttcaaacgccgccggccccttggccccctcctcctcccccgcctccccgccaccccccgctgcctcggcgcgctggcgcgccgcggcgcgctcccaggtggcgacctggtggatgcaggcgtccagcgtggcctcgatgccgcagttgcactgcaccgccgacagcttggcccaggccgcgagctcgccggcgcgcgcgccggcgcgcagcccgccgcgaccg

SEQ ID NO: 35384 - DNA, 626 bp, Chlorella protothecoides
  modified_base (154)..(411): a, c, t, g, unknown or other
ctcatgatatttacacatcgtgcccttgcccagccctttccaacgtcggctcgtacctcgacccgccccacatgcatgcgcaggggcatggttgacgttactcatgagtatctcaaaccgccagagccacatgccgacagagcactctgaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgggttgcaaaaggatgggtggagtgggggggtgcggcggggggccgggcgcagggctgggtcgaatgctggaggctgaatatggaggctcaggcgccatgccagcataggggcacctccaccaccctgcagcagactccaaattagaaacccagcatgagtcgacaacattcccccccgcgggagcgcacttgaggtccgcggcggaggcc

SEQ ID NO: 35385 - DNA, 61 bp, Chlorella protothecoides
tgtagtaatacacgacaccggcaggggaggggtgcgccgtccatgcagctgcagcttggcg

SEQ ID NO: 35386 - DNA, 101 bp, Chlorella protothecoides
cagggggtccttgcggggccagatccggccatgcgtgggcttccaatattttagcaacccctttaaaactccaatcctgcaggaatgaaaaggaactgata

SEQ ID NO: 35387 - DNA, 743 bp, Chlorella protothecoides
  modified_base (315)..(324): a, c, t, g, unknown or other
ggcggcgcgcagctgcgcgtgcgcgagctggcgtgcggcggcgcgcgcgcgccggctgcgcaccccgcgcccaagatcgtgtcctgcccctcccgggtctgccgccacgtgtgcaaggccgcggagttcttccgctacgcggtcacggggggcatgctgtccggtgagtgggattgcagccggggcctgaggtggggggtggggatcctggtcaggggtgcaggcggggggaggggctgtgcagggctgcgcagcgtcactcgtcagggagattcgacggtgttaacacctgcgcagggcctgtgaccaaggccnnnnnnnnnnagtcagggaggtccgacggagccaacacctgcgcagggcctgtgaccaaggccgcttcaacccccacccccccccaacaacacacacacacactccaacacagagtccgccgagggcgaggccgaggacgagggggaggtggacttcctgcacatggcggtcagcccccgccccggcgtgggcggcgcggtggtgggctccccctccccccgcgaccccggctggtcccccgcggactgggtccccggcggctccaacgtcgtgctcagcgtggcggcggtgggcgtgacctaccgcgagcacgtcatcggcgcgctgctggactttgccgactcctgcgaggcctgcaagcacgagccgtggctctggtcgcgccagtgcggcggccccggccccggcgcgccgccgccgcgcgaccc

SEQ ID NO: 35388 - DNA, 61 bp, Chlorella protothecoides
gcatgggaagcagtgagtgcatgcaagtcgagcacaccggccccactcagtatgagcatct

SEQ ID NO: 35389 - DNA, 118 bp, Chlorella protothecoides
aggtggatgcgcagcagggcctccaggtgggtcgccttcttggtcgccgcgaccccggcgcgcgcagagggcgagcactccaccacgaggtgcgccgcgctggcctcgctcccgcctg

SEQ ID NO: 35390 - DNA, 128 bp, Chlorella protothecoides
ccctgcctgcctcaacaatatagccacaggtggcagcccacctgctcgccagcctccacagccttctccgccatttccagctccgactcagcagcaactttttcctcccagcgccgctcttcatccat

SEQ ID NO: 35391 - DNA, 141 bp, Chlorella protothecoides
cctctgccgtagatcgtctgggagggtggattgtggggcgggggtggtgggggacctcctgttgaatcacagtctgcagtgctgccatcacacaatccgccgccagccccggggtcagacctgtagcgctccagggaggcc

SEQ ID NO: 35392 - DNA, 62 bp, Chlorella protothecoides
ctgcagcagccaatcagctgggatattatttccgctcaggaggcggtcagctgtgcctccca

SEQ ID NO: 35393 - DNA, 61 bp, Chlorella protothecoides
aagattgggaatgacgggtgagaggcggcgggcgttgtctttgtgttttgtgtgggaactc

SEQ ID NO: 35394 - DNA, 105 bp, Chlorella protothecoides
catcattcccaagagcaaggccgcctaggccatggggggagggtcccccagtagacccatcggtcggctaggcccacccggcgccgacgaggccagatgccacag

SEQ ID NO: 35395 - DNA, 106 bp, Chlorella protothecoides
tcttgaaagaaatccagctcaccctgcatcgtccagacgggacgctccgtaagcgcacacatgccactccttctgatctgtgcgctggtccagcaccctccctgct

SEQ ID NO: 35396 - DNA, 107 bp, Chlorella protothecoides
cacgccgtcctccccctggccgcccctctgtgaggggtatgtgggagtttcatgaggagtgggtgcttgtatgaggagtggctgaaagggggtatgatatcaatatt

SEQ ID NO: 35397 - DNA, 78 bp, Chlorella protothecoides
agcgcccgtcggatcacggggtccaccaggtagctgtaggggctgaagaccatgtcagcctcctgcaccgcagggaga

SEQ ID NO: 35398 - DNA, 74 bp, Chlorella protothecoides
tggtccaggattgagcaggcctgaagtacaaccaatcggcctcagacacatcatgtcgcccctggggcaaggaa

SEQ ID NO: 35399 - DNA, 78 bp, Chlorella protothecoides
ggggggaagaactgagcaagtgcagccaaaccggggtcgcggtcttggtacagatcatgatgcgctccagtctcggga

SEQ ID NO: 35400 - DNA, 61 bp, Chlorella protothecoides
gcgcatttgcataatcatgtaaaaggggggtgaaaaggctggaggttgcgaaggtgagcac

SEQ ID NO: 35401 - DNA, 76 bp, Chlorella protothecoides
gcatgcaccacaaatcgtgccgtccatgagctcggcgcgaggcggggcccgcgggcgggcggtggagcatgacggg

SEQ ID NO: 35402 - DNA, 61 bp, Chlorella protothecoides
cacatagatgagcagggagaccagcttgtcaatggcctccatgcggcgctggcgcgtggtc

SEQ ID NO: 35403 - DNA, 140 bp, Chlorella protothecoides
acagcatcgctgcgtacaggtgaggggagctggccatgctacccatcctgccctttctctgcactgacatttgacgtggctgggacgtgacccagcaccagttccaagcttgctgcctctctgtcctgaacagactggcg

SEQ ID NO: 35404 - DNA, 61 bp, Chlorella protothecoides
acgagcatgggcatgatcatcatgaccgtggtcacaagcacgacgagcatgggcatgatca

SEQ ID NO: 35405 - DNA, 80 bp, Chlorella protothecoides
tgcgcggctgcccgcactgtctcggccacgtccacctcggcgatggcatgggacgtcgccaccgacagccgccgcagggt

SEQ ID NO: 35406 - DNA, 79 bp, Chlorella protothecoides
ggaggaggggtcttcttgactgggggtggaggccacttcttcgttgagggaggtggtttcttctttgctgggggtgacg

SEQ ID NO: 35407 - DNA, 95 bp, Chlorella protothecoides
tgcatgcgcagcacatcacagcaagcacgcacaatggcaactcctcatgaggggcagacaacctggtcagggatgctgatcagggcctcaacact

SEQ ID NO: 35408 - DNA, 123 bp, Chlorella protothecoides
tgtcaagggcatgaggtcagaggaggtccatacagtgatggcagggatcgcgctgagggtgaggttttttgtcacgcaagggtcaggtggtttagccctcaaatgtcgggggccaggtcaatg

SEQ ID NO: 35409 - DNA, 61 bp, Chlorella protothecoides
ctccccggccaggtgggggacgtggtctgggacaaacgcagggaagcctgccttggcgcgc

SEQ ID NO: 35410 - DNA, 111 bp, Chlorella protothecoides
cagggtgtgtgtggtggtggaaacctattggggaatcccgcagagagtaaagcaagctggggtggggcgggttgccttgggccccctccccactcagtccgagcccaatgc

SEQ ID NO: 35411 - DNA, 61 bp, Chlorella protothecoides
cagcatcctatcgtcgtccgtgctcacatattccaaatcgtgcaaacggtcggagctggga

SEQ ID NO: 35412 - DNA, 117 bp, Chlorella protothecoides
gcatcggtgggtggcgcgggctggtggtgttggggggggacggggtgggaggggcgaggggtcagggcggcacatgcggggcgacacggccgggtgggtgcgcccacgccctgaagg

SEQ ID NO: 35413 - DNA, 61 bp, Chlorella protothecoides
cgcctatttgggggggaaagtgggggggggtgatgggacttacagcgtgcagagtgcggcg

SEQ ID NO: 35414 - DNA, 119 bp, Chlorella protothecoides
cttctggatcagggcagtggaggtggaaggaggagcagactctgtgacagccgctgtctcgtacctcatctacacctcacagagcacttgtgagatcctacagagtgctcctttgaaag

SEQ ID NO: 35415 - DNA, 134 bp, Chlorella protothecoides
gtactgcaaaggaggagaggggtgtgggtgcattctgaccctggggctgcaggtggtctggggagttctgtgtgatgaagcatgtgagcatgccgaacgcagccgtcacaacagggttgggcctggatctggac

SEQ ID NO: 35416 - DNA, 63 bp, Chlorella protothecoides
gggcaactggtcggcccaggacagagggggtaccatgcgggggcccccgccggggccctggat

SEQ ID NO: 35417 - DNA, 73 bp, Chlorella protothecoides
agccgggcagcggctgtcccaagaggtgtgcagcttgccgcccgcaatccgctagcaaaagaggagggcggcc

SEQ ID NO: 35418 - DNA, 466 bp, Chlorella protothecoides
  modified_base (103)..(340): a, c, t, g, unknown or other
cttgcccctggcgtccctggtcgtgccccgacagcggagatttcagagaggtacgtagaggggagtgggggagcctcctttgttgagatgggattggtgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcaaccgtgcaaggggcccgatgcgcgacagggttgccgaggctccccgacgttaatccagtgccagtgcagctgcatgccgtcccatcctgctcccaccgcccaggtcaaggatgccagcctg

SEQ ID NO: 35419 - DNA, 640 bp, Chlorella protothecoides
  modified_base (150)..(258): a, c, t, g, unknown or other
  modified_base (391)..(485): a, c, t, g, unknown or other
cctctgccgggtctgcggggtgggcagggggatggatggtcggctccggtgtggggctgcccgtcgggcaacgcgagcactcacgggacgcagctgaagactgagtgcgagggccgagcagggtgtggtgctgcagccaggctggctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgacacactccagccacccacccagcccatgcctgcgtcgccgcgagccacccgccgcccctccatcccccggtagcccaccctggaacagagccatgcattcggcgtcaggggtcccgcagacttcctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagccgctcgccacagccgcgcacacccgcctgaaccgcacggcaacctatggtgggcgagagaattggtaccggatgcggggggggggttgttggtgtgctgacgaacacttcagcctggctaaggcaccgcgcacgggtgtcaggctccca

SEQ ID NO: 35420 - DNA, 122 bp, Chlorella protothecoides
ggccgtggatctgcggtgctcagcaagacggccccctaaccctcagcggcactccagctcgcccacatcactcccccctccaaaagcaaaatgcaccgtggcctcgttctcggcgagcttgg

SEQ ID NO: 35421 - DNA, 70 bp, Chlorella protothecoides
cgggcatcagggcatcaggtccactgcaaaactagagctgcctcgaggaaagcatacagcaacaccccag

SEQ ID NO: 35422 - DNA, 128 bp, Chlorella protothecoides
tgcggccacccaattggtgcatcaagcaggtttctaggaccataccccccaactccacagggtgatgggggattcttgcagtatatttcattcagacccactacagcaagtcctgttatgtgggtgct

SEQ ID NO: 35423 - DNA, 64 bp, Chlorella protothecoides
tgcctgggcgcaggcgcgtatgagctcctcagtaagctccatcatgccatggtagtcggtgtag

SEQ ID NO: 35424 - DNA, 125 bp, Chlorella protothecoides
cggacgcgacggtgaggcagggaggagggggtgagggctggaggggaaggtgtaagggaatggaggaggggtactgggaagtctctgtcgagaatggggacggggaatacctcagacgactgcca

SEQ ID NO: 35425 - DNA, 61 bp, Chlorella protothecoides
ccaccgcctggcaggcgtcccggccggcggacgacggacatgccgagcctgccggcagcct

SEQ ID NO: 35426 - DNA, 66 bp, Chlorella protothecoides
ttttactagtactgatgagtacagggaagcaaaattctgtccccgggatcagcaatgatgtgctgg

SEQ ID NO: 35427 - DNA, 79 bp, Chlorella protothecoides
cccgaacttgaccccttcccacaactcttggccctcgcgaatggtcatccctgcaggcagcagcaccgccccaggctcc

SEQ ID NO: 35428 - DNA, 70 bp, Chlorella protothecoides
gtacagcttcgaccccaacttcagggacaggatccggaataagtcgctgcgcatccggctggaaagcacg

SEQ ID NO: 35429 - DNA, 109 bp, Chlorella protothecoides
ctgtcctcgcgcgagtccgccttcctcctgagcctgtgcgagccgcgctgagagcgctgagaagggggtccacggcaagggcccaggtcgccttgtgcgccagagtcca

SEQ ID NO: 35430 - DNA, 66 bp, Chlorella protothecoides
cgctgcttcgagctcagaccggcccccggtgcctggagagggagccgccgagtacctgcacggcgc

SEQ ID NO: 35431 - DNA, 78 bp, Chlorella protothecoides
gacgtttgggacccagcaggagccctcgtcatgtgttgccagctacgcgggggggaaggggggggggggggggggggg

SEQ ID NO: 35432 - DNA, 64 bp, Chlorella protothecoides
cgccgccttgcaaagtctgatctcgcgcgccgctgccacgcctgcgacggcgctggctgcctgt

SEQ ID NO: 35433 - DNA, 84 bp, Chlorella protothecoides
tctctgcacagtcgagggggtccagatcgtgatgctccgagctacaactcccaccgatgcacatcaatgaacagtcatccaccc

SEQ ID NO: 35434 - DNA, 79 bp, Chlorella protothecoides
aaaggcacgggctgcacatgctcgagtgaggaaaggtccaggtacacacgcctgcccagggctggcacggcacacctcc

SEQ ID NO: 35435 - DNA, 135 bp, Chlorella protothecoides
tagactagcatgcaacatttcacataaaaccatcacatcacccatggcaggcgagactcgcagctggatgggtgtgtgggtatgcagagaattcgcctcacctcgcgccctgacattcggaatggtcctctctca

SEQ ID NO: 35436 - DNA, 61 bp, Chlorella protothecoides
ttccatgattctagacggcaaaattggtaccgctgcgacagtgagttccacctgattgctc

SEQ ID NO: 35437 - DNA, 109 bp, Chlorella protothecoides
agggcggccggggtggctgaagatggggagttcgagggtgggcaggtagggggatcgcatgggcgggaccggacacagtagctggtgtcgtcgggaagcatgcggccgg

SEQ ID NO: 35438 - DNA, 61 bp, Chlorella protothecoides
ctgtgtccgtgcacagcaccctgacagattgtgccaagtacttcttgccaagcaaatggtt

SEQ ID NO: 35439 - DNA, 86 bp, Chlorella protothecoides
ctcgccaagcacaccgccatccgggcgtgcttagtaaactggagtgtcaaacagcgtttatacacaatgaacgtagaggggaatag

SEQ ID NO: 35440 - DNA, 109 bp, Chlorella protothecoides
agcctgtcagtatggcttcatccccgtgccgagaggagcttggtcgatggcaaccggccttttgccacccctccccttcggcctagatcctcggctgagctggcgcggc

SEQ ID NO: 35441 - DNA, 204 bp, Chlorella protothecoides
ggctcaggggtgcagcggtggcagcccctctggccgggccgaaggcgcctcggccccctgcaccgacagcgcatcgccgccttgtgctgtgctcgcctccgcatcgccctcgccgctcttcacagcctccgtccctgcctcaacctggccgccctgccccgcgtccgatcccgtttgcaccccgccgctctgcacagcctccgc

SEQ ID NO: 35442 - DNA, 61 bp, Chlorella protothecoides
ccgggtcgatgccgatgtactggtgtatctcggcatcctctggaggggggtcccgcctgca

SEQ ID NO: 35443 - DNA, 78 bp, Chlorella protothecoides
acacacacacacacacggccccctcctcccccgcgatagttaagaatcaacatgcagcagcccacgttttgggctcct

SEQ ID NO: 35444 - DNA, 78 bp, Chlorella protothecoides
aagtgcctgatggctttgaaatttcccaaccatcactctgtccctgttcaagactttctcccatcaaagtacatgtga

SEQ ID NO: 35445 - DNA, 61 bp, Chlorella protothecoides
tattatgtcagaaagatgatctgctggttctcctgcctgtaatattgcctcatctgacgac

SEQ ID NO: 35446 - DNA, 80 bp, Chlorella protothecoides
cctgcctgtaatattgcctcatctgacgacacgtggtcgtgacatccggcggaaaacctacaacgcaggctccaaccaaa

SEQ ID NO: 35447 - DNA, 61 bp, Chlorella protothecoides
actgcgccagtcagatcccgcttgcgggaacaagctgctagcaaccggcgcaagcccggta

SEQ ID NO: 35448 - DNA, 61 bp, Chlorella protothecoides
tcttcggagtttgggccggtggccatccccagccttgcagcaggtactccaatgaacccag

SEQ ID NO: 35449 - DNA, 111 bp, Chlorella protothecoides
aggcgaggggggccaggagcagggtctggaacgcctggcaaccgtgtcgtggggaggaggaggagggtggggagctgaagcgtggacgatggggagggggcgcatgggaca

SEQ ID NO: 35450 - DNA, 173 bp, Chlorella protothecoides
tcctaggctcgatgcaggaatggacttgttctgccacccgtggcacacatgtacgacggcatgggcactctaaggaccctactcatgcacgccccttccactcccttgtactccggttctgctgtcctgaaccgtcgtagcctcccacacacatgcccaccctggcactccaa

SEQ ID NO: 35451 - DNA, 91 bp, Chlorella protothecoides
ctgcgtggaggcccccactggtccccacattcctctagtaaactcacacacacaccgatgcccctctccgctcccaattactcgtccctca

SEQ ID NO: 35452 - DNA, 121 bp, Chlorella protothecoides
gcacgtgcaggtcgggggcctgctggcgcgtgcggggcgcggcgtgccggaccccgtcgtgcgcgacctggcgggggagggggcgccgcgtgtcgaggcggcccgccgcgccctgcccctc

SEQ ID NO: 35453 - DNA, 448 bp, Chlorella protothecoides
ctttgcccagcccccacccagtaccatcccccagcccccacccatcaccattccccagcaagctgtcgcctccatcacacatcccattcccgccaccctcgcccggtgcactcccaccacctttgcccaaagcgtccccaccacctttgccccgtgagcctccgccaccatcgtcaaggctgtttccgcctccatcacctggtgagctcccacccccatcaccgggcgcagtcccaccacctttgcccagagcggttctgccaccttcgcccagcagacccccacctccatcccccagtgagctcccaccttccgcgcccgagcttccgcctccatcgccaagaagccctccctccccacctccaaatcgccccccaatcccaccaccggaacaccccccggccccattctctaagcgtccctcccctccaccgcccacgctcccccc

SEQ ID NO: 35454 - DNA, 68 bp, Chlorella protothecoides
ccttgggcagctggctgccagataaataaaactatgatacagtatcaagcacaaggagtgttcccggc

SEQ ID NO: 35455 - DNA, 127 bp, Chlorella protothecoides
aggatgcaacactgtgggctggtcattcagcgacactgcgtcacctccagccccagcccccagcctctcaccccgccccacactccctcatctctgcaggaacgggatgggccggcacacctttgtc

SEQ ID NO: 35456 - DNA, 18874 bp, Chlorella protothecoides
  modified_base (112)..(169): a, c, t, g, unknown or other
  modified_base (5632)..(5687): a, c, t, g, unknown or other
  modified_base (6110)..(6119): a, c, t, g, unknown or other
  modified_base (6553)..(6562): a, c, t, g, unknown or other
  modified_base (6920)..(6943): a, c, t, g, unknown or other
  modified_base (7535)..(7544): a, c, t, g, unknown or other
  modified_base (7961)..(7970): a, c, t, g, unknown or other
  modified_base (8604)..(8613): a, c, t, g, unknown or other
  modified_base (10121)..(10130): a, c, t, g, unknown or other
  modified_base (10640)..(10649): a, c, t, g, unknown or other
  modified_base (10934)..(10943): a, c, t, g, unknown or other
  modified_base (12279)..(12288): a, c, t, g, unknown or other
  modified_base (12452)..(12461): a, c, t, g, unknown or other
  modified_base (12616)..(12625): a, c, t, g, unknown or other
  modified_base (12730)..(12739): a, c, t, g, unknown or other
  modified_base (13452)..(13461): a, c, t, g, unknown or other
  modified_base (14099)..(14108): a, c, t, g, unknown or other
  modified_base (14318)..(14327): a, c, t, g, unknown or other
  modified_base (15473)..(15482): a, c, t, g, unknown or other
  modified_base (16608)..(16617): a, c, t, g, unknown or other
  modified_base (17087)..(17096): a, c, t, g, unknown or other
  modified_base (17393)..(17402): a, c, t, g, unknown or other
  modified_base (17659)..(17668): a, c, t, g, unknown or other
  modified_base (18376)..(18385): a, c, t, g, unknown or other
gcgtcgaggcggcggaggccgccgaccgcgcgccgcctggcgcgacgcgcgccgcctggctcctaggccagtgcgccgccttccggcgcgcggcggcgggggagtggcaggnnnnnnnnnnnnnnnnnnnnnnnnnnnnnnnnnnnnnnnnnnnnnnnnnnnnnnnnnntttccacctcgtcttcggcgtgctgtcccaggacggcgaacaaaggtgaggggtgggggtggggaggatgtcggctgctggcggcccagggcgccaggcgtgtgacaccaccgcccaaacctgcgatctcccccttccccttcctgccctctcctcccgggccaccctgactctgaccagacattccccctcgccccttttgcagcgccttcaaccagcactacatgccctggctgaatgatctgggactagagaggctggaccacgagttccacacgctggccaactacctggcgctggcgcgggcgggggccgaggtgggggaggtgcatggcatgatccgggcctacgtccaggccgtcgtctccaaggtggccgccacctcgctggggtaaaggaggttccactccagaccgcggggcaggcgcccaccccgcggtctccctcccaggggctggcttgctgctgcgggggaggtgcagggagtcagaagggcttcttcagggaacattcctggcgcctggcccggaggagagtcctgaaggctccgatgggccccacatccacccccctcttcacccttcacctgtgccccgcgcactctccctgtactgctaacccccccccaaaggatccgccaccactctgctcgtcgcgcttcaccttgccaaggaatgatgttaggttcccaaacatcacatgccctcacgcttgagtactgtgcctgccctgcctggcgggaggctgttgcacccagccctgctccctgtcgtgttcgatccttttgctcctgatcatgggcaacgaccgtagcctctggtaccccacatgtctgcagcctgcccttccctgctgtcatcctgcgatggccggtgatgcaactatctgaactgctctgtgtgaaaatctcaccaggtccgactgggcactgttggcgcggggtgtctgaagcggcattgctgtcgagtggcctcgggcatggagtggccagctggatgccggcgcaggggtggtgtgtgcctcgctgtggggccatgctgggtccacctcagcagccgtgacagcagggactgcgcattgggcatgggaggaacaaacgggagggggccaggctgagtggagtgaaggggacaggaggacacaaaccccctccaccaaaacccacaaacaagaaaccaggaaggcgcttggtccctttcgcgcctgggcctgtcgcccgtatgtcagaggcaaggcagttcctgattcatccccttccacacccacaccaaccgtgcacgtggcagaggagacgcagggcgttcctggcgtgaagcccctgtcgacgatgggcgtcaccatctcccgtgcggaggccgctcccaccgccccaaaccccttcttcccagccactgccgccgctgccatcgccgcggtcgataaggtggacgtcggatgattggaaaggatgggatggaggtcaggaggtggtaatgttacctgctgtcgtgtgtgggactgctgttccggtgtacgagtgcgcaccgatcacccctcacccctctgtgcgaccacgcagcccaagaccgactacatgaacctgcctcagcctgtgcgctacgatgagctacagcgggagatcatgagtgcgtgctggggagggaaagtgggtggggggcgatggaagagggggactgggaaaccctgcatggacagccaatgcgcaccgtgggtcttggggactctacctcgcgttgcctcccgccggccgaggtataacgttctgggccagtcctgcctgcggattgagcccttgccacatggctctggatccctctcaccccttgacccccctcccgaccccgccccccaccccagtgtcgctgaagcccgacctgtttgagggcatgcgcctggagctctccaagcccctgaaccacaactttggcctgtcccacagcgtgtacatgggcaacctggaggtgcccaccgccaacaaccagcccgtgaagatgcccatcggcacctacgagtttggcgccaacctggtgaccaacagcggcaacctcatgctggggcgggtgaccaccgacgggcggctgacggggcgggcggtgtacaacctggcgccctgggccgcgctcaagtcccagtttcagctggccggcgagccggggatgagccagggcatgtttgacgtggacgtgcggggcgccgactggaacggcacgctcaagtatggcaccagcaacttctacggcgccaactacttccagtccgtggcgcagaacctgtcgctggggggggagatcttctacctggcggagcagcggcgatctggtgggtggcgcaggctttgattggccaaggagggaggtagagggatgggggattcttcatggtttggtgcgatgcgcagccaggtctgggcatccgaagctgggacctggacttgattgaactgggggcgatcaagtgtggggtcgcaacggccctggcgcggccagttatgggaatcccagacgcttgcaagactgtttgatcccacggtgcgtgtcccttgattgaagaggaggaccacccgggtgcatacacagcacgcctccaccccttgcaagcgtcccagtgacaccctgcccgcatgcgccccgcgcgcaggcatcggtttggcggcgcggcacgccaccgacacctcgatcgccacggtccaggtggcgaacaccggcctgctgtcgctcagctacctccagcgcgtgaacgagaaggtgaggggctggggggtgccagcgccgatgccctctccaagggatgcacggccgtacttgtgagccttgcccccccccacttcaggtgaccctgtccactgactttgtgttcaacaagaactcgcgcgaggcgacggcctcgttcgggtacgactacatcctgaggcaggcacgactccgcggccgcatcgacaccggtgcgtgcgcgcccggtttggggcagggggggtagctgggagggggcggtcacgcgcccagcctggcagccttgccgtgccgagccttgcaagcacgcgctcccagggtcaggtcccccccgcagctggccgcttggaaatatcagacccgcattcatggaactgtcccccctcacacgccctcgacccactcctgtcgccagacggcaagattggcgcgtacgtggaggagaggctgtcggtgggcatcaattttgtgctgtctgccgaactggaccacgtgaagaaggactacaagtttggctttggcctgaacgtcggcgagtgagcatgcctgccctcgcccctgcgatgtgccggaggcggtgccatgaatgttattcgctgggttggtgtgacagaggagggggttgggctgggggtggtgagggcccggcaacgtggcagggaatgggggaggaggtacaggaggcaggtagctggcagcagcacctgtggggcaggggatgtaagaatgctgctgcacggggctgctgcacgcctgctcatcatgaaccacaggtgacccaggaggaagtcctgggctcgcttccacacagcactcttgtcctgcatccagcatcagagctcctcctggctgcgcctgacgatgcgtgccaccttcttccggaactctgcccggttctccctccactccttggcggcgtcgatgttggcgggggactcgtcgttgggcgaggatagcatactgatgatggacagcacgatgctctccacctgaagagcgaggggggaaaggaatggaatgctgatctggtagcagggctgtgctgagtaggatgtctggagccgccgggcctaagcacttgggagctgcacaggccaagctggctgccgctctaccaagttgagccttttagctagtcgacgcgcaggtcaagcagagacgagtgccgaccccgatcactcacggtgtgcacggggctccacttctcagcggcgctctcctgagggttcaaggggtcgaagccaggggcatgcaggatcgagatgcagacgcgcccgtccgggaacactgcagggacggaggcatgggcaagagtgactgggtcttcctgcagcctcactgccctgaatgctggaagaatcgcttgcacgcgctcgcagctcaggcagaaaactcaatgcagaagaccatagcgccacctatcaggccctccaccttgcgccggaatcgtaccgtttgggtgccacatggcggaggtgaagcggcagtcgggaggggactgggggtagtcaggggggaacttgaggatggcattgaagaatccgccctcatacagggtgtccggggggcctaatactgtcaccgcccactcgaagaggttgctgtatggagaggcagtggggggagaggcagtggggggggaggcatggagctccaggacccacatcactgaacatggggatgcgcctcaggccggcaggcccccgggctcccacctatcatcgttgagccctgccgagaagccctccacaggattcttggtgagctctgtgagaaacaggggagtgattgcattgagcagtgcaatgatagaggtgaagacaccgcgtcgccatgtgatcagtaacctcggaccttgcagacaaccgcacatcacgtacctttcaattgcttgcgaagcagcagagatgcttggtcggtcatgcagggcagagatcgatcgcaagtctgcctccagcgagcaccgacgtcagcctgtaacgtccaggctgggaccaatgacgcctcaccaagaatcacaggcgccgctcacggagaggttgcgcttgcaacaggcttgacaggatgcagtgagtgcagtgagttcccttgcagcgtcaggtgtcgcggggcccaagcgggaaggctgtgggcaaaggatgagaaaccctgctttccacgtttccgaaactatgcatggaccgtctcgtgcgacgaggtcctgatgctccttgtcacgactgcaacggtgtccttccagtcgtgttataaccagtagctggtttgtagcatgcttggggtggtggggagggcggtcccaactctgcagcggccgtgatgttggagccaccttgaggacgaccaggtgccatgcccagccccataccctacccgccctgctgcgtggtattcgtatatgctggcgatggcgaatctcttgcgcaagccgcgcgatccagtgagtggacgcacgtccacgccctggctgggcgagggatttctggcgtgctcctgctcaaagatgccggccagcacaccgtgctaacctgcgagtcccttgtcactcagttcctgggcacggaagcagctgaaggcgacgttgctgccaggtatcctccatgccagcttgcatgggcgcatgagtccagcgagtggggtgcttcacacggccatcaaactggaccctccttgcagatggctcaacaggcctctctaggatcaaacatggggtgctgactctcacccagccggtccnnnnnnnnnnnnnnnnnnnnnnnnnnnnnnnnnnnnnnnnnnnnnnnnnnnnnnnncaagaacctgcggccggtctgcctggcggactccgcctcggtctgcgccaccgccgctggcagcgggtgcctcatccagcggctggccgccggcaccgcgccccaggacgcggctgcgctggcatcgcggaacctggccaagggcgcgccagccgtcttcctggcggtgaccgacccggcggcggcaggcgaaggcgccgtgccagccagcgcgtggagtgctgcgctggcctgggtccaggccttcctggaggccggggccctggagggcacactgctcacgatcgtctttgcggtggaggcgccgctgccggcgccgctggcctgccgtgttgcagaggcgggcggcgcgccgccgatgctcgcccccgccggccccgactttccccctgtgccccggccctggcagagcttccaggcgannnnnnnnnnagccgatgctcgcccccgctggccccgacttcccccccttgccccggccctggcagagcttccaggcgagtgggccgacggggttggtcgacgtcagcagggcatgcgtggggctgaccctgcagcacctcccaggggtcaccaggttagaccgtgcagggcgccatgggggtggctgactggcagggagcgtggtggtgtggctggttgtgaagatgtgggaaaaggggacaagccgcatgtagagggtatcgcaactgtatcgagggtctgccagcatttgaggctgcctgcactgctgcctgcactggcagcggggaatcttcacctagcctctgcacccttcgcacgctctgcacttcccaatgcacttccacattccaggtgtgatctgatggagagcttccagccggaggccatctgccaaaagggcnnnnnnnnnnctgtgggggtgtgggagaaggggacaagccgcatgtagagggtagcgcacctatattgagggtctgccagcattcgagggccgcctgcactgctgcctgcactggcagcagggaatcttcacctagcctctgcacccctcgcacgctctgcacctcccaatgcacttctacattccaggtgtgatctgatggagagtttccagccggaggccatctgccaaaagggcggggcaggcatgatcctggcggagagcttgttggccgagctggcgtttaagatcgggcatgcacccaagtacggggcgtaggatatgtttcacagcggagggcagcgcggagggcatgctttgcagaacannnnnnnnnnnnnnnnnnnnnnnngctagctgtgctatgaaaaccatggcaatacatcactccacgatgctccgcgagagacaggggatggtgcgatgcatgcacgtgggatgagtggatgcaaggcaaaagttatttatacacaaaggacccagattattcagctatgtgcacctccgcgacctcagcgatgggcctgagcatcggccaggcgggctgccagccccacgaactgggccagcgtgaggtgacgagcagactcggcccggccagattcctcatgcgcaaaggaaagcatggtctctgcctctgtcacagagatttcctggcccaaggtggctgcagcctgcacggttgtggcgagagcggatactatgaattggcacatgggccgctcctgggcaagcagctgccgcacaaggtcacaactgccagtgttgaccagctgcattgtaaacgaggcagcccgcatccaccaggtgtcaccaaaggaacgctcaggacggaccacccaccaccaccctactccaatgtgttgcctccagtgggaccatacaatcccagctgcccccacattcccaaccgcttaccagtatcaggccatggatgtctaccnnnnnnnnnncgtgcaaacgcggcagcccgcatccacctggtgtcaccaagggaacgctcaggtcggaccacacgccaccgccctcctccaatgtgttgcctccagtgagaccatacaatcccagctgcccccactttcccaacctcttaccagtatcaggccatggatgtctaccgtccctttccctgcccctgcaaggagtgcaaaacacgcctctagctctcccgggctgggatcaagtgctggcagccctttcctgcgcttctgcttcttgctcgctgcagtgggcctcgctggctgggcatcaggagccagggtgtgtgcaccggtggggccgtgcgactcggggaagggggcagcggcctcgcaggactgcgtctcctctcggcggtcaggggccccatctccttgcgcgctgtgggattnnnnnnnnnnttggggtcgtgcgacttggggaagggggcagcggcctcgcaggactgtgtctcctctcggcggtcatgggccccatctccttgcgcgctgtgggattcagcggcttccttgactgcgagggacatctccagggcaagctgcaggtctgcatcatcctcatcctcatcgggcacaccctgtgcgatgtcactcgagcgggcggcgctgcagaagccatggacctcctcgctgtcctccacttgagcagccctctcagaggcagtactggtgctgggggagggcactgcctcctcacgcagagggtcatactcctcgggctcgctgatgtccctccctgcctcctcctcctcctggtcggacacatccgccaatggtgccctgtcttctgtagttcctgcctttattctgctggatcggcgacgaggtccaccctgcatctgatccaagcccaggtgcgctgccttggcctcatccctagcctggcgttcttgactgaggcgtcgcacagaggctccaatctgagccaggatggaggtgggccatgctacgcagcagacgatacaaataatataccatgaacaactacagcagaggggttcaaatacccacctccagctgctctagcatcgctttnnnnnnnnnnacatgctacaaagcagacgatacaaataacctatcataaccaactacagcagaggggttcaaaaacccacctccagctgctctagcatcgctttattccgcaactgtgccctccggcgagcctcctccatgcccgtcatgctgtatgccgacgagggctagcagctcatcagtgccatgcaattcgatcctttacgcatagaataaaccttccagccattgtcgagttgtgaacgccgatcccacctcgagcgaggacggtcgtgtgatcatgctgcgcatgctgggcctggaccccatgcaagtccaggccatcggtgtttcatgcacttgccgacattcgggcagcagcagctactcatcaacacctatgcgcctatactcgaatgccccctgcgcatggaaccggtaatcgaggtgccgggcgcatggggagccgtgtgacccgaaccggtcgggtgctggaggatgttttcttcaagaaagccaaggtttgtagagagctgtgaatcgtgatagaaatattgggtgttcccactttcttggcaatgcattaagtcgacaactctgggggtcatgttgtgcaggcagctgggtacgtggcccggagcgcctacaagctgctcgagattcaggagaagcaccgcattattccgcgagggggacaggttctcgacctcggatgtcatcccggagcatggttgcaggtcgcctgtcaagccatcgggccacggtctgcaggaggggctgtgctggggatagatctccaggtaggtgatgcgggccatcaccaagaggattccatctcattccatggcaatttttctccgatgaaaccgctcactgcgagcagtcttcgcacatggtcgtaagatatcatgcaatgccctgtccaggaaacatccaagcctggcaagtggtgcgatgaccgggtggttgttgtgcagggtgacgctcgcgagctgacactggacttctggcaggagtacgcgccgacggtgagcgaagtgtcagttgaacaggttgcagcatcgtccgctgaagagagatctccctttcacttgattgcagtttccctcatgccaaccgtcaccctagcacgaggtacaccgcccttcctcactttttccacacagggaatggatgtggtgctgtcagatatgtgccacttcacgcatggcaacaagatgatggactcctacaaatccttagagctggcgcagactgccgttgacattgccatgtcggcaggcccagggtcgaatggaatcctgcgacctggaggcagcctcatcatgaagcttctgcaggtaaggagggtgtaagcaacgatggtcaggagaacgtgggcgttgctgcatatggcagtgtatcacaccaggggtccttaaagtgcacagcagctcctgcaggcgcggcagcgggggagtacaccaaggtgcccctctgttctcggccatgtccattgtctctctcccgcaggggcctggcacaatggagtttgcggcnnnnnnnnnngaaagtgcacagcagctcctgcaggagcggcagcggggtagtacaccaaggagcccctctgttctcggccatgtcgattgtctctctcctgcaggggcctggcacaatggagtttgcggctgacatgcgtccctacttcaagaaggtggcttggcagcggccaaaggctaccaggagcgagagcaaggaggtgtacctcattggcctcaaacgccactccccatccgacctgtccgactccgcctgaccagacttccatgctatgtctcggtgagttttgatgactacgcagtgatgttagtaccttgatgagccttctgagtgcagattcaggaatgagatcgtgtttctgtggcttgaaggggtgattgcaaaacgctctttcgacctgcagcgtcattcgaggtaaccctgcgcttccctcgctgcattggggcacaaggctcttccacaggtccacgaggtcgaagagccatccggtggcggacaaaggtaccttgcgtgccacannnnnnnnnncaggggttattgcacaacgctctttcgacctgcagcgtccttcgaggtaaccctgcgcttcgctcgctgcattggggcacaaggctcttcgacaggtccacgaggtcgaagagccatccagtggcggacaaaggtaccttgcgtgccacaacttaaagattcgggctggactgtgatcattagactatcgggaaaccttgcaagggggcctccgtccatgccctagcgactgtacgcagccatcttgacgtcgtcatccacacaatgtcatcacatcgaccggtnnnnnnnnnnaggggcatccgaccatgccctggcgactgtatgcagccatcttgacgtcgccatccacacaatgtcatcacatcgaccggtcacctaatcaaggcagcatgcgcagccgaagctgcaccacatgcatttgctggattcaggggatgccagggggcaagcttgagccacgcaacctctccatcctcggcctaagcagcagtgacaaggttgttgtgcctcagcagagcatccaccgtgggctgcctcccgcggaaatcctgtgggaaggagtagaagacacatcggcagcatgaggcagcgatgtccagcaaagttttctttcttgaaagaagtagagtggatcccctcggacagcgcagacagcaggttgtcaaggtcctgaaaaatggtgatattgatcaggctataatgctgccaaaacctgatctccaccagcaccgcacctcaaacacgaggtgaggagcacgaccccctcccagggccagcacagtgtttgcgaagcggcgtccagtctccttcacggcagcctcgttgtccaagcccgcatcctcaaaggcggcaaaggcgtcggcagacagcacttctgcccacttgtagctgcgtgaaagtgtgtttcagtgagcgtcggggtcccgctcttcaagttgggttcgggccgagaatcacaacagtggggcggggaggatgcagtgagcatccactttaccaagccactgtcagcagccctactcaaggactttcgatgtatgtgcaggcccatgcaagccccaaaccttgcgatatgacccccccccccctcggcctccgcacctgaagtaccctgcagaatatccaccggcaaagatgtgggaaaacccgcacaggaagcggtcctctggtaggggaggcagcaccgtcgccttctccgcgatctgttggtgtttgttggtgatggcatgatagtagagtgagagtcatcagctgtgagccagtgattgcatcatcatgagcacacccaagtcgacacaccagctcaactatttactcatccccaacaccagctcctccatctgggggcttcatcgtcggaagcagctcatgcagcgagacacatccagcctctcagtcaccataaacgcgccttgcggtcccggtcgaagatggactcgccctgcccggggacaaaatcggtgtgcaggtcgaggtccagcagcgcgaagtggacctggcgcagggtcatgctgccagacctgtgcggggcgtggggcctctggggtttggcacctgcccagcacatcccttggaaggcacaggggggcacaccccagggacgacctgcccatgcaaccggcccacnnnnnnnnnncgtcgagtgggagccatcagctgtgagccaatgattgcatcgtcatgagcacacccaagtcgacacactagctcaactattctgctcagccccaacaccatctcctccctctgggagcttcatcgtcggaagtagctcatgcagcgagacacatccagcctctnnnnnnnnnnctgtaggtccgcgcggccaacaagcgctggtacaggtcctccggcagcttctcgccggtctcgtagtggcgcgcaaacccgtccagggtttgcctgtggtttattggggtgtgtgtaaaagctgatggatgtatattcacggctccagcgctggnnnnnnnnnncgcggggcgtggggcctctggggttttgcacctgcccagcacatcccttggaaggcatagggggggcacaccctagggacgacctgcccatgcaaccggcccacnnnnnnnnnnatccagggtttgcctgtggtttgttggggtgtgtgaaagagcttatggatgtatattcacggctccagcgctggacaaccggtcttgccccaccaggcgcagcagcacagccatggcagcttgaaatccatcccttcgccaccgcgccgcacctgtcatagcaccagttctccatgaattggcttggcaactgcgcggcaggggtggatcggcgggaacaggtcatgagactgggttggcaacgcatgcgtagcgacatggtgcatcgtacccgcgctggaagaggacttctgcaccgggttctcaagaagtcatcccagacagccctccgcgccgagcccctgtgccatcccggtgcaacccaccccacctcgacggcgtcccactccactccgcggatgccggcgatgaggccctcctcctgctgagtcagcatgtgctgggaagcgtgcccaaactcgtggaacagggtctccacctccctgaagacaggcacggggataaaattttcactgtctgcctggtttggaatggcgagatgctctcacactcacgctgcgcatgcagtctgaggttggataccatgtcaggaccagtcacaggcaaggaatgtctggtaccaaatggcggatagcagcggggacacccgtcctgatctccatgctgtggtcagatccctcaaccacatctcccacaccctgcctcaggccccnnnnnnnnnnaaggcaaggaacgtctggtaccaaatggcgaatagcagcggggagacccgtcctgatctccatgctgttgtcagatccctcagccacatctcccacaccctgcctcaggccccaagtcacctgaatgtcatgagggagggcttgtcccccaccggcggtgtctggttgcacaccatgtgcgccaccggcaagcgcaccgactggccatcctgagcgaacaggcgtgactgtccgcacacctcgtccatccttggcgacgggaggaatggggagcagtgagcagcgatgcctgatcaggaggcgcagcaggggcaggggctcgcgctgaggtcttcacctgacccccatcagtggacttccatttcccccaacacacaaagggaatgcagtctctcaccaggcaccccccctcttctcagagggacgggagtaggggtccaggtaaaagtaggccttgggctggccgtccttcttcaccgcgaagaacctgacgtccgggtgccatatgggggcctggccgtcagcggcctcgatggtcactccaaacaggcggttggccagctgcagtcaatgtgttgcagtgcatgggattcgtggtcggcagtcacagtttcctttgggtagcacagtggcaggannnnnnnnnncgttcccatcaagagtgcaggatcgaggagctggatccaagggtgggcgcaagcagtcccgtggatttgttccaaggcccctcccatcagcctccgacacctccccttcccctttcttcctccccaacaccccctcctcccctgaaatcgagctcactttaaacaggccctccaggacattgggcagggcgaagaagggcctcagctccnnnnnnnnnncgcagtcccttggaattgttccaaggcccctcccttcagcctccgacatctcaccttcccctttcttcctccccaacaccccctcctcccctgaaaccaagctcaccttaaacaggccctccaggacgttgggcagggcgaagaagggcctcagctcctcgtcgctgatgctgtacttgtcctccttcaggcgctccgcccagaaggtgacgtcccagtgcgccaggtcgccctggaagccgcggccggcggcaaaggcctggacgtcgcgcaggtcggcctcggcggcggggcgcgccgcggcgcgcagctgctccagcagcgcctgcgcctcgcccagcgtggccatcttgctggccatggacagctcggcgtaggaggcgtagcccagcagcgcggccttctcccgccgcagctccagcgtgcgctcgatgacgggggtgttgtccagcgcgcccgccgaggcacgcgtgatgttggcgcggtacagctcctcgcgcagcgcgcggttctccgcgtgcgtcatgaccgggaagtacgagggaaagtccagcgtgaagagccaggggccctcctcgggcgtggcggcctcggaccccggctcccccgcggcggcctgcgccgcgccggccagcgcggagggcggcagccccgccacctcggccctgtcggtgaccaggcgcttgaaggccttggtcgcgtccagcacgttgttgctgaacttggtgctcagcgcgctcagctcctgctggatggcgttgaagcggtcgcgcgcctcgccctccagcgccacgccgcccagcacgaagtcgcgcagctccaggtccaccgcacggcgctgggcctcggacagcgaggcccattctgggccgtccttgagcgccctgaaggctgcgtacagcggctggctctgatgacatggggaggagggggggggaggtgatcgatggggcacccatactatgatagatatggtacttttagggaggcaatgctgtccgtcaacatctgtgacaagcacagtgagcaggaagaaagaaaggccgggtgatgttggcatcaagcagactggaggtggagtcggtcagccttacgggagctggcggccccatcaaatacactccctgcacattgacagtcgcatannnnnnnnnngggtcagcctcatgggagctggcggccccatcagatacactccctgcacattgacagtcgcataccttcacaataccttacccccgtcccatctcagtacctgggacaggcggagggaaagcttgaccttctcgggctgcacctcctccaccgcctcacgcagggccgggttgtccttgacggcctgcagagggagcaacgaagggccccgtcagggtgcgcagtggcgcccacggctcagtcgagtcagtggatcataggattagagagctctgcaggccacctcccccagccccccaccgcaaacaaccatctcgccttcaggtgagagacagtaccccaggcgcgtgccatgcggtccgcgatgcgctccagcgggtccacgatgccggaccaggtgggctgcagccccttctccagctcgtccagggcggcatgctggcgagccaggacctccctgatgccggggaccacgtcctcgggcctcacggcgtcgaaggccggcaagggggagtcctggacgtgggagatggcggaatgattgccatcatggtacaaagtgaaccatcgagcctggccaaggtgcatgtcgcaccgcatggcccgcgatgcaccgtcctggaccacataccgtcagcagagggttggactccactgcgatggccatggcagctgccctcagggagatcgaattgctctgaccctgagaccgatgagattgctgggatacgaaatgcgagggtgtgcccacccgacgggagagtgggtccttgcgcgatccagtcacggaagcccaacgccggtgcgggcccggataggcagggcgcaggaagactttgctggtcggaacggcagtgcacagcatgtagattgatcgcagcaacattgagaaccccggttcacaagaagaacttcatggcacccccatgacgatggctctacatcctctctctgcgcgcggaaactcatggcgagacggccagacattttacaatcgtgagggtggaaagaattggaagaagggcgatgaaatccaagctccaaggagtctttgtaaacaacaggtgagaagaagaggagcagaaagggatatgccaactttcaaagaatagtagtgactgcaagnnnnnnnnnnctttatgatcgtgagggtggaaaggattggaagaagggcgatgaaatccaagctccaaggagtctttgtgaacgacaggtgagaagaagaggagcagtaagggatatgacaactttcaaagaatagtagtgactgcaaggtaggggtgctgggctggtctgtacacaacggccacgaatgtgagagtcgccagctctatctacgagtctacggcgattgctaactagggcttggatggcttggttgatcccttcttcacatgcccctttccctgtggagcatgagttgaagaggatgagtatgagatcagggcaatagcgatctctgtacaccacaccttagggtgctaagggagaacggtatattcagacagtctgacaaacatggcagcaaagcccatctccatctgacaacccctcatctggcagcccacgcactgaccaggcacttggggcaggggatgtcgtgcnnnnnnnnnncagcgatctctgtacaccacaccaaaggtgctgggggagaacagtacattcaaatagtctgacaaacatgcaagcccatctccatctgacaacccccatctggcggcccgcgcactcaccaggcacttggggcaggggatgtcgtgcgcccacttggcctcccaccgcacttggccagcccctttgcagatcgggcagggggactgcccaggtctgagggaggcaagggctacagggccccgggctgcctctcctttctcaggagctacagcattctttggcaatgtggggctcggnnnnnnnnnnggcgcctttgcagatcgggcagggggactgcccgggtttgagggaggcaagggctgcaggggcccgggctgcctctcctttctcagcagctacaccctgttgctgtacagcattctttggcaatgtggggctcggtgacggaggagcagctgccaggccttgtgctgccaacacttttggcagagcctcttcctcttgcgcggctgcctcctgttgctgttgctgttgctgctgctgccgctgtgaggccgtgtacnnnnnnnnnnggagtctcttcctcttgtgcggctgcctcctgctgctgctgctgttgctgctgccgctgctgctgctgccgctgtgaggccgtgtacaccgtaagggccaggctgtacaccaggaggaagcccagggccgcgcggctggccagtccgatcacgctcttctgcaccaggcgcaccatgagtgcggcggggaggatcttggacagcgccctgttcaggactcgctgcatggccttgatgaccaggcccggcatgagccggggcacggccgcgcagaccacagcaggcccgcgcgggctacgccgtgcatcgcctgaatggttgagtggcctcgtaatgccaccctgtcgcttcgcatggcgcaagctggccgaggctcgcgcggccactacatgacagggagcgctcgagggtctgatgccggctgtggtcaagggcatgctcggactcagtggcgctcctcagccatgcaaaaaatactgatgagcttagttgttgtccagcggtcttcacgctggcatggtatggctggggcctccagattttcccttgcaggccagggtttgatgacgcgcgcgtggccagacgtggatggatcaggtcacattctctccctctagtcgcaagctcgagacctgcctgcgtgccgggcccctttcctttgatcacatgacagacatgtgactgcttgagctatcgtcatctgtacannnnnnnnnncccatgtggatcacattctctccagtcgcaagcttgagacctgcgttggctgtggatcaggtcccatttcctttcacacatgacagacaggtgactgcttgagctatcgtcatctgtacagacaagacggggcaaggtggagatcaggcatgcactggccttgccctggttcggcggtcctgcccgggctccccacccttgcagaaggggaggcgcccgcatcggcagagcgcggcgtcggtcttggcgctcggggtctaagagatcccggcgggggtggcatcgatgacgctggtgtgtttccggtcgccgttgagcacggaaatctggccgtcggcgtccactgtgtgggggttgaattgggtgtcggatggcaagaagggtggtgatctctcgcacagaggattctcacccttggagcacatgctggtggtctacattgccatgcaacgcccttgtctcctcccccctcccccccctccacccccc

SEQ ID NO: 35457 - DNA, 61 bp, Chlorella protothecoides
tctgcatgccaatattaagtgtagtgctgatatgagaccctgcctgagtgaaccgtgtcgg

SEQ ID NO: 35458 - DNA, 170 bp, Chlorella protothecoides
agcatgggcggtggaggcaggattgggtattcatgcgagaacagggtgggacttccccatgcgacaccattgaatgtatcgattccatggaggagaaagcaactacaccaggccccacaacatggtcccctggcaggcacacgctctcgaaccggccaccccgccacccc

SEQ ID NO: 35459 - DNA, 120 bp, Chlorella protothecoides
tcaagaagtatgccctccaccagcggctcgacgaccccatctcgacgtctgatacgacaccgaatgcgctgcatgtacgcagcgcacgcgccgcgcatgttccccgtacacaccgcacga

SEQ ID NO: 35460 - DNA, 15755 bp, Chlorella protothecoides
  modified_base (488)..(497): a, c, t, g, unknown or other
  modified_base (838)..(847): a, c, t, g, unknown or other
  modified_base (1181)..(1190): a, c, t, g, unknown or other
  modified_base (1726)..(1735): a, c, t, g, unknown or other
  modified_base (2442)..(2451): a, c, t, g, unknown or other
  modified_base (3086)..(3149): a, c, t, g, unknown or other
  modified_base (3588)..(3597): a, c, t, g, unknown or other
  modified_base (4387)..(4396): a, c, t, g, unknown or other
  modified_base (4972)..(4981): a, c, t, g, unknown or other
  modified_base (5570)..(5579): a, c, t, g, unknown or other
  modified_base (6570)..(6579): a, c, t, g, unknown or other
  modified_base (8291)..(8300): a, c, t, g, unknown or other
  modified_base (9357)..(9366): a, c, t, g, unknown or other
  modified_base (9425)..(9434): a, c, t, g, unknown or other
  modified_base (10257)..(10266): a, c, t, g, unknown or other
  modified_base (10712)..(10721): a, c, t, g, unknown or other
  modified_base (10872)..(10881): a, c, t, g, unknown or other
  modified_base (11508)..(11517): a, c, t, g, unknown or other
  modified_base (12007)..(12016): a, c, t, g, unknown or other
  modified_base (12833)..(12842): a, c, t, g, unknown or other
  modified_base (12970)..(12979): a, c, t, g, unknown or other
  modified_base (13783)..(13792): a, c, t, g, unknown or other
  modified_base (13845)..(13854): a, c, t, g, unknown or other
  modified_base (13926)..(13935): a, c, t, g, unknown or other
  modified_base (14496)..(14505): a, c, t, g, unknown or other
  modified_base (14775)..(14784): a, c, t, g, unknown or other
  modified_base (15210)..(15219): a, c, t, g, unknown or other
tggcgacgtcggctgcgacgccggcatggtctggctgcgcagtcccggcctccccgtcgtccatggccctaccctccagggcacacccatccagcttcaggcgcttggcccccagagccgcctgccggtgctctgaaagtcgagccgcggcctgtgcggggagacccagtcctgaggtaagccatcggccattcacatcatgtgcatgggctccccagtgtctgaccagggctcagcatagcggtggaagtatcacaggtctctggattccatcctcgctcacctcgtccctgcgcttctgtgtggcggcctgagcgctgcctgtgcctccgggcttgtgatgccccgctctgcaagcacacggcgcaaggacctcgtgaccggggccttgggatggtctgctgtggcgcaaaatgtgtagctgaggctaaagaatactgcttggtgaaccctaccatgccaagtcaccttggcatggggatgccctnnnnnnnnnnccttgggatggtccgctgtggcgcaaaatgtgtagctgggctgaagaatactgcttggtgaaccctaccctgccaagtcaccttggcatggggatgcccttaggagatccctcgcactcaatagccaagtatcagcacgatatacaacatgctctttttcaaggtgctgagcaggaggcggtcttgtgttgtcgtcgcctgcatgtcactcgccggtggatccgacaggtagtccgtgaggaggtctcggacgaaataaacatagacggctgcctcaatcgactcgggaggaatccaaaagggtttactgaatactacaacagtgtagctgcatcgatttnnnnnnnnnncccgacaggtagtccgtgaggaggtctctgacgaaatgaacatagacggctgcctcactcgactcggaaggaatccaaaagggtttacttaatactacaacagtgtagctgcatcgatttgccgctgcgcaacgccggcgctgcaaggcttcctccatgctccagaatctcaggacaggtcataaactccattcattttgaaagcgcccatgaccaccaaggagacaaccgtcccacaattaagaggcacgctgaggcatacacattaaatagaacacctcgaagtacgactgggagatcgaccaggtgttcgagcgtcaggcgcatgacggcnnnnnnnnnntttaggaggcacgctgaggcatacacattgaatagaacacctcgaagtacgtctgggacatcgaacaggtgttcgagcgtcaggcgcatgacggctccccagcccttcgcaacgactccatgaacctcgccctgcgctagccagtcccctgggccagcgccatgatcaggacacacagctcccttcatgcccaccacaatgtccatggagcggttctggggccgccaaatggacgtggcgcccgcatgcgcccatccgcaccatcgggagtcaggggcgcaaagcggtggaggccatgtgccgccctacccgagccaaccaaaggacccagacttgctgcagaccatgagggccccagcaatcagccttccgtcattctgtcaagactgaaaacggtacatgcaaagggcgagagttgagggtggtgggggtctcctcgcgtgtgtgcagagtttgagcctctgtctgagtggccgacgagtgctctccattccctcatcgtggcgtggacccaaccaccatgtcacagctggcannnnnnnnnnggggcgagagttgagagtggtgggggtctcctcgcgtggatgcagagtttgagcctgtgtctgagcggccggcgagtgctctctattccctcatcgtggtgtggacccaaccaccatgtcacagctggcactaccatactggatggagtccagcgaaaaggtccaggcacgatggaagctagcaagagtactgggcttgacccttggcacgacgggcatcaggtgctggatggatttcgtgtgggtcttctttctcggtatgaagtgttgttgcgatcccataaaggtaaagcaggacacaatgtgcaattcccttcgtaacagggtacagctgattgacaccacacccatgccctgagccctccattcccccaccttcttcctcatgacagcgttgttttcaactacctcggccgcgatttcttcaacgccctagccgccaaggaccaggcaaagttctcggagatgctgattaagtacctgggggcaatcgtggccggcatcccagtgtttgtcttcaggtgtgacaggggatgatctgcatggactgtcagagtctgcagtgtattctgcttgggagcatgaagtgtctgcagccgctgggccctgccctgacattgcaggcctggatgccagcaagcccttggacatgtttggcaagagggaaatcccacaacatcagccactgtcaccccacgcagggattnnnnnnnnnngttggcaagagggaactctcacagcatcagccactgtcaccccacgcagggattactaccagtctctgttggctgtggagtggcgtgagtggatgacacgccgcttcacctccgactacctgtctggcacgtcctactacaacctcgcctcctccggcaccgtggacaaccctgatcagcgcatctccagcgatgtcaggtggccgtctcatttacccgcaacctctgcacaacatccatgagtgcagcttccacatggccagtaccacccctcagctgtgttccaccaccatctcaccaggaacttcacggacgcggcgctggcccttaacatcaccctgctcagcgctgtggtggatctggtgtctttctctggcatcctttactccatttatccacccctcttcctggcgctcctgacctactcgggtgaggtcgcacaattccgtgcccttgaggtgtgggcatggccgtgaggactgataggatgggcggtgagaagcgagaacggtgagagaggcctcgccccacctgaactgcaccggtgtttcccgcctcttcatcatgcctcttgtatccctggcgcagtgggagggacgggcctgtcctacctgatcgggaagcggctggtgggnnnnnnnnnnnnnnnnnnnnnnnnnnnnnnnnnnnnnnnnnnnnnnnnnnnnnnnnnnnnnnnnggcagatttcaggtgcttgggctggcagttgtgcacgactatagtttgaaagtttgcaggaggatcacagataagagggcacgaccttggcaatatgtcgcatgcagcttacaagttgcagaccacaccagacgcatgatgcctgaaacttgatgtcatccaattcctggcccccatttcctccatcccaggtacggcctggtgagggtgcgggagaatgcggagagcatcgcgttctatggtggcgaggagagcgagagtcggctgcttgggaaccgcctgtcgggcgccatctccaatctgctggagctgctgaaggcgagcaggaacctggccttttttacctccttctaccggtgggtgggtgacatgcatttgcactgggaatggaaggagcaagagccttgcgccacgagggatcacggggcagggcccctcnnnnnnnnnncacctccttctaccggtgggtgggcgacatgcatttgcactgggaatggaaagagcaagagccttgggccacgagggatcacggggcagggcccctcctgcgggtagcttttgcatggatcaaccatcagccaggtctgcagttcctgaggcactcaaagccttccctgccaacggaatgcagattcttgatccagctgctgccggcagcggtaattgcgcccctttacttcaaaggagacattgagtttggtgtgatcaaccagtccacctcaggtgcgaggtctgcgcaggggtcatggtcgttgtctcagcttggagttttgttccccccacgcttcacactgttgctggccgcacatataaacgtttcccttcctttaggtcagctcccttccactctttcctcccagccttcaaccacatcctgggcgacgtgtccttggtggtctaccagtttgagtccctggccggcttctccgccatcatcgaccgcttggggcaattcagggagatcctggaggatgatggaggaactgcagcttcactttcctctggtaaggaagcgccagccctggacaaagggaacgacagccccggcacggcaaagttgaccaatggggtcgctactatctcagtggtcgagacggatgtggggaacacaggtgaaactaggcatgtggaggctgtgacttttttatctgcacctgggtgcagggcatacttcccagaatctgctgcctatactgtgtgatgtgtataatgctctggtctccaggcccccaaactcnnnnnnnnnncactaggcatgtggaggctgtgacttttcgatctgcacctgggtgcagggcatccttcccagaatctgctgcctattttgtgtgatgtgtgtaatgctctggtctccaggcccccaaactcacaatctccctccttcctaactcatatcagggggtgacacgctgctcacggtccaagatctgaccctcatcgtccccggcggtaccagcagcaaccccctcctcatcagcgccctggatctgaccgtcaggcgcaggtcctccgtcctcatcatgggtccttcgggggccggcaagaccagcctgctgagggccgtggcgggcctctggcgcagcggcagcggcaccatctgctgcccagcccgggggtcaggcctgttctttgtgccacagcggccctacatggtactgggcaccctgcgcgagcagctcctctacccgacctggaccaccgtggtcagtggccccggggtcagcggcgccgccgagtttactgtggtgggtacggggcgccacaatgggaagccgcagctcccgctgcccgacgacggccacctggtcgccgcgctgcagcgnnnnnnnnnntggggtcaacggcgccgccgagtttactgtggagggtacggggcgccaaaatgggaagccgcagctcccgctgcccagcgacggccacctggtcgccgcgctgcagcgcgcccagctgcagggcctgctggaaagggtggcgggcgacctggactgccaggccgattgggccgccatgctctcactgggcgagcagcagcgcctggctttcgccaggctgctcctcgccaggtccgtgggtgcggagatgactctgcgcaacgacccctgacgcctgcatggtgccttgttgtgaggtgatatcgaaggatgcaagccgctcaatcaccccgctttttgtcaccccgaccccactgcaggccggacctggtcctgatggatgagtcgacctcagcgctggacaccgagaacgagagcaggctgtaccaggccctgcgagaccagggtgggttgcttgtgggctcgtgtgtgctggtaaaaaagggtggttgaaagcacaccgagggtcctcctgcgctgctcagtagcatggcacgcgagggggtccctttcaatgattggcaaatgccaagcttgcatgacactcgannnnnnnnnntctggtaaaaagggtggctgaaagcatgccgagagtcctcctgcgctgctcagcagcatggcacgcgaggggggtccttttaacgactggcaaatgccaagcttgcatgacactcgaccaccccaaaacctcctttcccctgcgcgcatcccaggcatcacgtatgtgagcgtgggccaccgacccaccctggtgcggtaccatgaagaggtactgcagctgcatggcggcggggcctggaccctgcacgccgcctccgaggccaagctggacctcctcggcgcattttgaggacgtggcactttgcgcgctgtgcatgcatgaagtgtcctgaatgcggctctcggtgacttgatcatatccagatacccgtcgcccacttcctctgccccctccataccttcttctgtccctcttgctgttgtaccacaccaggagtagtgcaatgacaaaaggaacattcagtctgcaggcagtgcctgggcctgggtcaggtgtgacccactggccccaagctccagtcgtcggactggaagcggccgtgccccaccacccggatcctgtcctcgaacacttcgatgatgccgtggcagtcgttgcccggcggcgtctccaggatggcagcgcacacccgatgatggatgcccgcagagtccctgcagtacccgtctcggtgtgtgtggcccgccagggtcgccacgacggtgcccgggaaggcctgcagtacctgaagatggtgggaggtgcaaggggggccctggttgttggggagctgaaggtaatggatcttgaaacacgggctcaaatgcaatgttcccgttgaggacagtgcacctcactagagaaaacccttgctgccacaaccccggccagccccgccgacccctgtagggtgctgccaccccctgcatggctaggctctcatgtgcacagacccttgatccctactcctgctcgccagcctacctccaacacctgctcgtagttccannnnnnnnnngtaggctctcatgtgcacagacccttgacccctattcctgctcgccggcctacctccaacacctgctcgtagttccagagcaggcacacaggcgggcaggtgtcagggtgcatgggcaggtggcaggccaccacgacacggtcgcccgctgcgcgcgcttcgcccagctggctgcgcatccacgccagctgggcgtccgacaacccgccgccaaacttcacgaagcgccgctccatgccctccagaccgtcggggctgttcttctcctggtgaggattggggaaatgggggaggctggttggaatgggctctgaaggtgctcacgcctttcagtgatgcttcacgccactccatgtagcgactgctgttgtggcatcgtgggccgccccacacgctccctgcaccgccgtgcagcccagcggcagctagaccaagatccggtgacggctgacgagacgtcctacgtactccaagccacacaggcctcaccttgttggggttccgggcctgcagtgtttcctcagccagctcatgcagcgggtgccccggctcccagcccagcaagctcacgtcatagccatccaggacgagcacccgccacccggccagtggctggacggcatagtaactgtgctgctgcccaccctggagctcgctgatgcctggttgggtggtcgaggggtgtgtcaaggggctgatcgatcggtgctcctaggtccacagcggccctgcccgggcgctgcacgttgcttgaacagttcgacattccagtcccccaaaacctctgcagcgcccctcacccagacgctggttgagcaccgggcggctgtggcagtacaggcagtgattgcctagcatgtggtagaccggcgcctccagccgagtaaagatgtccaggacgtcctgcagcgcagagtctggtctggaccgcaccgcgctcgcctccgcgggggtcactgagttgtgaaagtccacaatctgtcagggagagggtgcaagggggatgagtcatgctgagtgggaccccacctggatgccctgcctggccatcccaatctaaactccagtgcagttcaatgaaatatccttgcaatccccacctacatctccaaggtgcatggcaaagttgacgtgggcctccttgaagtcgtccacagcgcgttgcaggagctgcaatgctccacggtagtagcgcgggacgccatggaaggaactcccatcgggtatgtcggcgtgctggacgtcggccacgacgccaaagcggaagagggggagggactgcatgcttgccaagccacgaggagcagaggggtgcacgactgccgctcgaatgaggctcatggggtggtagattctcagcgctagcagatgtcacgagttgtagcctgatagtggccgagaatgtgggaatttattccacaaaccattcggttctgttattcgaaaggagtgtgaggtgggaacttctcgccgcgtcactgcgtcacgggttcctatacaatagaggaagattcaacatatttaaacaatcaaatttgacaactacatgaaaggagcacttcctgaatttctgcttcgagtactggggcaccgaggttttgtggctcgatgggcattgccccaaatccgcgcgcgcccagatctcggagatgcactacttcgcagcgacgctggtcaattactgccgcggaatctgtacgcccaagactggnnnnnnnnnntacgatgggcatcgccccaaatccgcgcgcccagatctcggagacgtactacttcgcagcgacgctggcaaattgctgccgcggaatctgtacgcccaagactgggatgtctgaaacatcttgcagggtgtccaggttgtactgaacgacctgcacgggtcaggggtgctgggggttgtcggtctcgatcacccaccccatgtcgtcccggactcggcccccttccatcctgccaaccaggagctttgcatccgatgggggactcactccacaggcactgcgatccgacgctagtaaggcggctgcacaccttcgacgctcctccctcagcggcacggatgggcaggatggggggttccctccctgggccctggcgtctgacatgttcagggcgcggtactactccgtgctggcacacacggagggagactggcggcccctcaagggtatccacctggccctagatgggggtgcatgccctttgccaggcccccgcagggccgcgaaggacaaggacgcgtcagacctgtccgcagatgccgccagtctggcggcggggacggatgcctggcacggcgggccgaggatgggggacagcagcctgcgaggacctgcccgcgcccccaggtgggcgtgaaaggatggtgcatgaggtgtgcgggggtggtcacgatgagtgtgagccgggatggatctttgcatccctgttcccgtggccctccttgcgacagcccctgatcccaaggcctcacttttttgacataggccgcaactgctgttccagtacaagccgtacgcacaacaggattccctggacgtgggcgcccccgcagtggcggcggtggtggaggcggtcttcggcgccgggcttgcggggtcagcggcacgggcatttgaggtacgcttccggttgctggactatttgtccaaggagcagggaatgtgggagcaggtccagcctggcgttgagtcaagtggccaggcagggtcctccgctccattggctgagccgaggtggcaagcaaaggcctcctactgatctcaggcgcccaaagcnnnnnnnnnngggtgtgcagaggtggtcacgatgagtttgagccgggatggatctttgcatccctgttnnnnnnnnnnatgggagcaggtccagcctggtgttgagtcaagtggccaggcagggccctccgctccattggctgggccgaggtggcaagcaagggcctcctactgatctcaggcgcccaaagcctggcccacatgcaatggtccacacgagagaagcagaccccagcgatcctgccctacacagactccatccggcctcccacttcccactggacctccttcggtctcctctcctacagctcattcacacccctccccaatccaccccccagacgctgcccagcgagtccctgtgggactccgcggacggggcggccgcctttggcgtgtctgccggcgccagcacgggcgaggtctcggccatcatcctgctcaagctggtgatggacaactacctgaaggcgggcgggcgcggcgcgtacgcgcccaccctcctgctgctccagcgcgcgctttcttctgggcggcctgctgcgcaggcccgcgtctttgacctcctctacaacctctccctgcacggcgagctgctctatctgtccccagccgcggaggtgcccgagacggcggccgccatccgccagagcggtgcggatcgggcggggctggcaggctggaggggagggggagggggatttccatcaacaccagcagactgggattggtgtctgttttgccgacggcgctggcttgcggacctcccgtttcagcagcgccgccctgcgccgctgcagcacagcccgtcttgtggcctgtgcgctgcctgattcaccgttttcacaatgtacgccgtttctgccctcaaatgcgcctccaaatcaactcgccgtccacnnnnnnnnnnctcaccgttttcatgatgtgcgtcgtttctgccctccaatgcgcctccaaatcaactcgccgtccaccagtgtccgaggcggacggggagggcggggacctggactggcgccgcaccgtcacccgcgccttccgctcaaccctggccgcgtcggcgacgcccacgggcccggcggcggcgcgggaggcacccttcacgggcccccacgcccggcagcgccgcagcggccacgccggcgccggcgtggagggcctggagcggaacagcagcggcaagctggaggcggactggcccgtctgtcccggaccgaagcccacccaggcaggccgggccggctgggcggtgatggggcgagggatcgagcattcttcatgcatgcgctgccgttccggcgccgtcggcgtctctccagcggaggtgtcaccctgctgacctatccgctggcnnnnnnnnnnaccggcgccgtcggcttctctcaagcgaaggtgtcaccctgctgacctatccgctggcatgtggcgtgtctgatgccctgccactcccctcttgaccctgacccacacaacccccctccgtctcttggcccccactccccccatgcagggnnnnnnnnnnaccctgccactcccctcttaaccctgacccccacaacccccctccttctcttggcccccactccccccatgcagggcggcgacgcacgcaccgacaccttccaccactggctgcgcctgctcctcttccgcctgctgacgcggctggcctccctggagggcgcgccggacgcggtgtggacctccgcgctgtgcacgctggcccacctgaccacgcaccgcggccgcaccgtgcgtgcctacgtggaggacctgccactgtgcgcgctcggcgcgctgctggaccacgcgcgggatggggcctgggcgcccgccatccgcgactggctgctcacgctggcctgcaacctgctctacgtccggggcgagggcgggcggggcgcagggtcgcgctccctgaaatcgccgtcggcgacggagtccctgcgcagctccagtgagggtttttttttcgattgggggagtgggggggtggggggcgcaatggtaggaaggacgaggcctttggtgacgacgcgtttcaagctacctgcggtgaggatgctgcatgcagacgcgcagtaaggcggaaacagttctttgaaaacaatggtgaacacatcaatgccgctggtcatgcatggcggcnnnnnnnnnnagacgaggcctgtggtgacgacgcgtttcaagccacctgcggtgaggatgctgcatgcagacgtgtagtaaggcggaagcatttctttaaaccaaatgtgaatacatcaatgccgctggtcatgcatggcggcaatgcccgaccaggcctccccggtcacctgagctcccccccccttcccattccctccctccagccaacctgcggcgcagcgctgcggcagccgggagtgagacctggtgggccaacgcgcatctggatgtggaccgacttcaggagtttgggggcatgcgccaggtgggtgggggtggctgggtgggtcagtgtggaggagcgtgtcggcccagcatgctgcggctgggtggtgaagcaggccacgcctcaggtgtgacatgtccagactcgtccacacgggcccgtcacaactcctcctgactcaccgctgccatgcaccgcatacatacctccacgcagctgctgcgatgctacnnnnnnnnnngcaggagtttggggggatgcgccaggtgggtgggtgggggtggctgggtgggtcggtgtggagcagcgtgtcggcccagcattctgcggctgggtgttgaagcaggccacgccccaggtgtgacatgtccagactcgtccacacaggcccgtcgcaactcctcccgactcaccgctgccatgcaccgcatgcatacctccacgcagctgctgcgatgctaccgggaggcgccgacgtccagagctcgcagcaatgtcttctgcgtcatgtatgactacatcacctcctcgcaggtgggccaggtcctgggctgtgttggataccagcacgggctaaacctctttggtttcatctgggggcctgaagggtcgagtatgtgcaccagccgcccatcgctccatcgagctgccagcctgacaacccccctttcaatcacctccacccatctgcatcccttcttgcaccaccacccccatctttacccccagggccccaacgagtacgacagctggtcccccgccctggcccagggggcgcactcctccgaggtggtggcgctgggcgcggccctgctgcacctgcgcgccgccgacgcgctgcaccccatgttcctggcgggcacgccggggtacgttcccggcgtggccgacgagctgaccactcagatggcggcggtgcaggtgatgctggtgatgctggtggctttgatggtggggtgttgggtgggagtttgagtgggacttggggcagcctgacgattgccggccagcacaaagtcgattcttcctcgccaacgacagcctctcccggcatcaannnnnnnnnngccattgagctgccagcctgacaacccccctttcaaccacatccacacgcttgcatcccttcttccatcaccacccccatctttgccacctctttaccccccagggccccaacgagtacgacagctgnnnnnnnnnntttggggcagcctgacgattgcaggccagcacagagtcaattgttactcgccaacgacagcctctcccggcatcaagccatcccctcacccgcccctctcggtccacgatccccctacacccgcaccctccaacaggccaagaaccccgggagggtgattgctgtgccgcccgcctttgtgagcgaggtgctggactgcctagaggatatcgcgtgcaatgccatccgggtgccgcgctcgctggaggagagcgtgaagtacagcctggaggtggtggccggccccgacgtggacacagcaggtgctgcttttctgtgttacagaggggggtcgtacgggaagaggagcgtggagggtgttaggaccgaggggggcgggggttggaatgtatgactggccctgcgctcatgcgcgcaatgcaccaggttgcgggcgtttcgtcgctgcccctgcgtcctccccaccatgaagcgctgtgcatgcccccctcatcccctccgaccctccctccggcctgggccttcaacctcccaggccgtggggacgaggcgctggtctgggacacgctggtcgactgcctgagggaccagagcgagctgggcgcgcacatcggccgcggctggctgctcaagctgctgttggccagcgccgagcaggagctgcagcggtgagcgcgggatgggcccggaaagggctctcatgggtgggccgtggggtgatcgaagaaagccaccggtggtatccagggtggtgtcgggcggggctggatgggggttaccatcgttttggcctcaccatccggnnnnnnnnnncttcgcccccctttccacccaaccccgcggcgacaggtgccccgccaacgccnnnnnnnnnnggtcccccaatgccttaaaaacctcccgcgggaggcatcgcccacctcaccgccggtccatgcaccggccannnnnnnnnntcacccaatctcttgaaaccctcctgcggggggcatcagccacctcaccgccggtccatgcaccggccaagcagccatcactctcgccttctttccacccacccccgcggcgacaggtgccccgccaacgccctgccggcgctgctgccggaggtgggcccccacggctgccagctggcgccaggtcagcgcggcatcgcctcccaggatcgcctgcgcgacttgctggaaagggcgctggccactacgggcgactcccgcgccgccgacgcgttcatggacgccgtccaggtctggtcgtcgggcgggctggggtggaactcgtggactgagggtggcagggcgcgacggatgatggtgtagggcccacagggtggcgcaggggtcgtagcgtgagggatgctcgtgcagcgggctgcctggactggcgaggtcgacacacagccagatcagacgcagcggagccaggtgtcgtgccacgccacactgacacctgtgctggagtacagaactcttactcacatcatgccgcacagggcatgctggcacacatccggctcnnnnnnnnnnccgtgccacgccacactgacatctgtgctggagtgcagaactcttactcacatcatgctgcacagggcatgctggcacacatccggctcaagtcgctgcgccgctcgtgggaggctgacccggtggtgagtgggggtatgtgggaatgcgagccatcccccgcttccctgacccggcttctgagagtgatggcaagcgctcaaacccccttgagggcaagcagaacgtagctgacccctggcaatccccgccgccgtgcaggccgccccnnnnnnnnnntcaccttgagggccagcaggacgtagctgacccccggcaatccccgccgccgtgcaggccgcccccgcgcccgccgtgcccgacaccgccagctccacctcgggcctggtcagtgccatgcgccgcgccggcctgtccgagggcgagtcggaggtggaaagcgtgagcgagatgagtagcgcgctgtcgcgcagcgcctctcccctcccgcgcctggggcagggcccggggtcgtacgactcgatgccctcctccctgagcagccaggtggacggcggcatgcccagcaccgagcccgccgagtcctggcaggcgagcgtcggtcgtggggtggtgtggggaagggaaattatgtagggaggggagatggagcaggtagaaagggagctttgtgggcacattgtctgtggcaggctgtgcatgggnnnnnnnnnntctatgtaagagaggggagatggagcaggtaaaaagggagctttgtgagcgcatttgtctgtggcaggctgtgcatgggtgctccgtagcgagctcacaacccacaagtgagcctgtcgcatgcatgaagtcatctcccaccccctcctctaaaaatcaaaaacacctactgcaggcggtgaacgcgccagcggtcctgctgtccacgctgtgcctggcggtagagtggctgctgcaggccccgcaggaggcgcgccagggggccatgctccaggccacccagctcctgctttccttcatcgtggtcacccccggtgcgggggaggaagcacggggcgacgcctcgcccagctcccgcccgcgccggcgctctacggccggctgggccctgggcccgttgggcgaggaagcggcgggcgagggcagcgtgggcgaggccggggcgggggaggacgggcacggcgacggcggggcgggggagggcggcgatcacaccggccgtgcaccgatccccgccccggaggccagccagggct

SEQ ID NO: 35461 - DNA, 85 bp, Chlorella protothecoides
gccgtcagcctgccactcatggtgttcgactgcacaggcgcaggggcacgcatgttttcccagcttgacaggcttcagagccaaa

SEQ ID NO: 35462 - DNA, 71 bp, Chlorella protothecoides
ccagcctctctgtctgcgtgcgcggtttcaatgcatatgccaccgaggacatctgctgcagtgccagtggc

SEQ ID NO: 35463 - DNA, 133 bp, Chlorella protothecoides
cgtggacttgaagtacgcatcagtgaaagcggcggtatccacgccggagacgtccaccttggtggaggtggcaatgacgtaggcctggttcacacggcgagcgggcacgccgttgacgcggaaagggccggtg

SEQ ID NO: 35464 - DNA, 77 bp, Chlorella protothecoides
cagggcgcatccgtcccaccatgccaatgggccctcccgtccacgttccagccagctccagacgtcgtccgccttgc

SEQ ID NO: 35465 - DNA, 93 bp, Chlorella protothecoides
ttcgaatgccatttctttctgctagaaaaaagagaagagtcaactgcagcctgttggctgctagccagcttgaaaaagtcgccagtagcgccc

SEQ ID NO: 35466 - DNA, 61 bp, Chlorella protothecoides
ctccaggctgcacgaggcggggaaggtgctgtccctggagctgcgcgccagctgcgcgccg

SEQ ID NO: 35467 - DNA, 104 bp, Chlorella protothecoides
gctctgctgcattgtggctggtattgtggcccgagcggctgcgcctcctaacagtcctgtactggaacagcccagatgcgcagctgaattccctcccacaacac

SEQ ID NO: 35468 - DNA, 118 bp, Chlorella protothecoides
ccgctgtcattccttggaccggcacgatgactcccgtcctgaggagggtggtggagtacggtatcccatgatttcactgatccgtgtaatgagcctaccactacagggcccggtcacc

SEQ ID NO: 35469 - DNA, 78 bp, Chlorella protothecoides
gagctggacacggatcggacgggcgctaggcgggggtctggtgcctgaggaagtttgtgggtgtggaggggagggcag

SEQ ID NO: 35470 - DNA, 73 bp, Chlorella protothecoides
ggtggctgtcgctaggtcccccgccgcctcatggataaagaggcggatgtactccatgtcgggcggctggagg

SEQ ID NO: 35471 - DNA, 75 bp, Chlorella protothecoides
catgccacgcctcacgcacctttatcacttcttccccattcagagaaacaacgaggtgtcggaccagtgggttga

SEQ ID NO: 35472 - DNA, 73 bp, Chlorella protothecoides
ccctgacaccccccactccttcccatgacccgcagtcctcggcggctcaccaggcacgaggccagtccgtcct

SEQ ID NO: 35473 - DNA, 13583 bp, Chlorella protothecoides
  modified_base (2239)..(2248): a, c, t, g, unknown or other
  modified_base (2524)..(2533): a, c, t, g, unknown or other
  modified_base (3643)..(3652): a, c, t, g, unknown or other
  modified_base (4725)..(4734): a, c, t, g, unknown or other
  modified_base (10527)..(10743): a, c, t, g, unknown or other
  modified_base (11488)..(11497): a, c, t, g, unknown or other
  modified_base (12225)..(12234): a, c, t, g, unknown or other
  modified_base (13084)..(13093): a, c, t, g, unknown or other
atggcgggagttgggggtgggggggaggggcatggatggtgtgtgtctggcggccgcaagaccgtcgtgtgcgcccaggccttgctgcagccgagacttgggggagtgacatggcgacccgaggggccctgaacgtccgtcatggggccgccgggatggtgtctggatgtgcgtggatggtgtcaaaggtgcaccggcagccgaaacgatcctgccagtgggtacacaagctgcgatgcacacccctctccagtgccgcacccacaggcatccggaaggcatcgccgcgcaagacgccactgcagagggagcgggaagccgccgcaaagctggcaggtcagattgggggtggtctgttggagatgcgttgttgcctatttcagtgagctgaatgataaaaaaatccccccataaacccctgtccgcgcagccaaagcggcagcgcgtgccgccaaggcctaggacgtggagctcagccaagccagtactgcaccacccggatgggggccccggcgtcaggttccattgttgacttgctcgaatacacagagaaggttcaccccagatttttcctgcttctactggaatccattctacgattgcgtagggctcatgctgatgggtcacggttgggggagtgggccgggcgtacagaaaggtaccattctatggcgcgcacgagagcattttgtcgggcgccgatacttagggcaaacgcaacctacggcatggccacagcgcgagacctacctgtaaaggctatcaccattccctgtatcatttataaccgtgctgcgagactcgggggccttccagggcttgccaattgtgtgaccggagaaaccctaccgactcttcggcaggtgcacaacatggtctgtgagccggccccatacccgcttctcgactcattcatatgaatggcatgtaatttcatgcaattcaaagttcctgctcctcccctgcgacgtcgatcccacccatttccgggcaaaccctgcgcaggcacccggcggaaactgacaccatggcgtgctgcggactggacgttggggccatgttggcaagcctcaccaccaggcggaacccaaagaagcccaaaaccactcccgagggtgcgggggccaggaggcgagcaaccctgtctgggtcctgtagggtttgcatgcccgcgtgcatctagccctcgtgccgggtcacctgtggacgtgcccgggactgccggctcacagtatacctctcccccctcccgccaggcaaccccctgcccaaggaggtgcaccagatgatcccggccaaggccacagctgggcggcgggtggtcatcatcggcgacgtgcatggctgcctggaggatctgcacctcctgctggagaatgtggccgagcccaatgacctcatcatatgcacgggagacatcaccggcaagggccccgacgtgctcgacgtgagtgccgtgctgcggggcctgagccctttggctgagtcgggctgatgtcaccgcatgagtccatccaccggtctgggggttgcaatcccgtgcctgcttgggtgcttctggccaccactcccagccacatccatgatttccctgccatctccagccatccatgatgtcccccccctcccgtcccttgaataataaatactcgcagacgctgaagacggtgcacgagatgggcatcctgtcggtgcgtggaaaccacgacgaccgcgcagcggggtactggcaccgctggagcctgcacggggagaacccctccgaccccgagttcgactgggtcaaggacctggagccggcggtgggcgacttcctcctcaacctgcccttcaccatcagcctggaggcctacaacgtgctggtggtgcacggcggcttgctccccggcgtgcccctggcctgccaggacctggcggtcatgtacaccatccgcttcgtggtccccgcccgcccgccccccttcggctccttctcctgggcgctggagcggcgcatgctggccgaggcggtgcgcagcgggcgcatcaccgtgccgccggcgtaccagctggaggcgcgcgagcggcccgactggaaggagggccggccctggggcgggcagtggcaggggccgcagcacgtcatcttcggccacgccagcagcaggtgtctggttggagttgggggggtggggaggggtgttgtcgccgcatggggtgaggtgcgtcgccgtcactgcgcactggacctgggtggggnnnnnnnnnncttggttggaggtggggggggtggggaggggtgttgtcgctgcatggggcgaggtgcgttgccgtcactgcgcactggacctgggtggggcgcgctcggggtgtccttggggggcacgggaggggcaaacttgcgcatggcacctcgcgccagggggcctcgcgactacctcaccccgtgcacacgcctctggcctacaccctccaaaaccaaccctcccctccccccccgcaccccaccccggcacaggatgctgcagctggagccgtttgccannnnnnnnnngcacgggaggggcaaactcgcgcatggcacctcgcgccagggggccttgcgaatacctcaccccgtgcgcacgcctctggcccacaccctctgaaaccaaccctcccctccccccggcaccccacaccggtacaggatgctgcagctggagccgtttgccaccgggatcgacacggggtgtgtgggcggcggctacctctccgcctgcatcctgccggcgctgacgcgggagggcgagatcgtgcccgacacgcatgccctgccgcccttcctgtaccagcagaccatccgcctgcaggacggagagggcctgagtgcgcgcgtgtgcatgcagccctccctgcagccagggttccacgccggcaaggatgcaaagggccagctggagtgagctgggcgagacggcagccccgcagcgccttcccggcagattgaaactttgtacttgcacactgaacttgcccttgctacacaccttctactggcgtacacctgcgatgttcctagcgcccaccttgcacggcctggtcttccctcctagtaaaccccttcctggctgaagaggggctcctccctgcgcctgttttgtcccatgtcatagcaatgtgcaatatatgatccgctgatgatcatcttgcctagaatgtgtgggacatgcccgacgattcgagtgcaccatggtttggttaccgccaggttgggtactgcgctggttcgagtccgggacacccagactctggtagcccggcatctgatcaggaggggttccaagctcagcgttcgcggcactccaacccagtgagcaagctcagcgcgatcacctctctcaacgctgatcgctccgcccgacgtgctgggcgttgctaagatctcctgcccctccgccctgcaccgcctggccagcagcacggcacgatggtggtgctggcagcaggaatcgtcaccaaatcgggcaaaggtagttagggcttcatgctgcgggggtgccctcccctgcaacccgggccggacccttcgtggtcgccgtgttgtccaatgcagacctccccgaagattgttacccaagaccccgttcctcacccctccaaccatgccttcccgcagccctgnnnnnnnnnncccaatgcagacctccccgaaagattgttacctaagaccccgttcctctcccctccaaccatgccttcccgcagccctggtgtcccgtcagttcctggacatgacccgcatcaggatagagggcctgctggccgctttccccaagctggtggggcagggcaagcagcacacctacgtggagaccgagaatgtgcggtacctgtaccagcccctggagtccatgtacctggtactggtcaccaacaaggcctccaacatcctggaagacctggagacgctgcgcctctgcggcaaggtcgtccccgaatacgtgcacgggcttgaggaggaggcggtgtcggaggcggccttcaacctcatctttgcctttgacgagatcatcagcctggggtacaaggagaacgtgacggtggggcaggtggtgcagaacacggagatggagagccatgaggagaagctgcacaagatgatcatcgccagcaagatcgctgagacgcgggagacaatgcagcgcaaggcgggggagatcgagaagaagaagatggaggcgggccgtggctcggcgcgggggaggccgggcgaagggccgcctgcctacccctccgcccccgccgcgtccggggccggtgggtttggcgagtcccgccccgccctgccgcggcccggccttggaggtagccgcggtgaggctggtctcggcgcctcccgccccaagaagggcatgcaggtgtggatgtggggcggtgaaccctttttctgggggtgggcggggcgtaaacaggtgggctaccagaagggatctgatggagagaagatgtgtatgtcggcagggggagagtcaaaacctctttgcttgcagcacctgcaccagccctgctcacccactccctggcctcagctgggcaagggcggccaggccaaggacctgctggcgagtctgaaggcggagggcgaggcggtggaggacgcaccctccgcccatgcacccccctctctggcaggtgggacgacctgcgagagggtgggggtgggggtgctccaaccaggcctgcaagggtcactgcctgagcccnnnnnnnnnntgcaccctccgcccatgcaccgccctcgctggcaggtgggacgacctgcgagagggcgggggtgggggtgctccacccaggcctgcaagggtcactgcctgagcccctggcaggagcgtgtgtgtctgggtgccaggccgccgtcgccttgcaagggtgtggtcttccgctggggtcgcccagaacccccacccaccccctcgctcccctcattgcacacacaggcccaagggtgggtgcgaccgccagcgaccccgtcttcgtctcggtggaggagacgctgtcggtggtgctgtccaaggacggcggtatgcagagcctggaggtccagggctccatgagcctgcaggtgggcgagggcgccgacgcccgcctgcgcctggccctcaccggcgacgccgcgcagcagggcttccagttcaagacgcaccccaacatcgacaaggggttgtacgcgtcccagaacgtgctgggcctgcgcgacgccgcgcgccccttccccatcggcgcccccctgggcgtgctcaagtggcgcttccagaccgacgacgaggcagccgcgcccctcagcatcaactgctggccctccgtgtcgggtgggtgggtgtgaaagagggtgaggagtccctgtgaagggaagggggggggggttggagggacgacgcacggtctgcgtcgaggcctttgcagcgtgtcgggcgcaggttcgtgcgacgctcgggcccgtgtgccgggcctggccgcgagcggcgcgtcgagtttccactgtcctgcttttccagcacaactcgcgtgtccccaacaaccccttccctgggtcacctcaggcggcgagtcgtacgtcgacatcgagtatcagagccaggtgccctttgatctgcacggcgtacagatctccatcccagtgcccgccggcggcgcgccccaggtcaaccagctggacggcgactggcggtacgacgcgcgcaaggggcacctggtctggagcatcgagctgatcgatgccagcaacgcggcgggggccctggagtttgtcgtacccgccgcagacccctcggccttcttccccgtggaggtgagggaaggcgacgaggatgtgtgcctgaacaccccggtggagggcgagggcttgtatggattatgacgatccgtcccacatcacccccgcccccctctccaatccctcccacactctcaaatatatctccaggtgtccttcacggccaacaagaccatgtgcgacatcgggatcgctgaggtgacggcagtggagggggacgcccccgtcaagtttggcacgaggtccctcctcaccaccgacgagtacgtcatagaatgaaaggcttctgttcggcccgctgccatgaccacgatcccccccatcctgtgaaaatcttgccaaggcaagactgtgaaaacctggtattggttcgtggtgacgcttgtgcgaccgcgggggagactctcacgaggcaggatgatccgtggcaagtgcttacgataatgaaatgcagtctgcggcgccgctgcgctctgccatggtgcagtcgcaacattggcgctctcggagcccgatggagtcgtgtaggggaattcgcgcgcccagggcctggtaccaggagtgccatgagccaacccccgcgtgaaggttcccgcaacaagaaagttaagaggcaagttcatcgttactttctagcacacggcgtcgcagactaccctgctcaccagggagattggactccctggaccatcgttccgctgtgttgcccccaatcgacccagggccctctgccgccaacgcagtaagtcctcttcacccagcgccgggccagtctcgccctctgaggctgtgcctgcacatcctacatacacctatcgccatggcagccgcccgccccctggtggcggtgcagggcctcgatggcaaggccaccgagcaggtgggaccccactcgcggcgccgggatggccggctggcggggtgcgcgagggccccctgccacgctctgctcacccccactcaccccttttatttcgcagatcgccctgcccgaggtcttcctggcccccatccgctccgacatcgtgcagaccgtgcacactggactggcgaagaacaagcgtcaggcctacgctgtgtccagcaaggccggccaccagaccgccgctgagtcctggggaaccggtcgtgccgtgtcccgtatcccgcgtgtgcccggtggcggtacccaccgcgcaggtgcgtaatggagggcatcccgggtaggggcttggggcgggggccgctcgagtcgcgacccggcacgggcctgcggagctgcaaagtgtgttattggcgacagtactgggcgccgctcgcgtgcgccgcgccgctcatgccggaggcggcaataccgagcccttgccaacatggaaagcatctcagcgtgcctggggacagcaggcctgcatttgtttgccatgcccgctgtgctggagagcacaccagcagcaggctcttcctccgcatgggccctgaccgccgccttcctctccctccctccccgcccccaacaggccaggctgcctttggcaacatggtccgcggcgggcacatgtactcccccaccaagacctggcgccgctggcaccgcaaggtggcggtgaaccagaagcggtacgcggtggtgtcggccctggccgcctccgcgctgcccgcgctggtcctcgcccgcgggcaccgcgtggagaacgtgcccgaggtccccctggtggtctccaacgcggctgagtcgctgaccaagaccaagcaggccctggccctgctggcgtcggtgggcgcgctggaggacgtgaagaaggtggaggcgtcgcgcaacctgcgccgcggcaagggcaagatgaggaaccggcggtacgtgtcgcgcaagggccccctggtggtctacgccaacgactcgggcatcacccgcgccttccgcaacatccccggcgtggaggtggcctgcgtggaccggctgaacctgcttcagctggcccccggcggtcacctgggccggttcatcgtctggacgcaggccgcctttgcgcgcctggacgccgtgttcggcaccacctccactgccagcgagcagaagaaggggtaccgcctgccgcgccacgtgatgaccaacggcgacctggcgcgcctgatcaactccgacgaggtgcagagcgtggtggccccggccaagcccgccggcaagcacgcgccgctgaagaagaacccgctgcgcaacctgggctccatgctgaagctgaacccctacgcggccgccgcgcggcgcgccgagttccgcgcctccgccaagaaggcgggcaagaaggcgcgcgccccgggcaccaaggacaccgccaaggccttctacggcaacatggtcaccgactccgactacatcggcgagcagtacgaggtgttctccgcctggctgggggcggagcagtgagctgggagcccagaggagcggcgagcggggggaggagttggagcggcgagacgcgtgccggcctgccctgccctgtaagcccatcaaagacgcgattcgtagcaagggagagggcagggcagggagcagagacgagggtgctctcgactgcatgtcaatggtgacgactggggatcatgaaagcgagcaacgcatctgagaacctgcaagaaggcacacgcaagagacccagacctgcagccggggctgctgacaggcccatccactttcatatggggggcaacaggcggaggggggaagggaaggtccacgtccgcaccaggatattgccgagacctccgcggatccatgcccagccgcctgcagggcgcgagctggcgggacagccacgccgtgtctggctgaattcgaattaggagcgagttgcgccgagctggacccagaagtttccgcctgtctgtctggccggaggccgtccgggtgcgttggctggcgggaggtcacaggtggctggcggggcccgaggctggtcgtacgagcggacggcgcgaggaaaggatagccaaaaactcagaacatgatctccctctccacgacttccagcacgccagaggcaatctcatacaataaaagttcttagaatgcgtagatctagcattgggtgaggtaccaggtcggcagagatcgtgagatcgccggcggctcggtctgccaggaagactgccgaaggcgagcgtctgtcagactgatggaaagagctcgccgcagcggaggggatgtagggatgaaagccgtcaggaactaccaggggaacctaaagttgaccgagtcggatacaaaaccccatattgcccctttctcccctcgtccttgcctaaatcaaccatccacccctccaacaagccatccacatcctgccctctgcccatcatggccaccgtcactccagcagttagactgctgctcaactgcctccttctcgcaactaccgcctatgcggcacgcaccttgcccggtggcctggcctcccgtcgcttgctccaatgtgcgccgggtttgtagttgaccaagttgccgccgtcgccgcgttctctgcctgccgccgcgtgacgccccgggaaccgaaccaagcgcggccttacccgataccctcgcagctcctcctctcaccccttccccatccctccacattgcagcgaccgagacctgccccgactccgcgaacctgttgagcctcgtgaatgccgctcgggccgcccacgggtgggtggttgcggggttctcgtctccaactgcccgtcgggggtatgaagtctcctgcttccccaattctcgcactgtgctcaatggacctgcacctatgcccaccgaaagcaaaccttgcaccccctcacagggctcctgccctgacctggagcgacaccatcgctgccgccgccgccgccgtcgcctccacctgcagcggcaaccacggcggcagcgggtatgggcagaatatcctggctgcctggggtcccatcacggacgggggctgctccatggccatgcagtactggtacaacaacgaggccggctcctacgactacgccaaccccagcttccaggccgactccgggcacttctcccagattgtgtggctgtccaccacccaaatgggctgcgccgtggcgcagtgcccagggtcctcctggtacgcgggccccaccgccggcaactggcacttcatcgtgtggtgagcacgtggggaggaggctggtgcgagcttgcttgctgcccagaacatctgtgacacatgatgggccgggtgtcgagggaacgaggtggtgtgccgccatcccaccatcagctctgccatacccagctggcatgccccttcgattccatgtctccctctgaaaccacccaccctctaccggtgcagcgactttgacccgtccggaaacgtggatggcgagtttgctgccaatgtcctgcctgagaccaccgtctcgccggtgggtgacgtccagagtccttgggcacatggcttggttgtatggttccagggccccgcaggaattgtagtccatggtagcccaccccctgcaatctgcagcatgcccgacccttcctgggtctgattgcacgctggtcgcgatggtagactgcttgcctgcgtgggttcgcaagccatcgcgcatctcgctgtgccaaagctcatccgtgtatcctctcttcatgcagccgccaagccccgtggtcgcctccccacctccacctagcccggtggcgtcgccgccccctcccagccccgaggatgcttcgccgccccctcccagccccgaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccttcacccagccctaaggctacctctcctgcttctcccagccctgaggagcctttccccagccctgaggagccatcccccagcccagtgacgacgtctccgttgtcaccaccccctgtcagcaatgaggagacttctagcgaggaggccttgggtctgacccaagccgaggctgctgcccgtctcaatgagttcacagatagcttgtccggttgagagtgcagcatagagggtgggtgatttcataattcgtcaacattgctgtttttccagtcttacgtttatgcatcacttctcccagctcaagctggcagaagctgcgagtctcatttatacacaccgtgctttgctatttcatccctcctcaatataatcctgtcgcccggttcctgcccatgctctggaccaggacgatacctccttccttgcactgtctattcttcattcttcttggagcgcatgttagcacacaacctttccagtatcatcggataagtaggccagggtggtgttggaacgcgggattgtggcggccatgcaactatcggctgggcctggatgggggaatcaacttcgaccccatcgccacccctgctgtgcgttaaacggaggcgctgcttcccattatgaaagcacaccggccaagctgcgtgtacacagggcatacaccacatttcgctgttcaatctccgatacattaacatggtttttgtgcaaggaaggcctccccaagcctccccannnnnnnnnntgctgttcaatctccgagacattaccatggttttggtgcaaggaaggcctccccaagcctccccatcgggggaaaggggccagtgcgcttagatttcctcctccactctgacccctatgtggacaggctgcgattggatggaggagaggcccactatgtcgaattcttgcaggaatcgcgttgcgatatcctgcggtccgctcggccttcattcgtctcagcgtggccggcatgcagcgctcaacctacccttcccaaagcacagcgcatgtgctgttgttactggccctgctgttcaccggaaggtcttttgtcgaagcccaaagggacctgctggccaactccatgcttggtgaggcctccgacacgacgtgggagggtcccggtctttgtaacccgcctggcaaggctgccgctcttgccgcgcccatgtccttcagggaagggcacagcgaccccttcaacaagttcatataccttcttcctgctgtagaggggggagcttgcacggatgctaagcagctgcttgctctccacaacaccgcgcgggcagcgcacgggtaagcgaaatccggaggttccggcgccagtaggggacgtccactctggatcgatgggtgtgcgcccagatgccaatgtatctgcacctgaacgtagtactagaatgcttgctcttgcaagaatctgtactattcttttcctatgacagctccaagcccctcgtttgnnnnnnnnnnttactggaatgcttgttcttgcaaaaatctgtactattctcttcctatgacagctccaagcccctcgtttggagtgcaacagttgcgcggtctgccactaagtgggccgagcgatgcatctggtcccactcccagtccgagtacggggagaacatcctcatgtcctgggtaggacgtccgcaggatctgccagctctaggcctggcttgcagcttgtcgtcgggcagacgcgccccagcactgcgcaactgatctgtgtttgcttttcccgacgagggaaaggctcgtccctgccggtgcctgtaatgtaccgtcggccctttcctcctctcatactccttcctctcctgcacagggaacatctacaacctgctctatagcaatggagtactggtacgacaatgagcgggatgattacagctatgcaaacccaggataccagcctgatgccggccacttttctcaaggtgtgggccagactctgacttttttgtgggaggcaggacccgcgcgtgtcttgaagcttgcttctgccgtttcttgatccgcctcataccagagaccccctagtctcccatctgtgtcctctgcctactctctgtcacagtcgtctggaaggcaaccagccagctggggtgcggcattgcagcatgcgatgcctccaccgcaccaccctcggtccgagggccctggacgatgatggtgtggtgagtccccgaatgatctgctgcgttgagacagagcgtgcggccagggagagtgttcctctgtgcaaatgggaatgttaatgagcccttgacttcatccccgccctcaatgcccctgcgcccctcctgcagccagtacaacnnnnnnnnnnttctgtgcaaatgggcatgttaacaagcccttgatttcatccccgccctcaatacccctgcgcccctcctgcagccagtacaacactcctggaaatgtgcaaggtgcgctgcaggtgtcagtgggcgctgctgttcggcatgtttgctgcgatgcagattgtggccgtccacgcttgagtgtccaggctatatctccaccgactcatgtccacggatgcatgcagggcaattcagagagaacgtgcaggccgagtcagactctgaccttcccactttttccccaacaaacccaccaccaccaccatcaccacaaagcaaacctacaccaagtcccaggcggtcgccacccccaagcaagaagttgctgcctccaagcaagaagtcgccgccgccaaaggctgttgtcagcagcccgaagcccagaattaaacctccgccaccacccaaggtgaagcgttcaccatacgtgtcgaaatttaaacgctcacc

SEQ ID NO: 35474 - DNA, 73 bp, Chlorella protothecoides
tcgcgcactgccaggcctcgccaccgggatgccaggaccccttgcgcactcaccttgttcaggaggttgagcg

SEQ ID NO: 35475 - DNA, 69 bp, Chlorella protothecoides
agctgtagagctacggctcctcttccctttggggggggctagtccgggagtatggcgccgaacgcctcg

SEQ ID NO: 35476 - DNA, 135 bp, Chlorella protothecoides
attcaaaacgtcctcggtcgcgaggagtgcatggagggctgtgggtgcgggggggcgggggggaggagagaggcagggggcggcacgcctgggtccagccgcccgcacgctgcaccccgggtcactccgcgctgg

SEQ ID NO: 35477 - DNA, 104 bp, Chlorella protothecoides
acaagaatcgtgagattaatttcattgtgagggaggcatacagcgagggtcacaatctgttgccagggacctctgagcctctcccaccagctgcaactggggtt

SEQ ID NO: 35478 - DNA, 4108 bp, Chlorella protothecoides
  modified_base (817)..(826): a, c, t, g, unknown or other
  modified_base (1274)..(1283): a, c, t, g, unknown or other
  modified_base (2122)..(2131): a, c, t, g, unknown or other
  modified_base (3111)..(3120): a, c, t, g, unknown or other
  modified_base (3278)..(3287): a, c, t, g, unknown or other
gagggcctcctactccaactgtgccagcgctgtgaggacactttgcagcacatgtacccacaacgtccaatgggtgcccccttggcagtatatggtatagggtggccggatcggcccatctgaggttgtaatggaggggatgggattgttaggatttttgagcaaatgtcagaatccatggactccgtgacctctgcacaggccgcctctctcatagtacatcatggcatcatgagaatgccccctggcatctcattcacaaggagaggcgcatgaccttcctgttcaagaacattgcaacccgcaaccctcgtgaccacactctccctcccagcccccacacctgcgcccagctcagacgtgctccctgccacaaaagtcccatctgcgaacaccacagggtcggcatacccaggggtcacgcccggggtgggggtcacatacgagcctatgggactggaggcctgcaccgcgctcgcaaaggcagccatggcatgcggggaacccagtctgatggcggtgatggcagaccagggccgacaagcacccgaggcgggggtcaccccatacccagccccctgcatgacggctgctgcgaggcgtccgcccttcagcgcctcgccggtcgtttggggggcggcatacaggcctgggccagcatggttgcgaagtgagggaagggggttgagtagaccccgcggcgacaagacgcctgacagttgcatgcctcacggagtttccaaaggtttcaacatgatttccacgcgcagccaggctagccgccgctggcaaaagccatgcaacccacatgcactannnnnnnnnnattccaaggtttcaacatggttttcacgcgcagccaggctagccgccgttggcaaaagccatgcaacccacatgcactacccagacccccagccaaggtaggcttgtagcgcgctttgcacctcctcccacccctcccaaagacccaccctgaaacatgaggcgcagggtctccccgttcacggcgcccgcctcgctcccgatgccaggcgccgtcagcctcgccagggcggcatccaccaggtggcgctttccggccacatagcccccgccaggtacgagcgtcccccccgggttcttgatgagcgaccccatgcagagatcggcccccacctgggaaaaagaaaatggaggttgggagctgaacacaccatgtgcacaatcgcctgtggaacagccggtggtacgctggcctgctatacagttccagcctccacgacccagacagnnnnnnnnnntccccccggattcttaatgagcgaccccatgcacagatcggcccccacctggggaaaaggagatggaggttgggagctgaacacaccatgtgcacaatggcctgtgaaacatccggtggtacgctggcctgccatacagttccagcctccacgacccagacagggcatgaaaaaacctttcgacattctcccaggccccaccgctccgggctcagcggtgtcggtgaattctccatagcagttgtccaccgccacgatgacgcgagggctctgggccttgatgacttgcacagctcgccggatgtcctccaggctgagggtggggcggtccgcatagccgcacgagcgctgcaggagggccatgcgtgtctctgcaccggttggcggaggctggtgacgtggctggacgttgatcgcatgatcccggggaagcttgcttggtatacctgctctcctgcctgctcgatgccactccagggtcccacccctggcagcagcgatacttggtggctctccaaagtttcccacctggtttcacggcggtggcaagcgcgccccagtctatggcgccgctgccgggcgccagtgggaggacccggtacccgaccccatgctcggcgagcgaaccggagccaggggtgccgcgaacgccgatcacctcttccagcgtgtcatatggactggcgaggggtgtgggcgatgggtgtctgcctggtttcatgggtgaatgcatgctgggatcctggcagtgcacccaacaaaatggcaagtgcaacacatccgtgggcaaaagcctgtgtgcctcgtctgattccatttccgtccagcaggcaaacccnnnnnnnnnngaaatggcaagtgcaacacagccatgggcataagcctgtgtgcctcgtgtgattccatttccgtccagcaggcaaaccctcacgatctcctgacagcccgggcccgccacaccttccagccacagaaaggagctcgtcgccaggcctcaagacgccaaacagggcgcaggcaatggcgtgcgtgcccgaaacaaactggatcctcaccgccgcagcctccatgcccatcacatcagccatgatctgacgcaggccagtgcaggccagaagggagggtgggttgcagcaagtggagttccaggcacaagccaatgcccagcctgctcggactgcctcgggacattccctcctgaattcacgggccccacctggtctagggcaccccggcccagatcgccatgaccatagcctgtggagcccaggaagtggtggggcccaatcctggcggtcgcaaaggcgcgctgcgtgcgcgccacatttgcagcaatgaggcggtcgatctcgctgaagacgggttgcagctcctccgcgcatgcccagatctgtagtggaggagagtggctggtgaacagcctacctcttgacgaggatgacgaacaagcgctgtaccaaggttcaatccaatggaatgcagccacgaaaagaccatgcagcaccatccggcaagacaaaccgttttaagtgggctctggggcgggtcttgtgtcttggctgtctgggggtgcagcccggtgggtgcctcatgaacttgatgctggggcggcgcacccatccacgccgaccgattggccgctctgccctcgcctcggcgcacatggaggtcattaagacgtccattcctggagttatggatgctctttgacgagaaccatattgtttgcggaggttttagactactagtaccggtgaacatcccccagactgaggttcgttgccctagtattcgacttgtacgcagtggattgaccgcgtgctatcgnnnnnnnnnncagactgagggtcgttcgccctagtattcgacgtgtacgcagtggattgaccgcgtgctatcgagagtacgacattgaatgtagttcaattatttatagattgaagacgggtgcactccggcagaattagcgggtcttcagaacccaccgtgccggannnnnnnnnnaattgaagacaggtgcactccggcagagctagcgggtcttcagaacccaccgtgccggacaaactcccggcatgcgtcggatggacgacggggtgggatagcgtggcgcccgaatctctccccaacactccccttccctttccaacccaccccgacacactcctcggacaactggcattgctacattccttggggcggtcagtgcagggcgtagcacctgctggcgggtggtccagggcccaagacgcccaaccggcatcacgagcgcacatccacgccgagcgcgagcttggtttcctcaaagacaaaccagctgatgcccgcggcgggggcaagcttgcagagattcgtccccgctccctgtgtgaggaggtgtggtagaggagtgggaattatctgcatgccctggtcgggccagcgacgtgcatggcctggcagcaccggcatggagggcaagtggagatggcggcctgcaccctggctctccactgtgcacattaccagggtcaaagtgccagcccagacccctcaaacaccccttgaaactttgcctgctgcccccctgctgcgcaccttgtacagcccccggaagccctcgttggcaaaggtccgccgcagcacgtccatcatgccggtgtatcgcaccgcctgcccgcctaccccctgggcctgcagcctcgtccgcgtcagtgccagcgggtaggacacgaactgggccagggaggaggaaagcatgcccgcgccgaggatgacatgcgcgggggggtggttgtcgtactgcacggaaggacgcagagcagcgatggggaggagggcggggg

SEQ ID NO: 35479 - DNA, 84 bp, Chlorella protothecoides
ctttgttcccggccgaggtctggtcgggggcctatgcctcaggccgctgactgagcctgctgcagcgcagcctccgtggctgca

SEQ ID NO: 35480 - DNA, 2092 bp, Chlorella protothecoides
  modified_base (396)..(405): a, c, t, g, unknown or other
  modified_base (656)..(665): a, c, t, g, unknown or other
  modified_base (813)..(822): a, c, t, g, unknown or other
  modified_base (1049)..(1058): a, c, t, g, unknown or other
  modified_base (1207)..(1216): a, c, t, g, unknown or other
  modified_base (1485)..(1494): a, c, t, g, unknown or other
tggcggggggcgcctcgccctcgtccccggccctcggccggtacgcctccgaggactgcgcccctagcctgagcggggtgcagagcagcggcccaggctcgccgcgcttcaacggcgggctggcctcgcaggagcacacgccgctggcctcagcggggctgaaccagacacagttctcctctgcggacacgaccctcaccgccaactacccggcggtgagcagggttgcctctggggaaatgggcgcaccgttgggctctggtttcatggcgcaggggaaggcaggggtgggaatccatgcgactgcatcaggctgcaggcagcagcttggggccacgtcgggcgccttaggcaggactggaggccgggacgcagggtagcgtcttgacgacagtnnnnnnnnnntgcagctgggggctacgccgggcgactttgcaggcctggaggtcgggacgcagggtagcgtcttgacgacagtttgagcgcatggtgccacatcgcgatgtcctgggcctcgcctgttccaacgcgatgaccggcccatctcagagcgatggtcttggcttcctgcacaagcttgtgtatcacctcgactccttccccgtcgctcacccctcctccaattacacgctcagtacctgcaggcatccccgcgnnnnnnnnnncgggcctcgcctgttccgacgcgatgaccggcccgtctcagggcgatggtcttgccttcctgcacaaccttgtgtatcacctcgactccttctccgtcgctcacctctcctccaatcacacgctcagtacctgcaggcatccccgcgnnnnnnnnnnaagagctggcgcctgaagctcaaggacatcacccccgccctgaccggtgcggtgctctcttgtcatggggtctgggagtctgcatgccttggcctggagtgccagcttttgcttttgagttgtgggaggtctttgaaggggttcccggcctgggcgggaccggtctagaggggctcgcctgctgggtggctgccctgcattccagcaagcagccttgagcacaggannnnnnnnnncgagcgctcggagaccggcggccgcgccgccccccagtacggcgactctctcgcggcggcgcctgccggggatgcggggcctgtgcctgtgggcgtggacgcctccctctttccccccggctacaaattccggggccccagccggcgcnnnnnnnnnnttctcttgtcatggcgtctgggagtccgcatgccttggtctggagcgccagcttttgcttttgagttgtgggagggtcttgaaggggttcccggcctgggcgggaccgatctaaaggggctcgcctgctgggtggctgccccgcattccagcaagcagccttgagcacaggagcgcagcgtggcagtcccctcctccctccgctgtctcctcccctgccacattccgaacccccccccttcttaacccaccgcagggcgcaccgttcannnnnnnnnngctcccccgccacattccagcccccccccccctttcttaacccaccgcagggcgcaccgttcaactgcactggccggacgacaacctgtggtggccggcagtggtccgcgccgtggacgtgccgcgccgctccgtggtgcttttctacgagacgggggacgaggagagcatcgacctggccaagctggtggccgcgggggaggtggcctgggtggagccgccctcggcgccgggcacccaggccggcacacagaagcgggcgaggcaggggagcgatgaggaggcggagccgggcgccgtcaggcccagcgccggcagcttcacgggcgccagcttcgctggcgcgaggccggcggccgtggctgcggccccgccctcccccgccaccgcgccgccgcccatgtcccccctcaaggcgccctcggcgggggtggggacgtccctgcagggtgccatggtacccgcgccaggcgtctccacgttggtgccggtcccccccccgcccaaggcctacggcgtggacctgacggcgccgggcgcgccgcgctcgcgcgacgccgcgcgccccggcgcccccatccacgccagccccttcctg

SEQ ID NO: 35481 - DNA, 65 bp, Chlorella protothecoides
agaactggttgaggccaagtgtggctccaggatcacgtgactgcctggtgaacacatgttgatgt

SEQ ID NO: 35482 - DNA, 80 bp, Chlorella protothecoides
ggtctgtgcagcgttggcaggaaggcatgcagacccctggggaaatgaacgcacgatactcccacaggacatcaaggctg

SEQ ID NO: 35483 - DNA, 61 bp, Chlorella protothecoides
ccattccaataggctgcttattgactgacctgcttaagccgcattccggttctgagaggac

SEQ ID NO: 35484 - DNA, 61 bp, Chlorella protothecoides
cgccctgcgttgccacagcacagctgagacgctggatgcaggcagcccatgacagtctatc

SEQ ID NO: 35485 - DNA, 68 bp, Chlorella protothecoides
gctggcagtcctggactgggagctgtccacgctcggcgaccccttctccgacctggcatacaactgcc

SEQ ID NO: 35486 - DNA, 161 bp, Chlorella protothecoides
agatggccccggggtgggggtggggggtggggggaggtgggggatggccgtgggcgcacgattccagcaatgacagaacaatgcaagcccccgaactgcccaccgcgaatatccagacgcaacacccccttgtcgtaccatgaagaggtcaatgggcatct

SEQ ID NO: 35487 - DNA, 69 bp, Chlorella protothecoides
ccaaaaccactccgctcatcaccaaccagcccacacccgtcccaaaatgacatcctccaggcccctcct

SEQ ID NO: 35488 - DNA, 111 bp, Chlorella protothecoides
aggtggcatcgtcgcaaggaggcagcgcaaggggggagcagagcatgatcgcaccagctgggggtcctccttttccattggttaccaggggagcgggaaggtggctgggag

SEQ ID NO: 35489 - DNA, 114 bp, Chlorella protothecoides
acccacacggccctgacgcctgaggaccggaccgaggccgagggagggccgagggcacgcatgttgcatcgcgtgcgccgtgcaaacgcgcaccgggtgacggacctggagacc

SEQ ID NO: 35490 - DNA, 61 bp, Chlorella protothecoides
ggctcggctgcacgaagaggcacatgtgggttctgtgctgaccgagagggcagctcttgcc

SEQ ID NO: 35491 - DNA, 61 bp, Chlorella protothecoides
tctctgccaccgcctccagcgcggcgtcgtcggtggcggaggagggatcgccggtcgcctc

SEQ ID NO: 35492 - DNA, 752 bp, Chlorella protothecoides
  modified_base (374)..(431): a, c, t, g, unknown or other
caggcgcaggcgctctgtttcgcgactgggagcgccgcctgcacgagcggcgccgccccctcgaccatcgccgccctgcgcccaggcgcgcagggccagggcggcggccagccgcgcggtctgccacctcccctcggtggcctgcagcccgcggcgcagcgtctctgccaccgcctccagcgcggcgtcgtcggtggcggaggagggatcgccggtcgcctccccacccgcctccccacccgtcgtcccagcctcgccccccgctcgccgaaccacagccgcggccagggaccccagcgcgtcggccgccgcgaggcgcgccgcggacagctcgcccgcactgccgacggccagcggcggctgggcggggaccnnnnnnnnnnnnnnnnnnnnnnnnnnnnnnnnnnnnnnnnnnnnnnnnnnnnnnnnnntgccgggcagcgccacgcacagcgcccacacggcttggatccctggtaagcgggtgggggtggtggccagggcctctgcgggaggccgtttggtggccgcggcgagctccatcggccgtcccgcggcgcaccttgccccgccaggcgcactccccgacgcgtcctccgatccccagcccagctccagggcgggcaccagcgcggccgccgcgccgcggtcgcccaccaggcgccgccacaggcgccgcacccggcccagcaggcctgggtcccgctccagcaccaggcgcggccccagcgccgccagcgcggccgccaggt

SEQ ID NO: 35493 - DNA, 96 bp, Chlorella protothecoides
ggtgagcgtcttgggattttcgcgaacccccaacgtatccatttccacacacgagtggagccacttcagcatccaaactgtcctgatcaaacatac

SEQ ID NO: 35494 - DNA, 97 bp, Chlorella protothecoides
tggcgcggcacctccagccgtgctggcgctggctcccatgcaggcgggcgctcattcaggacctggatttcctcccccacacaccgccgggccgctg

SEQ ID NO: 35495 - DNA, 76 bp, Chlorella protothecoides
ccagaggaaaacgcggtgatcacgggcttcaatatgctacactttatttcttggtaccgaagcacctctagagcgg

SEQ ID NO: 35496 - DNA, 142 bp, Chlorella protothecoides
ggaatcccggccactgctggaagaccggccacactagcatgttggaacctgtgcagcctcaaacgcacgtgcatccctgcaagctctccttccacccccaccgcctccatgtccccgcatgccacccattcacccctgcagc

SEQ ID NO: 35497 - DNA, 88 bp, Chlorella protothecoides
ggggccttgctgcctcccaatcacgtggctttctttccaaatgttcacagaaacatgttccacccttcctcatctgcccacaggctgt

SEQ ID NO: 35498 - DNA, 61 bp, Chlorella protothecoides
ccagtccccctgccgttgcgtctgtgcctgcgatgtcagggccagacaggtcttgtgaaca

SEQ ID NO: 35499 - DNA, 69 bp, Chlorella protothecoides
tgatgagttgattgccaacaaactgcaatctgttgttcagtttcctggcagggcctattactgggatcc

SEQ ID NO: 35500 - DNA, 139 bp, Chlorella protothecoides
tcccaaggtgcttgcggtgttcactgccactgcccagttgctaggatggagggacgatggacgctgggatgcatacacttcagaccctcaacgcatagttctctacgcagcctgggttccctgccagcactcacaccaa

SEQ ID NO: 35501 - DNA, 64 bp, Chlorella protothecoides
catggcaagtctcatctgcgtggacgacccaaacgtgacgctgctgacttggcaggccgatgag

SEQ ID NO: 35502 - DNA, 61 bp, Chlorella protothecoides
cgctttttgcacccaggctctgcacggacggcggtgattccagtccacccctcccactcac

SEQ ID NO: 35503 - DNA, 87 bp, Chlorella protothecoides
acacgggtgcagagtcgggagggcattcattgcgggagcatggaggggcaggggttcgaggggcatccactcataattttccggcct

SEQ ID NO: 35504 - DNA, 61 bp, Chlorella protothecoides
gcttccttgcagggtgagtgccgtggctggtgagcgatctcgggaaggaaaaccccactgc

SEQ ID NO: 35505 - DNA, 123 bp, Chlorella protothecoides
cgattttggcgagtgaactcctggaaaaatataaaaaaggatgaggagaactgcttccatgaaatgttgtggtcttgctgctggatgacattcgtggcaccttcaagccagatggcagactga

SEQ ID NO: 35506 - DNA, 61 bp, Chlorella protothecoides
gagggaagccaccaaggacttccagtccgggcctgtcgagagagggggtgaagtgtaggga

SEQ ID NO: 35507 - DNA, 77 bp, Chlorella protothecoides
acccccctctcacaagccgtcacctccgcctccgaccaagaagccgtcacctccatctcgtaagtcgacacccccgc

SEQ ID NO: 35508 - DNA, 369 bp, Chlorella protothecoides
  modified_base (105)..(271): a, c, t, g, unknown or other
tgcggtgcaagaaggggtcgggccagcggtggacccgcagcgcgccactccggcgtcgtgcttccaacaatcacctccagaagcaccttccccaccgacttgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaccctgaggcgggcgaagatgtggaggccagggaggtcggcggccactcccggggaagggcgacccaggcgcaccgccagagctgatgggccagca

SEQ ID NO: 35509 - DNA, 65 bp, Chlorella protothecoides
ccagcaagggcgggctatcgatcagcgcacagatcgcccctccaaaccatgcctctcaccctggc

SEQ ID NO: 35510 - DNA, 77 bp, Chlorella protothecoides
catttgcgatactgatctgtgccatctttggttttaggaggacgagcgtcctggcgtggcgagcaaccccccccccc

SEQ ID NO: 35511 - DNA, 70 bp, Chlorella protothecoides
agatcgtggtggcaaggacctcaaccccgtgaaccaggcaactctcaaagcgcgggagtcagaagacacc

SEQ ID NO: 35512 - DNA, 61 bp, Chlorella protothecoides
tccattgtcgcacagtctgtggctgcacgcacccgccgctgtaagctgcatggccactggg

SEQ ID NO: 35513 - DNA, 462 bp, Chlorella protothecoides
cgggcccgccgccgccgccggccgcggcgccgccgggcacctggccgacgcgcgcggcctgctggctctccgcggccccacgcacctcggcggtgttcacctccaccaggaaggtccccgccgcggtggaggagatgccgatgacgtcctccacgcgcagcgcgtgcgcgcggatgaagtcggcggcgtgctccagcacgtacacgcgccgcgactccatgccgttggcccaggactgcagcgtgaactcccagcgccgcccgcccgcgtcctctgccgccagcaggtgagcgcgcccgacggcaaaggacaggttggcctccaccgcggcgcgcggcagcaggatgcgccccttggtcacgtcgctgttggtcagcttcttggccaccaggatggtgcgggccgggaggcccgtggaggccggggtggggctgcgctggcgcgcgccgccgcccgccgcca

SEQ ID NO: 35514 - DNA, 222 bp, Chlorella protothecoides
gccgccagcagcaacgggtcgggagacagggcttccaggcgtgccaggcagaggatgggtacaatggggaagccatccaagacatctgctgggctgtccaggcagcatgtcgcggatggttgtctgggcacctgtgcaatgttgcagggagaggagtgtctgaggagcaggacacacagattgctgcatggatgccagggcacggaaactgacactctatta

SEQ ID NO: 35515 - DNA, 82 bp, Chlorella protothecoides
ccgcgccgccactcgtccgcactgcatggtcctcgatgtacaccaaaggaagacgctgggtcactcggcgtgtcgcagtcaa

SEQ ID NO: 35516 - DNA, 155 bp, Chlorella protothecoides
atgtaccgagggtggtgtgtatctctgtcatgccctcgtggacgctccgccagtcggcacggtcaagtggaaggcatgcagcccatgtggaccgagctctgttgctacgcggcagccactccgttgcatgcagcctgtcccttcactctgtcaac

SEQ ID NO: 35517 - DNA, 105 bp, Chlorella protothecoides
gatgactgtgctgaggtgtggaagtccttcttgccctgtcacaggaaggcgcccctactccatagtctgggtcacacaacagcacccagcacctgatccccgacc

SEQ ID NO: 35518 - DNA, 99 bp, Chlorella protothecoides
tgcctgccatatggagtgtaatgtacgcgatggagcatggtgtccgggcggcgcataccaccatcatgatgtcacccaagcggaatccatgatcatgaa

SEQ ID NO: 35519 - DNA, 73 bp, Chlorella protothecoides
ggggcagggcaatgtgatgggggcaacgcacgtgcatggtcgtacaggcagggctccatggcgctttcatgtc

SEQ ID NO: 35520 - DNA, 61 bp, Chlorella protothecoides
acacctctgtccttacctcgaccagaataatctcggccgctagcagactcttcatcactcc

SEQ ID NO: 35521 - DNA, 61 bp, Chlorella protothecoides
gtggtgccaggggtatattggctggggggggggacgcctcagagggacagtatggcccagg

SEQ ID NO: 35522 - DNA, 86 bp, Chlorella protothecoides
ttgcagggtcaccgacctgtgcatgtaggtgggatctggggctcgtgaatacatgagtagctgtgctacccatctgtcaaacccct

SEQ ID NO: 35523 - DNA, 61 bp, Chlorella protothecoides
cgccgccaggagctccgcgaagctgtgtgttcgcgccgcgcccagcgtgagcaggctccag

SEQ ID NO: 35524 - DNA, 116 bp, Chlorella protothecoides
ttgaacacctggggcgaggcagagaggggagtaagggggtggttgggaggcatatataaatgtgggcactgcagcaggatggttcgcatcaggacttggtagtaccaccgcgggcg

SEQ ID NO: 35525 - DNA, 78 bp, Chlorella protothecoides
gccgcagagggtgcagcagcccgccacccgtgtcccccggcagccgctcagctcggagcacgacggcccgccgggcat

SEQ ID NO: 35526 - DNA, 150 bp, Chlorella protothecoides
actggtgagcagggagcacttggttcctggaggagggcagaagggttccacatccagcctccggcctcgtccgcccctgcccccttgggcaccatcaacgcacgcccaccaacctctgctgggacgccaaagtgggaggggtgcagctgc

SEQ ID NO: 35527 - DNA, 61 bp, Chlorella protothecoides
atccattttgagcatgcgcagtataccaccacccatcctcgttgcatccacagcagcctgg

SEQ ID NO: 35528 - DNA, 62 bp, Chlorella protothecoides
tccttgtgtcgcttgcggcctcgacgggggtccgccccgggcacgaccaacagttgcaggca

SEQ ID NO: 35529 - DNA, 73 bp, Chlorella protothecoides
accctaaccctaaccctaaacctaaacctacccaaaactaaacctaaccctaaccctaaccctaagccggccc

SEQ ID NO: 35530 - DNA, 78 bp, Chlorella protothecoides
ccctccagcaaggcctcactgctcaacccagtactgcccctctctcttcgcccagtgcttaccttcccctggtgggcc

SEQ ID NO: 35531 - DNA, 61 bp, Chlorella protothecoides
atccttggaaatgcttccatatccgcaagcaccctgtggaggaggaagatcgtgggtgaga

SEQ ID NO: 35532 - DNA, 103 bp, Chlorella protothecoides
accctgtgctccttgaccacatcagaaaggcctgcaaccgtaaaacttcatccaaccgaccccgaagctgctcgacaggccaaccctacctatacccattgtg

SEQ ID NO: 35533 - DNA, 61 bp, Chlorella protothecoides
aggagagtgcggaaccagcgggctctgggggccatggccaggggcgagggtagtgagaccc

SEQ ID NO: 35534 - DNA, 61 bp, Chlorella protothecoides
ccatccgttggctacccgcactccaatcctgcatccctcgaaatgctcaggccggcggaca

SEQ ID NO: 35535 - DNA, 77 bp, Chlorella protothecoides
agttgccccacatgcaacaaagtgtcaaaaacccacttacagagaagttccttgcgaagtgcatcgggtcacctcat

SEQ ID NO: 35536 - DNA, 88 bp, Chlorella protothecoides
atgcatgtataaccatcgactcgacgacgcgcaccccgcgatcacatccacgccaagactcctcaccagcccaagcaagcgacttcgc

SEQ ID NO: 35537 - DNA, 144 bp, Chlorella protothecoides
aggcgtgtacttggtccccatcaagggccggcaggagcaagtgtgaggcatgctaccctcccaacgctttgccaatccccctgtgtgtcgccagtgcacctctccagaggatgcctgcgctgcgtcgtggaaggcaaggccctg

SEQ ID NO: 35538 - DNA, 61 bp, Chlorella protothecoides
cggaccagcaggtagtagagggaaccccagctccagaagaagagctggtagatgatgaaga

SEQ ID NO: 35539 - DNA, 123 bp, Chlorella protothecoides
tgaaacgtttcgtcgccctggatcgaggcgtcgggctcggcagcgcagcttgcacacaccccatcgaaaccctgcatccgacaagcccagcgccggcgctcacctggagcaggaccttgccgg

SEQ ID NO: 35540 - DNA, 98 bp, Chlorella protothecoides
caggcgccgctcgatcaccctagcgggagtaccgcgctggatcgcagtcatgagccggcgtccagtccgctcgtcagcccttcgcgcctcccaaggcc

SEQ ID NO: 35541 - DNA, 171 bp, Chlorella protothecoides
tcaccgctggcgacggtcttgggcaggcatgagcattggtaggctgtgcctgggaggtggagctgtgatttgcgaatccctccacaccactgtcagctcacgctctgaatgcagaggtccagaacagtgccgttgtgcgcgtagtgacggtcggacatcaccaccaggacc

SEQ ID NO: 35542 - DNA, 61 bp, Chlorella protothecoides
gcatggggcaggagggtgctgtggtgggggtggagacgccacaggcgacaggcatggaaag

SEQ ID NO: 35543 - DNA, 61 bp, Chlorella protothecoides
cactgggagcagtgaggagtgtcctgaggtacacgcccaccttgcagatgacaccacacct

SEQ ID NO: 35544 - DNA, 61 bp, Chlorella protothecoides
gggcccaccatacaatgacctcgaagagtggagcgtgcaatgccaatgcaacccgctatat

SEQ ID NO: 35545 - DNA, 79 bp, Chlorella protothecoides
gctcctcgggccgggagaggaaggtgcccgccgcgatctcgccgtgcacgccacgcaggagcgcctgtgccgtcagcgt

SEQ ID NO: 35546 - DNA, 66 bp, Chlorella protothecoides
acaccgcgcattgtttgcaactgatttgaggattttagatgtgaataatcagtcttgggggggggt

SEQ ID NO: 35547 - DNA, 67 bp, Chlorella protothecoides
gggtggagggggaggcgacttcttgggtaggggcggcggaggattgtagttcacacgcacagaacta

SEQ ID NO: 35548 - DNA, 122 bp, Chlorella protothecoides
atgaggtgcgtggacaacgcgtcgtggttcaataacttgtggggtccggtgatcggggccctgtatgcggctctgtgccaggatgcccaaaatctctcccgctccctgccctcccccagaac

SEQ ID NO: 35549 - DNA, 61 bp, Chlorella protothecoides
cctggtgagcaccctttccagcagcacagcgtacaggtcgtggtcgatgtcggtgcccctg

SEQ ID NO: 35550 - DNA, 70 bp, Chlorella protothecoides
atgcttcctcatgccgtgaatgttcacccctcctcccccccaccccctgcaggccacagggatttcatca

SEQ ID NO: 35551 - DNA, 61 bp, Chlorella protothecoides
tggctggacgcccgctcctgaacgcggcggtggcgtctctcttaccatcgattggcctgac

SEQ ID NO: 35552 - DNA, 7926 bp, Chlorella protothecoides
  modified_base (169)..(190): a, c, t, g, unknown or other
  modified_base (1000)..(1009): a, c, t, g, unknown or other
  modified_base (1359)..(1368): a, c, t, g, unknown or other
  modified_base (4312)..(4321): a, c, t, g, unknown or other
  modified_base (4745)..(4754): a, c, t, g, unknown or other
  modified_base (6255)..(6264): a, c, t, g, unknown or other
  modified_base (6492)..(6501): a, c, t, g, unknown or other
  modified_base (6567)..(6576): a, c, t, g, unknown or other
  modified_base (7032)..(7041): a, c, t, g, unknown or other
cggggctcagcccgccactgccttggcgccccacacagccaggggccccggcgacccctcggccccacgtcccgccgcgctggggtcgggcgacatcctggcggcgctggagcgcagcgtgggcgccgccggccacggcgcgggcgagtggctgggcggcccggcgggnnnnnnnnnnnnnnnnnnnnnnccgccgcggacctgaacacggcacgcgcgctgcccacgctgcgcgagcggtacgacacggggcggcggccggccgggggccccgtcgcgatccaggaggaggctgcgggccccgcaccggccaaggccaggaagaccttgttcaggcgcgcactgtacgcgctgcgcctggggcggcgcggcgcggtgcagtgaagccggtggcagccatgggcgcaggggtggctgtgctgtcccctaaactacttagagttgcgagcattgacacactagcgagcggggaggatgggagttttctggccgcgaacctttcttcccgctgtaattgatccgtcgagccgcgacgagggacaccatagagaggggggggagcccaacagccctacacgtagaagctccggggagcagacgctgagagtcaaacagacattgtcatcgggaagcgcccagcaaccgctctcatgctgggcttggctgtggggccatgtggcctgcacaggcgacagcccgctccatgcctcgtcacggacccatccgcgcaccgtgccgcgccggggcgggcagggggaggagcacaccattgtcgtgctttgcatctgtctgagaagcagaaaacgcgcgcatcccgggcgcatggtccggaggaggtgaggctcacagcgtcgtcatgcagagctccaggacttgccgtgactcgcgtgggcccctcgcggcactgccgccccatgcctcatgcgcatgccgactcgtttgcaatgcagggaagcccatgcatgacctttgcggcttcatcaaaccctccagaggtggnnnnnnnnnntccatgcctcatacgcatgccgactcctttgcaatgcagggaagcccatgcatgaccattgcggcttcatcaaaccctccagaggtggcataccctgcctcctggtacgatggggagggccgcctcatgctcaagaacctgacgctggagcagctgagcgactgggtggtcgcggccctgggtgagtcgacgtggctgctagcctcggtcaccccgcatgccaggcatgcttccctggcccctgcccctgcgtgtaccagggccccctccagagcaacaaatcttgctgccctggttcgccgatgccgcaggcgagccgcggtccagggggatgcagctgtggcgcgccnnnnnnnnnnagcccccctccagagcaacaactcttgctgccctggttcgccgttgccgcaggcgagccacggtccagggggatgcagctgtggcgcgccctctaccacagctggcccctgctggaggacctgcgccctacgataggcacgcccaatggcttcagcgccgcgtttgtggaccggctgacccgggtggccagcctgggcggcggcatggaggtagccggcgtcagcactgcgcccgacgggacgcagaagctggcctgccgcctgaccaccggacccgcggcggggatggaggtgagtgctgctggcttgggcttgagacgcctgtctggttgcgtgctcgacttcacctgtgcatggcgggacgcctgggtcggagaacgaccccctcccccctctcttccctgccaacaggtggagtgcgtcctcatccccatgccggggtcgaagccacgcatgacggtgtgcatctcctcccaggtcggctgcgcccagaactgccaggtgcgctttgttcaggggtttgggagcgacgtgggaacccgcttgccaccctgggggctcgggggccagccatgcgccgctcgccaggcagtacacttcccaagcgctcctcccgtcatctcccccccacgtccccagttctgcttcaccggtcgcatgggcctgctgggccagctgtcgcccgcccagatcgtgcagcaggtggtgcttgccaagcgccaggcgcgccccagcggcgtggccaagcctccggatccttcatcagggcctgaagcgcccgtcaccaacgtcgtgttcatggggatggtgagcctggagcctggcaatacttctgtggactgcaatcgtatgcattgcgatggtggtgtggccgtaaggcctcgccgctctggacatgcgtgtgggtatcggcgcctgcactgaggcccgcatccctaggatgaaatctgctgcctccctcgcacacagggcgagcccctgcataacgccggctccgtggcggtggcagtggaggtgctgacccacccccagggcctgggcttccccgccagccgggtctgcgtctcgacggtgggctgcgcatttgtgggatggtggcagcgggtgcgactctgatgttgcgcctgtcctccctcgtgccccgtgccactcgctgcgcagcccatcccttgaccctccaagaatcaatcctcgccccgtcgcaggtgggcctggtgccggagatgcgggccttcgcggcgcggagccgcgcggcgctggcggtgtccctgcacgccaccaccgacgaggtccgcaactggctggtgcccatcaaccgccggcacccgctgcgcgagctggtggctgcactggaggagctgttccctgcagaggcgcagcgcgccggccgccacgtgctcgtgcagtacgtgctcctgcgcggggtaaacgacggcgaggcggacgcccaccgcctcgccgacctgctcgcccgcgtgcgctgcaaggtcaacctgatcggcttcaacccgcacccaggcacgcgctttgcgcccagcggggagcgggccacgcaggccttcctcgccgtcctgcggcagaggggttgtgtggtgatgctccgcgcctcgcgcggcggggaggaaatggcggcatgtgggcagctgggggggctggcgggcgggcgcggcgcgggggacggggcgctgccgcgcatcctcccgccgccgcgccgcttcgaggaggtgctggcggctcggagctgaggccttggaaggggtttgcggtggaggggactcgatgctcccgggaaatgcgatggctggcgtgcagcacagaagcctgtcaccctgtcccaacccactccccatggtatcgaagcgtgtacagattatactgggcaacatgagagagaactcaaggggagggagtgcatatactgatcgtgtaacgtcagggtgcaaagggcaagtgggggaagtctgcaaccaagccaagctgcgtgatggtggggagcaccatggcggctgcccactaccacgcccggggtcattgcgggaccacacggtgttctccggcccgattcctggactggacccgcaagcgaccgtcaccgggctgcaggtgtgcctagggagggaaggggcgcatgtggggccacagagacgggcacgaggaagcttgcaaggaggccgggtcatggagacccgtcgggggttgggcccaagtctgcagtctgcagtcatgccccccgccatgggatcccacctgagagggtgtacctgggggagctgagccggtccgcgccgtcggcctcgcccccttcccattcacctcccaggacaggagggacagatcgccgtaccccctcttccagaacaggcctgattgggttgggttgggggaaggggatccttgcgcatgtcctgcagtgccaacaggatgttgagatccaagggcacaagcatgggcgacctcacccatgcctcagcctgggacccccttccctccttctttccagcccaaacacacccaggttgtaggtgatgaacaggcttgctgcagccagccaggcgaggccgccgatgacaatgtagacactgcccaggaagacgttctttccccccacccagctgttggtggtcaggatgaggctcttggcgccctggaagccatacgtgttgtaccggttgtacaccagcaccgtgacgatcatgtctgcacggtgcgatgcttgcatgtcttgatatagaaagagggaagggtgctgggggctgactccgccacctcctggcctgaccatggcaaagcctcatccatgcccaggagaccagtccccggttcagaatcccgatgccagccaggcccactgggcctcctgctcctgctgccctggtttcctcaaacccctcgatccccagactctccatcgggagccccacgatcctcgctccaaggccaatcnnnnnnnnnngccgatgccagccaggcccacagggccacagggcctcctgctcctgctgccctggcttcctcaggcccctcgatccccagaccctccttcggaagccccacgatcctcgctccaaggccaatccctccccccgcccagaacaacgaatccgacccaccagcctccaggtcggagtcgatgcggccgtacagcttctgtgcctgggcctgagcagccgggcgctgccacaccatccagtgctggtcctggttgagcggggcgaagaccccccggcccccgcgcagcgccggcaccgtgttgaagttttcggcgttgaccgggccgtagaggtgctcgcggtcgctggcccaggcgatgtcgctggaattgattggcagctcccatgcggcggcgccgccgcgtcgccgcgccgacagctcgaagnnnnnnnnnngttgattggcagctcgcgtgcggcggcaccgccgcgtcgccgcgccgacagctcgaaggtgtcgttgaagagggactgggagatctggccgcagggcaggatggcgccctggttggggaaggctgcgtccggcgcgcccgtgatgtaggtgaagggctcgcaggcggagacgccagacttgttggcctccaacccgtcgtgcatgttgtcagggtcaaaggagcggacgtagcggcggtagttctgaaacatggagtccagctcgtacacgacgtagatctgtgtgggtcgagggaggggccgggagggtgagcaggctttttggttgggcagcatccgaggggagggggaccccggccggttccttcctcagtgggactgcgccatggcagcagggatggcttcacgctgcatctttagtgtgcctccctcgccagaccacgcaatgccagccctgcctctcaccggggcggtcatgcgcttggttacctcgatctccaccatcaccagcacgccctcgtcgcccgcaccccacagcagctcctgctggttgttggagtccaggtcggcgaagacaccagccagatcgtagcgggccttgtactccacgacgttcagggaggccactaggatgggtatgcccagggccaggcaaaacaccccaacggccaggaagtaaagttccgcgttccgggcatgcaggatgggagaccagccccggagccgctgctggacgaaccgcttgtgccatttggactccttcttgccctgcgccgcggagcccgagggttgactgtcggactcgctggacggcatctgggccacaggctacgccccgggcaggtcgcagatgagggacggtgctatcatgacctcatacgatgtcgttccaggcgatccgtgaccttcctggcgagctgagcggccccggacttgggttcagcagctctgacataacgcgaacatgattgcaacttgaacagtttgtcccgggttggagggccacctggcgcagcgcttcaaaataatctcggggacaggtaagcaggcggtggcatgcggtcgccctgggacgggtggcgcataatgtacacacccacctcgaaagtttaaatactgagttcgccatccaccggtcgcaagcgcatgccaggcctgtgagcaccccggcgccagcacggaatggccagcaggaaggcgacgccccgggccggcccgggtgccggaggccctgctggatccgaagatggagtcaacatccaggtcatactgcggtgccggccccctaccaaggaggaggttgccggcagggcgccgcaggtcgtcaagtgcaacgaggccctgcgggaaatcaccctgaaccagacgctgggagggaagcaactgggtcggacgtaccacttcgaccgggtgagcttactcgaggatgggaatggctgacgagcatcgctggagaggaaagtggctctgggctgaacccaccacagctcaaccgccctcnnnnnnnnnncccctcgtggaggaaatgctggagggatttaactgcaccatctttgcctacggtgaggtcccagggttctgctctcgtaatgcctggcttatgcttgttgattgtggtgcagagtgacacatctcactttgcactgccaagcttccatgtggcaggacttgtgccgaacatcaatccccctcccttcccgacttgtccaattgcagggcagacgggcacgggcaagannnnnnnnnncccccccccggcaggtcttccccggcgacacctcacaggagagactgtacgacagcaccgtggccnnnnnnnnnnagtgcagagtgacacatctcactctgcactgccaagcttccacgtggcaggacttgtgctgaacttcaatccccctcccttcccgacttggtcaattgcagggcagacgggcacgggcaagacctacaccatgaccgggggtgatctggcgcagggctcggccgagatgaccgactcggcaggcgtcatcccacgtgccatccaccaggttttctcctacctggagtccctgggggcccaggaattcacggtcaaggcctcctacctggagctgtacaacgaggaggtcaccgacctgctggccctgggcagcgagccgcccaaggtggaaaagaaaggggggggaggagggactggggtgatggcgcacataggtctgctctatggagtgtagaatgggaatttgagggcaataatgaggatgcatggccatgctggcagagaggggtggacatnnnnnnnnnngggtctgctctacggagtgtagaatgggtattcaagggcaatgatgaggatgtatggccatgctggcagagaggggtggacatcaggccggctgatgtaaatgtttgcccctcgaccccgcgcccacccaaccaaagggctcccaccacccccacctgaccaggtgcgcattctggaggaccgcacgggcgtggtgctaaacgggctggaggaggcccaggtccgctccgcctccgacatcttcagcctgctggaccagggcaccgccaagcggcgcacggccgagacgctgctgaacaagcagtcctcccgctctcacaccgtcttcgtcatcaccgtcagcgtcaggtgtgtgtggggggggggggcgcgaggggggtgtagaaggtgcagccttggtatggaaacctagcaggcaaatggtgccacgcagaggccccttcacccaatctcgaggggattgcatcgcttggcaccatggctccaaagcagccccggcagcacaatgagaccgctgatggtcccagcgacaccccttcctcggtgcatatcccaaacactgtgtcttcacccttcagcgaagtcgtcacgcacaatcttcacacccacttccaacagggagatcctggcggagggcgaggaggtgatccgggtgggcaagctgtacctggtggacctggctggcagcgagaacatcacgcgctcgggcgcggtggagcagcgcgccaaggaggccggcaacatcaacaagtcgctgctgacgctggggcgcgtcatcaccgcactggtggaaggccagggccatgtcccctaccgcgactccaagctgacgcgcctcctgcgtgactcgctgggagggcgcaccaagacctgcatcatcgccac

SEQ ID NO: 35553 - DNA, 135 bp, Chlorella protothecoides
ttgggggggtggcatccaatggccgctgtatggtgttgcgatctggattccatgcgcacagcatgcagctctgccaggcaggagtcctcaccccacttccttgttaacccagcctgcctgtgtcacatatccccc

SEQ ID NO: 35554 - DNA, 80 bp, Chlorella protothecoides
ctggatgggcgcattctcgtacgagtacctaccggtttttcgtttaggggtgttgagggggttgtatgtgggtggtggtg

SEQ ID NO: 35555 - DNA, 120 bp, Chlorella protothecoides
ccctctgggtggttgggcagtgcagtgtggccccccaccctccaggctggtcccacgacccgggcccttgcgttccaagccacgtgcaccgagtcgatcccccgacccacccgtgccgcg

SEQ ID NO: 35556 - DNA, 77 bp, Chlorella protothecoides
gccagctcggccgccagcgcggcgtcgtgcgcggcgcggagctcgctcggccccgtgggggcggtgaggaaggtggc

SEQ ID NO: 35557 - DNA, 61 bp, Chlorella protothecoides
gcgcttctgtcccgaatcccttgtacgccgaccccgcccgcgcctgaggcagcggctgagc

SEQ ID NO: 35558 - DNA, 61 bp, Chlorella protothecoides
tttctacatactctgtgctgcgtatttgtcaccctgccgaaggatgactgaccccctccca

SEQ ID NO: 35559 - DNA, 79 bp, Chlorella protothecoides
agaagcagcatcaggcatttccaagtgcatcaaatactgcatccgaggatcgtcgtcacggcaaacgagctcgggcagc

SEQ ID NO: 35560 - DNA, 69 bp, Chlorella protothecoides
agcccgcaatacagcccgaccagcccgcagtacagcccgaccagccctcagtactcccccaccagcccg

SEQ ID NO: 35561 - DNA, 117 bp, Chlorella protothecoides
aaggctgcggccgacgaagcaggtaggggcagggtccaggcgcaagagcacggtggcggcaagcgcgaggatgctcttacgaggggagctgccatggtaaatatggcatcaaggtcc

SEQ ID NO: 35562 - DNA, 103 bp, Chlorella protothecoides
tgggcgtgcacttgccgtgccccttgcgccacgggcagcgctgccggcagtatgggcagtaggtcatcctggggtgaaggctgacgccgctcccaaaccaccc

SEQ ID NO: 35563 - DNA, 61 bp, Chlorella protothecoides
agaaggaggagtggatgcccaggactcccaaccccgggatgatgcagcccgtaacgagacc

SEQ ID NO: 35564 - DNA, 61 bp, Chlorella protothecoides
ctccaggtatgtctgggatgcattttcagcaagtgcccgcactgcagtcagagatggcgtg

SEQ ID NO: 35565 - DNA, 61 bp, Chlorella protothecoides
tacctttcccctgaccattgatccctgcccgcccccccccttgtctcaggctgcctctcaa

SEQ ID NO: 35566 - DNA, 61 bp, Chlorella protothecoides
tcatgaagcatcaagcaaagatctagcgtcgcagccactcgccatgatgttgtgggtggca

SEQ ID NO: 35567 - DNA, 81 bp, Chlorella protothecoides
cgacatctggagtggcgcccgcgtggcgcaaggtgagaaaggggggggggttgagagttggtataggctggaacaatcatg

SEQ ID NO: 35568 - DNA, 61 bp, Chlorella protothecoides
gctgtcaaacggcggctcagcattgcaggcgccgcggagtgaatctttgacagggcctcct

SEQ ID NO: 35569 - DNA, 61 bp, Chlorella protothecoides
cttgcgctggaggaccagggcgcctcccacagcccctgccgcaaagactcccaggacgttc

SEQ ID NO: 35570 - DNA, 108 bp, Chlorella protothecoides
caccccacgaccagttgcaagccagagggcttccaacatcccagggcacggtgccatccacccctgagatccccctctcaccagctcggcacgagtgatgaagcggta

SEQ ID NO: 35571 - DNA, 77 bp, Chlorella protothecoides
tttattggtggtgacagctgccaagacccctttaccctccctttaggccccccccttcactgtctcacaagctttct

SEQ ID NO: 35572 - DNA, 77 bp, Chlorella protothecoides
aggcacaggcgggactgcgggagtgggtgcacacggataccctggctgggctcaccctgcatccacactgcacccac

SEQ ID NO: 35573 - DNA, 137 bp, Chlorella protothecoides
atggcggtcgtcaggtcgggcacggcggtgtgcgcctgggccctcgtgcgagaggccgtcaggggggagcggggagaaagtgatcaggcgtggccgccgccgccacgccagcgcgccggcgcctcctccaggctgag

SEQ ID NO: 35574 - DNA, 70 bp, Chlorella protothecoides
gcttcccgaaggtgctgaactacttcgtctgaagccctttccatccgggatccaatatgacacccgacct

SEQ ID NO: 35575 - DNA, 69 bp, Chlorella protothecoides
cctcctccgaattcgggacctgcctctttattccttaaactcgatctcttaaatattgcttgatactct

SEQ ID NO: 35576 - DNA, 61 bp, Chlorella protothecoides
ggagtcattcacctctccaacccgtttgcctatgtacagggcttccctgctccgtgatgac

SEQ ID NO: 35577 - DNA, 61 bp, Chlorella protothecoides
aacttcaccattgcacaatcctaatctgaagtacactcaaaaccccgccaaccatgcagcg

SEQ ID NO: 35578 - DNA, 160 bp, Chlorella protothecoides
ccggctcgggagagggcggggcggggtcattggggtctgccgtgggcaaatatgtctgcggcaagcgcgtccccacgcccttgtggtctggagagcgtggggcgagggagccacgggatgaaggaaggcgggggagggcagcggctgagctgaggactgg

SEQ ID NO: 35579 - DNA, 116 bp, Chlorella protothecoides
tggaggagattgcttggcagtcggcggaggtgacttcctggcgggtgtcggtggtgacttcttggaaggcgggggtggagatttcttagatgagggtggtggcgacttcttggcgg

SEQ ID NO: 35580 - DNA, 1243 bp, Chlorella protothecoides
  modified_base (92)..(293): a, c, t, g, unknown or other
  modified_base (390)..(638): a, c, t, g, unknown or other
  modified_base (982)..(1168): a, c, t, g, unknown or other
cccatcgtgctggagttcagagatgcaattgatttttattttgaacccaatttcacttcggaggattcagccgactagacacggttcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagtcgcgatattgtaccttcagtttggctgcgtgccgtaagggcatccttggtaatgatttgattcttggaactatgtacgggcgtcagcttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcgttgggcaggctatctatacacttgatgtgatgcacgtgtaaactatggctttgctttgaacatccgccacgcactcaggcctgggcaatggcgcctcctccgactggtaatgcctgggacaacccgatgtccgccgacgacccagcacgcggcctcatgccgcacttgtcaggacgcctcctgaagacgacctcgtctgccaccactgcatggaatggttgaagggctgggagtcagctatgggccttgaacatgcacgagtgcagcttccagccatgtgagctgtcctgatctggggcacgcagatgaacagcatcgagcacgccatcaggccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagggtaatgaatgcgctgaccagtaaaggatcatcatgagcagcccaccgcccattgacctttcacccctgcca

SEQ ID NO: 35581 - DNA, 119 bp, Chlorella protothecoides
ctcatggtgcacggccgcctcggcgcggtgtgcgtcactgatggatgatagtgcgaccccctctcctcaacctcatgtcccccaccacacacccaacaaccacaccctcagtcggacat

SEQ ID NO: 35582 - DNA, 61 bp, Chlorella protothecoides
gaggggaatgggcacggttgccatggcagggattctttaaacgaacacatgcagcctgaag

SEQ ID NO: 35583 - DNA, 95 bp, Chlorella protothecoides
ccgcggcgcgcgcacatgggtgcgggcctctcgagcgctgctcgccgcctcgaccctcaggcgggcgggtcctcagcgcagcgcgcgatcatgcg

SEQ ID NO: 35584 - DNA, 80 bp, Chlorella protothecoides
tcgcagtcgtcgtgtcgtgaggcccgcattctgcctgctccgtggccgcggcagcggcgtgcagctgggggcacagggcg

SEQ ID NO: 35585 - DNA, 118 bp, Chlorella protothecoides
gcagcggaaactgaaggaggagaaggagctgaggaatgcccttgccggtggccttgcaggcaggttttgggctccatggatcactgtatcggcccgggtcctcgagccttgctgtagg

SEQ ID NO: 35586 - DNA, 61 bp, Chlorella protothecoides
ttgctgcttcttgaatcgcttattcctgtaaaaatattcgccctcgataaattcgccacct

SEQ ID NO: 35587 - DNA, 6844 bp, Chlorella protothecoides
  modified_base (1832)..(1841): a, c, t, g, unknown or other
  modified_base (2596)..(2605): a, c, t, g, unknown or other
  modified_base (2938)..(2947): a, c, t, g, unknown or other
  modified_base (3926)..(3935): a, c, t, g, unknown or other
  modified_base (4148)..(4157): a, c, t, g, unknown or other
  modified_base (6398)..(6407): a, c, t, g, unknown or other
  modified_base (6488)..(6600): a, c, t, g, unknown or other
agggggagagggggggcagggggagagggggggcaggggccttggtttgggggccatgggccatgacatctcatcccaggagcaacgtaggtggcccggatgtggaaggggctgatcacagcgttcctcatcccacccaacacattcttggtgtgtgtggcaggtcggaccagggatgccccgcacgctgcacttcagtcctgactgcagcgcatgggcgcagccgtcgggatgggaatcagggcatgaggcttccagcggagtggctgctggcccagggaggcgcgccacccgcgcccatgcacccctcaccttggtcccagattccagctggctgccgccgttgatggcagcgatcaggtaggacacacccgcggcgaccagggcccccatgggggaggccagcatgatcccagccgcgacctggaggaccgacatgccaatgtgcagggccagcgcgctggtccagtagagcagcagaatggaagaggtggggctgaccaccacggggtccagggacagcgcgctccagacactgacggggctgacgatagccatcatgaccagtgtccccactcccatctgtgcgggggaaggcagagtgtggcactgcaggtcgacgcccactatgaggggcgacggtcggagtcacatgggtatatgtttaacttcgaaacctacctggacgccgaccctcacatagggcttctgcgaagcggctgccagccagcgggcgaggcccatgacgggtagggtggtagacccaccccggtctatgagggtgcacttgcaaagctcaacattctattatgctaccaatatcgccttgctgtcccgaatggccacaggatatggggacgcatctcggttgcgggttcgagaatgtaatagtgttcggattattcgtttggcaggatgctcgtcacgttggtcatcggttcaaggtagatctcaagagctctgtttcttgtggtcgccagcaaacagcatggatgaacaatggtgagactggctcccctggctattccatcacaggagtaaacctttgctatcagcaacccaatgcaaacgccgccgcccacagccgcctaaggtgggtgtttgtcctccagtaccaatcgtaacatgttgtgatggctgatgttacggttcagaggcacctttacaaggggtgctctgcccggacccacaccaccgtcgcaagacgcaaaggcagagtgcttggggaggattctgaatctgtggacgagcacttcagcatggctggaagaggtcatggcaagtaagagatggtagcaaaggctacatatatgttcatggcaggcattaccttgggttgagccatcaatggtgctcgcggcatgggcttgttcatgctatgcccggcgggtctctacacaccctctgggtcgaggctcttgggagatgccgctcccaccgccctctccaggccctcatcctcctcgcagtcgcctgggtgctgggcgaccgccatgaggtcgttgcagaccagcatgagctcctggtccagtgcccactgctcggcatccaccagacgatccacggcggactgcgccgccgcgtcgccggcacggacacaccgcaccaagctcacggccagtgtgcgtaagaccaaggcggcgttgaacatcatggccaggaaggacacgcccaggatgaggtcgttttgggagtggcagcccagtgccttggtctgtagcatgacggaggcgaagaggtgccgggtcatgtcctccaggttcagcgccatctccaccaccctgcgggcatgcaaggaacatgagcgtctgggcgggaacaggagtgccaannnnnnnnnncccggccttggtagaagtgggcgtggcaggaagagacgaggttcacgtataaatagagacccatgactgcgaaggtgcgcggggagccttcaaaggtgctcctagcctctgggttgctggttgtccctcgagggtcctctacacttctccggagtccagcttctttgaggacatggtgcccgacaccgcatggaactcctccatcccttcgtagtcgcccgaggtctgggccaccgccatgaggtcgttgcacaccagcatgagctcctcgtccagggcccactgctcggcatccgccagacgatccacggcggcctgcgccgccgcgtcgccggcacacacacaacgcaccaggctcatggcgagcatgcgtatgacaaagccggcattgaacatcatcgccaggaaggacacgcccaggaggaattcgtggtgggactggctgcccagggcctcggactgcgacaggcaggagacgaagaggtgccgcgtcatgtccttcagattcagggacatgtccaccaccctgcgggcatgcaaggaacgtgagcgtctgggcgggaacaggagtgccaactgggagcaggccaggcggaggcggcggcctcatggtcgctgtactcgtcgccagagtccacacagccagctgcccgcaagtgcgtgccatgggattgggatccacgacttgcaggcccaagctgtatgcagcaacttcctccttcacaggtaactcctcctagcgccccactcaggcnnnnnnnnnncggcccaagctgcatgcagcaacttcctctttcgaaggtaactcctcctagcgccccactcaggctcctctggacaccagcccgtccgccttcccctgcctcacctgtcagtagcaactgtgcggcgcaccactcctgccagccccagcaggcactcgctcaactggaaggccacgctcttcacctctttgcggtgggggaggagaaagggcgagctgtgcgcatcgttgctgtccagggctgcagcaaaggacgatgcgacgttcaggaggcagaggcaaagacgctgagcctggtccccagcctcaagagggaacctgggtgaagttggannnnnnnnnngacgctgcatgcgggtgagtgtgttgagtgtggtgtttggggggggaatgaggcggagtgggaggggcaggtggcggcggcggccttgtggtcgtcggccttgttgccagcaccctcttccctggcgcccccgccgcgagccccccgtgatcgtgcacaaccgggcatgcgtccgccatcagcggaggctagcttcacggacaagatcaacgcccgtagggggcgctgcccggcgcctccctcacccaccccctgacccttctgtccaccctggccctccccttcccacctatcaatggcaaccgtgcgacgtgctacccccgccaggcccagcaggcactccctcagctggaacgccacgctctccacctcctcgcggtgcgggaggaggaagggcgagctgtgcgcgtcgtagctgtccagggtggcggcaaaggacgacgcgatgtccatgaggcagcagcagaggcgccgcgcagtgtccccggcctcaaatgggaacctaagtggttttgggggggtgaattggggttgcaagcatggtcagtagggggacgcagggttcagcagaactttgcgggggcctgctgggacgtgaggactgggacgcaccgaccatgcagcagccatgcagccagggctcgcagccgtcccccccgaaagatggggcgcatcccctgcgcggccctccgctgtgcccagcacaaggcgagcgctcgatgccaagccagcccgcaccacagatgcagggtggacgatctcccgcccgcgcgcccgcaccggcaggcacaccccgtcaagagcgctcgcaccctcccgaggccctccctggcatcgcggcctggcacacccaccgcttgactttgctgaaggggtagaactcgtactgcaggggctgcgccatctttgcaatggccgccagggctttgttcgccgggagcgcacggtgcatgaggtccaggtaggcgctgcccagcannnnnnnnnncgagcctacagtttgagtagctgccttgccatgtgcagcccagggcgtcggtcaggctcgaggttgcccagccggcacaccctacttcccgtccccgcacaggcaagtgggctccccccgtccccccaccctcctccggggctttcccccccatccgctccacacccaccgcttgactttgctaaaagggtagaactcgtactgcagggcctnnnnnnnnnntgagcctacagttcgaggagctgccttgccatgtgcagcccaggacgtcggtcaggctcgaggttgcccggccagcacaccctacttcccgtccctgcacagacaagcgggctccccccgtcccgccaccctcctctagggctttccccctccatcagctccacacccaccgcttgactttgttaaaagggtagaactcgtactgcagggcctgcgccatcttggcgatggcctgcagggatgtgctgacagggagcgcccggcgcatgaggtccaggtaggcgctgcccagcatgcgcacccgattcccccgcccaaaatccatcaccaccgtggtggcaggggcgttggggctcaacggcgccggctgctgggggctgccggggtccggggcgttgctgggcacaggcgtgcgcgccgcagccgcagggaggcgccacgcggggtcgcaccccgcggcgccgtcctgcagcgggctggcgaccgcgcaacgcacgaggggcggcttcaggcgcaccgccctgccgggcgctaggagcggcgcggcccgcgggcggcagtcgcatgccggcgccgccccatcctgtggcggcttgcctccatcctcggtcccgtcgccgaccctaacgctgcgcccgtcggggctgccatacgccgtggcgacttcctcgtccccgctgggcgtgccgcccctggtggtgccgcgctttccgcacttgctgctgccgcccctgctgccctctccgttgcggccatcctcccattcctgtccgtgcggcccgccggtgaccagccgacccatggcttcctgcaggacgtcggccagcccctccaggctctccaccatcagctggtggtaggttgaccgcgccgtcactgggaagagaacggctgccaccagcagctgcagccccacacccaaggatgtggcggccaggcgccagagcgccacgcccggcagtggggtggaggtgttgtaaccgggcagcgcccccagcaccatcaccatgcacgtgatcaggacggtgtagatgtgggccgggtacagcagggtgcaggagaagaggaggcccgaggcgatgctgagtccaagcgtcatcacgatgaactgcgtgcggttgtgcggacggggtaggtgggcgccagggtgcagtccccctcaacgtgtgcccgacccctctggatcgcagggagggggtttgatgcccagcaccagctgccaacaccccaccccttctcgccggggtccggccacgggctggcggggagaccagcgccggtgatcaccaccggagtgcgcggtggcagcccgcccccccgcgggacccacccgttcctggcctctgcagccccagcgcccctgcaaaggtctcctccaggcatgcaccccaccccgacacctcaaccccatccaagcgctcagaccttggccggctcgttgtcgtagctcaggccattgcagaggtaggttatgtaggtgagggcgaggccacaggccacgcccagggtcgtccccatgatgcgttccagagacctcaccaagacaccgcctgccggggcagggaagctggggtgagggccggtgcggatccagaggcacgaggtgggaaggggagctcgaccaggcgtcgatttctgacggggcggctgaggggcgagtcgcgcagcgcgccacgcgcccgaacggaggcaggttggacggggtgggcgggaatgtgctggggggccctgaccgtgcaggtttcaaggtaccccatttgcacattcccatggctagagcaggcagcggcagcatctgcaagggcatgtgccctctctttcccccatcccctggcagccgcaacgccatggttcatgagccaatgccccacctcccccatgccagcctcctccccttgcaaccgcttcccctaccccttcccgattcccccctcagcccctcttccccggctccttcccgcctgggacccctccccctctccccgcgcaccggccacgggctccagcacgttgaagacgaggacaatggcccaaagggtgtgctggctgaaggcattgttggtggtcggcatgatgatcagggccaggatgatgaggtaggccaccgtgccctgcagccccaggcccagcatggtgggggtgacgccggtgcgggcggtcagcgccgccgcccagcgcgcatgccacgcgtggctcgcccgcgccggcggcagcgcgaggggggcgggcgcccgagacccnnnnnnnnnnaatgtcgtgcgcagcggtggccaggccctggggcgtggcgcacgccgcgctggcgaaggacagcatggctcccgacaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccggggtcgcggggcgtggagaccagggagaggcgcgtgagggaaagcgcggcgtgacccaggctgccctcgatccacagccccggcgtcacgccgtgcaggcgccactccgcgtcggggtgcggcgcgaagtggcgggccaggtggcgccgcgccgtggggtcctcggccgccacggcgtcggccaggcccgccgccaggcgccgcacgcgggtgcacagcgtgaagagcgtggacaggac

SEQ ID NO: 35588 - DNA, 264 bp, Chlorella protothecoides
gccgagcggctggccgcgctggagcgggctgccacgtcggcgcgggaggacgccgcggcagtgcgcgacctggcccgtcactcgggcgacctccagtcccagctggcgcgggcgcagcgccagctggcggaggagcgcggccgcgccgcacgcgcggccgcctcccacgaccgccgcctggccgaggcgcaggaggctgctaggcagagcctggtgcaggcgcgggaggaggcggggctcgaggccgccgagctgcgcgcggcg

SEQ ID NO: 35589 - DNA, 67 bp, Chlorella protothecoides
gggcccagcagcccgcacaccttgatgtccttggagcagcgcacctccagggtggcgttggaaccca

SEQ ID NO: 35590 - DNA, 61 bp, Chlorella protothecoides
agcgcacctccagggtggcgttggaacccaagcccaggtgccccggctcgcccggcggcgc

SEQ ID NO: 35591 - DNA, 85 bp, Chlorella protothecoides
ttagtcctctctggctccccaagtcgactatgaagctgcagcctcgagtgcggagctggggcagtgcttgctgaagctaccctgc

SEQ ID NO: 35592 - DNA, 72 bp, Chlorella protothecoides
agatcccctctgtcgtgttggtccccttggaggcagacaggagcctcacacaagccgggcaccctgcactcc

SEQ ID NO: 35593 - DNA, 152 bp, Chlorella protothecoides
tggaacggggggtcgtcaccttgcggctgggctccgcgtcacacccacgaccattcagcgacgcggcggcccacttcgattcttcctttctttcacaaccccttttttgccagctggaccttttcagccgcatggccaatgtgctggtgggt

SEQ ID NO: 35594 - DNA, 77 bp, Chlorella protothecoides
tgagcacacacaacataacccagcagtctgatcgcacttgcccagatatccacaggctgctcaccacgactctgcag

SEQ ID NO: 35595 - DNA, 106 bp, Chlorella protothecoides
ggaggcgggtctggcagctggctgaggtctggcagctgcaatggatggagatttggatgggttggtgagtagagaaagtagtggtctcccagcacgtacattcagc

SEQ ID NO: 35596 - DNA, 147 bp, Chlorella protothecoides
ccccctgggcgcgggaggactggatggcaaaggggggaacctcggtgggcaggggcgtcagcaccgccctcctgtcgcacacccttgggagccaggctgggccactgtcccttaccctcggagatgccaacactccctcccctccct

SEQ ID NO: 35597 - DNA, 100 bp, Chlorella protothecoides
gggaggggtggtggggaagagtgttgggggaagcacccactgcgcgctcgcgatggtcacgctccacctacggtgcctgaccacagtggaggctgccaac

SEQ ID NO: 35598 - DNA, 143 bp, Chlorella protothecoides
atgctgggaacccatggcgggaaggggctgtttcgtgaggggggggtgctgcgtggtgcggggacaaggcaagggcgaacacccgttgcccttgcccacgagctgggcctctgtggctgcactgtggtctcgtgtcacgctga

SEQ ID NO: 35599 - DNA, 63 bp, Chlorella protothecoides
ggtgtcctgcgctggacgcccaaccaggtgatgctcctcctgctccagcatcacgccttcttc

SEQ ID NO: 35600 - DNA, 61 bp, Chlorella protothecoides
agtgatgtgggtcctggagctccatgcctccccccccactgcctctccccccactgcctct

SEQ ID NO: 35601 - DNA, 68 bp, Chlorella protothecoides
cccatactcaacactggacccccccttctcttgcagaaatcgcggccgccatccgtgccggccgcatc

SEQ ID NO: 35602 - DNA, 80 bp, Chlorella protothecoides
acctgacccgcctcaaaaccctggccgagggaataccaaacaacgcgcatcccacccgccggtgcagtgctccatgacga

SEQ ID NO: 35603 - DNA, 101 bp, Chlorella protothecoides
gggggggtgacgacacacaatgcatcagagcctctttagaaagacgtttgcttctccaggtaccggcagggcctgcatccatgagccaagcaatgccaacc

SEQ ID NO: 35604 - DNA, 69 bp, Chlorella protothecoides
ggcccgccggccgcagccccctgtacagccttgtgcgcatcctttgcgtcccgccgagaccgccccatc

SEQ ID NO: 35605 - DNA, 74 bp, Chlorella protothecoides
tcagcgtcaccgcaggtacattgggggatgtggggttggggcccacacaggaggcaagcgagcagaggcggggc

SEQ ID NO: 35606 - DNA, 67 bp, Chlorella protothecoides
aaatccgaccagacaggtgcataggggaagtgggggaaattggcaggaggtcgaggtgattgtggcg

SEQ ID NO: 35607 - DNA, 202 bp, Chlorella protothecoides
cgggccagacaaggcatcgttggccagcctttccaccttcatcggcatcgtggcgctgaacagcaggagctgtctatcgggcatgggggtgggaagtcggagcaatgttggattgagccctctgggatgggaaagtgtgtaagtaccatttgaccgccctgtccccagccagatggttggccagcaagtcttcacccaatgt

SEQ ID NO: 35608 - DNA, 61 bp, Chlorella protothecoides
ggtgcgagacacccgctccgccacggcggccgggggcacccggagccgggccaggccctcc

SEQ ID NO: 35609 - DNA, 61 bp, Chlorella protothecoides
cgtcttcccctccccctcttgcccccttccccccattagtcagccatcagggctgaccaaa

SEQ ID NO: 35610 - DNA, 73 bp, Chlorella protothecoides
cgatccggagatgcaggaagacctgtatggatgggttaggtgtgttggtgggcgggtacgaagctgcctgcac

SEQ ID NO: 35611 - DNA, 117 bp, Chlorella protothecoides
caaatggtagaccttttgcatataagagggtcctgatgatgacctcatgatgctgctgtgtaccttaagattgctgtgccacaatttaagtaacggtggcacacggtgtgtgcgctg

SEQ ID NO: 35612 - DNA, 61 bp, Chlorella protothecoides
atcgggtgcgttgcagggtgggcgcggcgatgcccgccggccgatcaggacgcgcgtatgg

SEQ ID NO: 35613 - DNA, 173 bp, Chlorella protothecoides
cgcgcgtgccgtggagcgcagcctgcgtggtgagtcgggctaggggggccggtcgacggtagggatggcggacggcccccacacgacagagccggacagccccagcacgacagagcaggctcgacggccgcgcacgacgccgccgcgcgcgacgatacgcgcgcggcggcagc

SEQ ID NO: 35614 - DNA, 61 bp, Chlorella protothecoides
agccccgtcatctcctgcaagcagtcggccacctccaggccggcaagccgcatggcaccag

SEQ ID NO: 35615 - DNA, 104 bp, Chlorella protothecoides
tgaacacgccagccagcacatccaagccccgaccttcccttcacgcaccctgccagcatccaccaaaacattcctcccctcccaccctctcagcgcctcaccct

SEQ ID NO: 35616 - DNA, 119 bp, Chlorella protothecoides
gggcgtgtgcaggaagaagcccacctggggttgggcagcgtttcgtgcatgggaaggtgggtcgagaggacgcaggagggcagaggtgtcttgagctgggtcgggcgagctccttggtg

SEQ ID NO: 35617 - DNA, 76 bp, Chlorella protothecoides
tgcccgatcttaatggggacaaggggtgccaagcacaacgggcaagcaacggtgcaaaggaggcactcccggcctg

SEQ ID NO: 35618 - DNA, 61 bp, Chlorella protothecoides
atgacagagatttctccagacccaagctgtatcgctcgggaacacccactcctgatcctga

SEQ ID NO: 35619 - DNA, 61 bp, Chlorella protothecoides
ccacccacaatcgtccaaagtacccaccctcttcaggtactgtgacggactcacgctgaag

SEQ ID NO: 35620 - DNA, 112 bp, Chlorella protothecoides
acgtcgggtacatatctctgcagggtgcactgggtgatcgagaggtctaaatcatgtcgcaatctgaccgccccctcccccaccccgtggcccaggcgtcccttcttccagc

SEQ ID NO: 35621 - DNA, 61 bp, Chlorella protothecoides
atatagcgggttgcattggcattgcacgctacactcttcgaggtcattgtatggtgggccc

SEQ ID NO: 35622 - DNA, 112 bp, Chlorella protothecoides
tgttgggtagaatggcccagggggacatcgaaggccagcaggccgccgccgcggtctcacgctgcagacgggccaggaggttacagcgagccaggtcgccgctgggtctcgt

SEQ ID NO: 35623 - DNA, 70 bp, Chlorella protothecoides
cacggtggtgaagatgttgggcgggatggagaggtagaacactcgatccccccgcttgaagcgcttctcc

SEQ ID NO: 35624 - DNA, 61 bp, Chlorella protothecoides
cagaaccggagcgggtgggcacaggtcgggcgagtggcgcgtggacgacaagatcttcacc

SEQ ID NO: 35625 - DNA, 72 bp, Chlorella protothecoides
agggtatcgcactctgcgacaaggttacctccggtgtgccgcggcgacgatgctatgtgtctcgcggctcca

SEQ ID NO: 35626 - DNA, 76 bp, Chlorella protothecoides
ggcagtatccccatgaagggccatgcccccccgccccccccccaaaaaacaggcttgcagagcccggtgaggtgct

SEQ ID NO: 35627 - DNA, 114 bp, Chlorella protothecoides
tgctggtgccctgggacggaagcattgtaggatggcatcttccaacgctcgctgccttgcagtgtgggcactctctacccccgtgcaccaagattcaccttgacctcaaaccca

SEQ ID NO: 35628 - DNA, 81 bp, Chlorella protothecoides
cacagattaagggggtgagggactgcatggcggctctgggaatacccacgtgcaggccgctcagcccagccagccgacctg

SEQ ID NO: 35629 - DNA, 108 bp, Chlorella protothecoides
gagcgtgatcgagcgtgtgggacgcaggtgagtggggtcgactggaagctacacaatgcacgctggggtccagacagagtcccagtgacggagggcaaaggctacttg

SEQ ID NO: 35630 - DNA, 140 bp, Chlorella protothecoides
ctgggcacggcatccttgcccaccacaactgcgagggatcgaatgcaggcaggcgggaatcgaatcctgagcctgtaacaacgggcattcactctcaaccatacgggcacgacctaaaccaaccgcgtcccaggccccac

SEQ ID NO: 35631 - DNA, 61 bp, Chlorella protothecoides
cccatgccggccccctcaccccatgccgccgccctcaccccatgccgcccccgccccgccc

SEQ ID NO: 35632 - DNA, 61 bp, Chlorella protothecoides
ggtgctcctcctgggcatggtcaccaacctggggggctacttgggcctctgggcggttgtc

SEQ ID NO: 35633 - DNA, 154 bp, Chlorella protothecoides
ttgcatgcatcttggcccttccctgttgttccccccgatcgtgtttcccaattgccccaccttccacgggccccccttgcatattggccccgcccccctctcccagctgctgacctcaaaccccgaccccccttgcccaggcggcaagaccacg

SEQ ID NO: 35634 - DNA, 63 bp, Chlorella protothecoides
tggattgcctctgagagaccaggcatggcgccaggtggagaaaagaatggctcgattcttctc

SEQ ID NO: 35635 - DNA, 119 bp, Chlorella protothecoides
cggcgagggagctggtgcacgcgagggcagtgccgactccaatgccagatcagcagcgttgatgagcgagagcgaggagtcggactcgaatgatgatggtggatccgaaggggccccga

SEQ ID NO: 35636 - DNA, 93 bp, Chlorella protothecoides
agcacttggtcaacatcagtatgttggctgttgcggggcaggcgatatgcctccgtgatgggaacagatgtcgtactttctgagatagagttc

SEQ ID NO: 35637 - DNA, 66 bp, Chlorella protothecoides
cgacggcgggcatgtcgtcttggagaaaggtggcgttttcgacggtgcagaagggttcgcagactg

SEQ ID NO: 35638 - DNA, 124 bp, Chlorella protothecoides
tctgcaggaggcaggcgggcagggcctgaagggtcttccatagatgcgtgattttccggtcctggccgtgctcctgtcaattcgccaacatttcagaatgcatgtataccttctgccagccaaa

SEQ ID NO: 35639 - DNA, 62 bp, Chlorella protothecoides
aggtttccatctggagtggttgagaggggggtggcaggcccgtcgagggattgagaagcaga

SEQ ID NO: 35640 - DNA, 123 bp, Chlorella protothecoides
ccccctgatccagcgtgcctggcgaggggtaaaaaggaggtggttgtgggagatcggttgagcctctgcgcagagggcgtgctctcccctgggcccggccttcgtgccagggcctgatcctgc

SEQ ID NO: 35641 - DNA, 72 bp, Chlorella protothecoides
catgcctgtgtcgcagcccccgccctggtctaaattatttgaccctcccctccccgtgccaggcctgggtcg

SEQ ID NO: 35642 - DNA, 77 bp, Chlorella protothecoides
cgtctctccaggcggtcccggtgagcagggaccattctgatataagaaggcactcccgggtgcaccggccatcggtc

SEQ ID NO: 35643 - DNA, 61 bp, Chlorella protothecoides
ggggaggagaggaggtcgggaacggctgggttgggggagcgtcttggtgcgggaggggatc

SEQ ID NO: 35644 - DNA, 61 bp, Chlorella protothecoides
aggcgatgaataaataacgctcggcagtaattcatgaagggtcatctagatacatggaata

SEQ ID NO: 35645 - DNA, 61 bp, Chlorella protothecoides
cgcgaagtgcaacgtctgggagggtggtatcttctcactctggtccaggttgccgggtcgc

SEQ ID NO: 35646 - DNA, 73 bp, Chlorella protothecoides
ccacatccccttctcaccctgtgctcgatccagcacagccagggtgtgggagcacccctgccgcgcgccctgt

SEQ ID NO: 35647 - DNA, 139 bp, Chlorella protothecoides
tccagggccgaggtggcctcgtccaggatcagcacgggcgggtcgcggatcagcgccctgcggttctcgagcaggggggaatgggtgtgggacgagaggctgggggggcggcgaaggggcccgtcgcaggcttcgtgtg

SEQ ID NO: 35648 - DNA, 204 bp, Chlorella protothecoides
agctgtgcaccgccttcttcaccgtcaggtgttgtttttgttgtttaagagatgcctggggtgcagagcagggtttgtgctttgctttcacccaggcgccagcacgatgtagcattcctctcagtgccacgccctacactggcactcccctcttcttcacgcaccctctggttggccccattccctcccatgccctctcaaccc

SEQ ID NO: 35649 - DNA, 66 bp, Chlorella protothecoides
cccccccccagggcatgctgcatgtcacggtgtgccctcgagctgctgcaggctcagggacagctg

SEQ ID NO: 35650 - DNA, 61 bp, Chlorella protothecoides
cggtgcgagcgtgtatgactggagtggctcgtgcagatggggctgcactacctgttccgcc

SEQ ID NO: 35651 - DNA, 518 bp, Chlorella protothecoides
  modified_base (97)..(297): a, c, t, g, unknown or other
cacggaagtgtcaacgtcaccgcgggagctccccatccggtgtcacctgaattcatccttcgtcggtcccggaagacgaggcacccggcgaccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccaccatcaatctgaaactcaggtactcgacattcagggggattgatgtcctcaagcctcgtccagcaagctgggcatcgttattcttcaagccggcgctgaactctacctatggagagagctgccgaagactcatcgcaaagaattgtccgaatcgcatttgaaagctacccatttctgaaaaccatcccgcagatatcgacgcaccggcaatc

SEQ ID NO: 35652 - DNA, 259 bp, Chlorella protothecoides
cagagacgcgtacagcgccgccaggccggcgctgtcgccccgcgcaaccagctcgtcgaccctcgtcgccagctccgcaccgtctgcccgtgggctctcgacaggcaaggcgggccctgcgggctccgtggccctgtcctcggtgcagggacgcttggccggcggggggcgggggtcctctgccggccgacccggcgccgactggcttggcttggatgctgccgccccatctctcccgccggcaaccacacacgcctcg

SEQ ID NO: 35653 - DNA, 61 bp, Chlorella protothecoides
gttgcatcggtgccgccgttgcattggctgaccttgcacccagtggacccagcggaagcct

SEQ ID NO: 35654 - DNA, 97 bp, Chlorella protothecoides
tgctcacagcatgcgcagcacgcctcacatgcaaagtatggatctctttgtgttccttggcggtcattgccgtatttcacgaggtttcagcggatca

SEQ ID NO: 35655 - DNA, 69 bp, Chlorella protothecoides
aagactgctttgatggccacattatgatggtataacgtaaatcccactcttggtgtggcaacatgtttg

SEQ ID NO: 35656 - DNA, 77 bp, Chlorella protothecoides
gcctgggacgtcctggagtcggagcgaccacccatgtagacctgccgctcggcgtgaacacctatgctacaacatta

SEQ ID NO: 35657 - DNA, 72 bp, Chlorella protothecoides
cactggcaagtgtgcggacgtggggaggtgactgtgagggcggcatggctgctagaatcaagagaacggcgc

SEQ ID NO: 35658 - DNA, 104 bp, Chlorella protothecoides
tccgcctgagcgggcgcggcgcccggccccatggagaggaggccccctccctgaggagggagggaaggctgcgaggtgggccggctcgataccccgccagccac

SEQ ID NO: 35659 - DNA, 114 bp, Chlorella protothecoides
ccgcgagatgcaatgtgtgatgtgcctcagcatctaacaagatacttgaatcgctctctttataaaccagatatacatcgcgaacgcctgcctgcgtgtcctccgaggcagcca

SEQ ID NO: 35660 - DNA, 61 bp, Chlorella protothecoides
gcatgcacccccatctagggccaggtggatacccttgaggggccgccagtctccctccgtg

SEQ ID NO: 35661 - DNA, 66 bp, Chlorella protothecoides
gggctcatgtgctgagccagccgctgtgtggatgtgggacgcacctcaacccatgccactgcgcat

SEQ ID NO: 35662 - DNA, 61 bp, Chlorella protothecoides
gagggctcaggagggctcaggggcggggggggtagcatgcttcacactctgtgtgcgagcg

SEQ ID NO: 35663 - DNA, 103 bp, Chlorella protothecoides
tatgctcttgctggtcatcccgccgtctcgcgctctggaaggtccccccacccttgcccccaaatcctccctccccctctgatccaccagggccttcaaggcc

SEQ ID NO: 35664 - DNA, 69 bp, Chlorella protothecoides
tcactcccggctgtgccatatggattgctgccaacgaaaatcaagttttgcagtcacctgggaggggct

SEQ ID NO: 35665 - DNA, 157 bp, Chlorella protothecoides
gctctttctcgatcactggcctctgccccctccctgtaagcacagccttcgcatgagtggcattccaagttcaagctcgaggggttttgcaaggtttcttgggaaagtgctgcgatgcagctctgccagcgccagggagagacgagaccaggactga

SEQ ID NO: 35666 - DNA, 61 bp, Chlorella protothecoides
cgtggatggcaatgtagctggacagccccgcgatcacaccgtctgcggcggcagcgggggc

SEQ ID NO: 35667 - DNA, 61 bp, Chlorella protothecoides
cggcggccaaggggcatgtccaggggggggggcagtgtcatttcctgagatgcagcgatgc

SEQ ID NO: 35668 - DNA, 61 bp, Chlorella protothecoides
caggaccacgacgatggggacgaacaccgccgacacgcggtcggccagggcctggatgggc

SEQ ID NO: 35669 - DNA, 61 bp, Chlorella protothecoides
aggatcagggcgaaccagtagacatgcatgaccaccaaggagaggaggaaggtgttgaaag

SEQ ID NO: 35670 - DNA, 62 bp, Chlorella protothecoides
ttgcaatcagtgtcgtgcactgtttggtattctgtattgtcatgtcgctcgctctcttatcc

SEQ ID NO: 35671 - DNA, 61 bp, Chlorella protothecoides
tttggtatgtagtcaatgcgtgtggcagggtatgggggtccggcctggggttccggggcct

SEQ ID NO: 35672 - DNA, 78 bp, Chlorella protothecoides
cgggtcctgtgagggggaatgtgggtgtgtgcagggtccgtgggatggggttgaggaggtgggaggtggacagcctgg

SEQ ID NO: 35673 - DNA, 75 bp, Chlorella protothecoides
tgtgacaagggccagctctctggacacacacataagccgattgcaagtccaagtaatccagcgctgtcaccgccg

SEQ ID NO: 35674 - DNA, 145 bp, Chlorella protothecoides
cgccagctgcttgatgcttttaccatgttacctacaactttccaagccaacacagccctttttcccagcaacaccaatctttcccttcccctcccttgacacttggtggtacaccgtgctgtgcatgcacaaagtcagtatcgtg

SEQ ID NO: 35675 - DNA, 689 bp, Chlorella protothecoides
  modified_base (159)..(339): a, c, t, g, unknown or other
  modified_base (432)..(628): a, c, t, g, unknown or other
acaggtggggaggctcgtttactgtggtgtggggcaagacctgcttgagtggaggtgtgtgaggggttgttttgcatgagcacgatggaactccccccagtggcatctgcatgctcatgaaccttcctctccccatgtcactgcaccgctgcaggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcgctctgtgtggggaagggtgaggggactcccctgtgatgcatggcggcgctcttgctctgaagacggcgttcacatgctcgagacgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgcgttcagcgaggagaagctcagctccgagtagggtgcaacattctccatgccgggc

SEQ ID NO: 35676 - DNA, 80 bp, Chlorella protothecoides
gctgcaggtggggcgggcgggggaggcgactgatgatgctgatgcagctgtgccgtggcagtgcagccgtcgcggcggtc

SEQ ID NO: 35677 - DNA, 175 bp, Chlorella protothecoides
tgaacagtaaaccacttcgttacccctgcttttgtgccctgcattgtcttgctaacttcacgccttgagtgatgcgtcgttccattcctggttgaatgtgtgggcttgcgcataatcctgattccctttgcacccacccgtcagcttggtgattgtgtgacatgtatacattcaa

SEQ ID NO: 35678 - DNA, 16158 bp, Chlorella protothecoides
  modified_base (137)..(230): a, c, t, g, unknown or other
  modified_base (11285)..(11294): a, c, t, g, unknown or other
gggcgcgctgtgcgcgttgacgcgcgcgctggcggcgcgggagcccgagcgtgcgctgcgcatgctgggcctgctgcgcgcgcagggggtggaggcggggccggagacgctggccgccgtggtcggcgggcgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggagggcgcgcggggcgcgatgtcgccaccaggcttgtcgtcgcgctggccagggcggggcaggtgagggacgaagaagagggcgtgggtttttgggaagtcagaggggtgtgcaggtggctgggagtcgtaggtcgtgtattccctgtttcaggacggaggaaggactggggctgttgatttcatggggtaccaggagctccgtacagtcaatgaagtgtcaaccacattccctcgggaaccccctcgcattccctcccatgccacagctggccgaggcggaggcggtgtgggggcatttcattaacgaggcgcagtcactccatgacaccggccgtcaaggcggacttgcagcaggggctgggagttcagacgcatcagcaagcgaggatggggccggcgctgccagtcgtccccccccagatgtcatcccagaggcagccagccgcgatgcaagtgccgtggtgtcaccaccaagcaggcagctgccgggcgccagcgcggccgcggccctggcacttgcctgcctggagacccccggccacctggccgacggctgggcctacttccgggccctggccgaggagtacccgcccgtcgcccaggcggcgacgctgctgcccttccgccgcgcgtgggaggcggccgccatggccgcctgccgtgcggggcggctgcaggacgcgctcctcgcgctggatgcctggcaggccgcaagcgacgcgtggcatgccgggcggctgggcagggaggagcggggccaggaaccaggggcggacagcgtgcggagccggcgccggagccggcgcctggcggacctgggcggcgggggggcgacgatgcaggggcctggcgccagaggcgtccaggatggggccgaggcgaccccagcggcggcgtctgagggaagcgatggcgctgaggcgggcggcccgacaggaggtggccacgaatcgccgccggcaaccagtgtgcccgccctcgcgcccaagcctgtgcgcctggcaagcagtgccgccccgggactggcgcgcgcgccgcgtctctccagcgcgaccctggcctacctggcggcctgctgccacagggcgcccgcaggggccgagacggcgcgcgtcctccagctctgtgcaatgctgcgcacccgacgccaggaggccatggaggccgcacagccgcacccgccaaagcgctcgcaccacttttaccaggatggggccctgtgaagggcacgccacgcacgctgtgcaagtgctggcgcttgggatgtcggctgtactgggaattccctggacacacctgatgcagatcgattgtacagacaagccaatcgccaagcagcacatatcagaactttggagcaacaccgacgccaatggaaatggcaaggggcgtgcgccccgcaggggttgaaagaatgctagtgtatggcaaggggactgcagtgggtggggtcaagtgaaaatcccaccaagcaggtaattccagcatttgtggagccagagttgcgagctctacaccaaggcaatattttgaggaaccgcaatgggttctgcggctcaagccggcaactctggcggcaagcaagggcgttgacaaccccgtccactactcctcagctccatcaaaggcacctccttcctcctcctcctcctcctcctcctcttcgtcctcatccacgacatccaagtccgcagcaatatccaccccttcctcctcttcgtcctcctcgtcctcctcatcctcctccccgagcagggcaaaggcgccgccggcctcctcgtcgtcctcggattcagcctcagactccgcctcggcctctgcggccgcggctgctgcgtgcaggcgcacctcttccgcatctgcaagggcctccaggtgctgctcggcgacctccggcagcgccagctcagcgcccggcaggatctccgtcaggaagtccagcccgatccccttgaagctgaggacaaatattgaggggggcattagagagataataatgacaggctggagcctcagcagcagcctctgcgcagagctgatgagagaaaatggatgacacaacgaccgataaggcagaaacctactcaaacttgtctctgccgaggcaccccatttcctccttgcactgcctccaacgccccgctggctcaccgctgcagctccttcctgcgctgggaggcgctgggtcggccgtccaacccccgcacctgatccctgtcctcataagaatcctgggagtgcgactggtcatcgtccatctcgctctgcacagcgtctgtggtggttgggaaggggtggaaagcgggacttggaatgcctcctggcgatagacgtgccaatcaggtgatggctttgccccacacccgactggacaggtctctcagacctcccctgctggatctcgctttcatgtctacatcacagatgatcaaggactccagaacccagccttccaaacaaatcataaacactcacatatctcttccaggtgctcgttgaccatgtcctggaaggcatcattggcgttgcgacttatctcagcctccgcctcgcgcgtctctggagtgcgtgggcgggcgggagggggaggggtttgggcatcgcatctgggcgaggggcatgccccaagaccaggcattagcagcacccgcgtgcctcactaatcagcaacaatgagtatgagcagcccaatcctactcacccttgttgatctgatccaggttgtcgttgatcaccttgacggcccgcatccaggcggggaggtagtgcttggggtcgtggtccctctgcggccagcgagaggaggaaaggaggaatgagcgttgagttctgtagaatgatgctcaaagatcagccccacaattgtcaacatcccaggatcaaaggagagcagcaccgcacattcatcagcgcatcctctgcctcgatttcctccaggacctcggccattcggtgggtgatggcaaatctgggggagagggatgtgaaggtcgttggagtgttgatgagagggaggcatggcaatggcagctgagcaggtgtaagacctatgccgtagcctcgacagcctgccaggacctcgtgaaatttccaccccaaacacacaaactccagatgctgtgctgcatcccgttaccaccccagccagccacccagctcacttgttcacgcagcggttgaggttgtcgtggtgcagggtcagagtctcgtcccacgccttctccatgaggtaatcctccatggccacgtcctccgggtccgggtcgtcaaagagggtggagtcctcgccctggacgccccggtcccagccgcccggggacgtggggaatgggcccggcaccgggcctgtgttggggtcctggggcagcagggagtcgtcccaggagctctgcagcgtgccaccaaacagctggctcagcccaccagaggtttggtcagggccgccggccagtggcccggggttggagaagcccgaggtgtccaccaaggactctggatttttggaaagagggagtgggagggcttaggggaggggcctggcacaagaagctaatgctggacaagcatattcagtgattgatggtctcccttccaaagctttggacaaacaaccggcatcaaggcaacgaagagagccaggaatgaagcagaagaaggggcgcagagatgttccctggacactgatgacaaaggtatgcaacggccggcacaggaaaaggggctgcaccatcagaggaacgactggggacggcatgcagggcaggccgaccccagcggagcctcccatagcacgcccgtgccgggccgcaaggctgcacacttgtctgagggactggctggggtggaccggggtgcctgccaagacggtaggagcccacagcccatgccctgccgttcatgtcccaggattgtaacggtcttgggggatggagtgcccacacaagccctgacataaccctggaggatccggggggccaccctcctgtcagcaagcctgtccccccgccccccccccttgcccaccatcgccgaacagctgctggtcggggtcgggcatatattgcgatacttctcgtatgtcttcactggagaagaactcgtcgaatgaatcacggtcatcccgggccttggcgccgtggacgaggcgagggagaatgtggtggcggcagtgcaagctcctgaggccggggttgatgagggagctatcagcgctgggatggatgcacattatgggagtacttttaacaatgacaatgcaaagagcgatgagcacctttgtggagcgatgaccaggcatcgtgagctggtcgaggttccgagcccagagaggaccctcatcagcagccacgcgacctctttagggaggttcttattgtccttggtgagccatgtattctttcaatatggaatattgaccttcccttggcccaatattgcggtctgggtgcaggctgtaaatccgaagcgagtcgtgaactggaaaggagagcacgagccaacagacttcgcccaaaaccgagctcccctgttgacaggagcaccgaaatcttacagtgccctcacgactttggactatggtgcgaactgcacacatggactgtgtggtgccccattcttgttgttctgcacagagcagtatgatatcaattgactcgtggagctcattaacattccaggttttcatgccgcaccttgacctgttcttttgtcggccttgcagaccactcttcattgcattttcgagtcctgacattcgttttggtgttgactccaaccccttgataacaatgtgttctcaacacctccttgtggcacctgtttggtctgattctactgctctcacacaggtcaacattgaccttggcggacaccttaggcatcataggggtacactgtgcgccctgtggtggcgccatcgtccacatacccatcagaccgtagcttctgcccgctcacatccaccatagcggaggtgaaggccaggacagcccccgcagcaatgccgactgggatgcggcccactgtgtgacaggagtgtgtttgcctggagtcaggaggatgtcaataagacgggtaccatggcggaggaacaagcacctggtaacaggtacccatcgcccaacggaacccaaccagagtggacagaccacatatctacaaggcaacagcatctcgtccgctgactcacttcggattcccaggactccaccagtagcaaggcccgcgagagatccatttacccagtcctgcttgccacgaaggctctcagccacgcactgggtttgcaaaggggatggatgaatgggtcgtacggccccagtgactttggcggagggcacaatacagctggggatgaataaccaagcccctcccctgtcacaagtctcccacagcatagggtggcacacgcctcccctccttacgtcgacagcgctgtacgtgaggcccactacagccagggtggcgccgtagttcaccatgacgttccccgtccggagcagggcgggcaggggcttgttacgcagcaccagtgggatgtctccccagttggacgccacggcgcccaggaaggcgcctgtcaccgctcctgaggctacacccatgccgattcgggtggcacagtcctctggtcggtcgctggggaaagacatgcctgcggcccgggagagaggataggtgccgctcgcacgggggggctcaaccagagcgcccagtgctcgtcacaaacaatctttgagtaaaaccctcacctaaggataactgctactatacgctgtttcgattccggtgtgtatcctctggccggcgcccttcgcggtgccttgagggaaggctggactacccggccctgaggcttcgccactgcaggcaacagcggtttcagcaagcccagctcctcaccagtatagagtcaacagggtaacgacaccggtgctctctgtgccatcgagggattcgggttgaggttgccccccttttttaccggaccacggaccacgactgtgtcaagggggggcgtcgatcgcaagcaagaaagttggggtcaatgatgtgtggggagggtcccgtttcactgcaccaaagatagacattcaaggtccagaaggtaattcattacgataattgtagtgtacagacagtgagtgcaatgtgcaggaaatctggtcacaggatgtgtacaaccttttgtgagacatcatcagttaaggtctcttctcttccctggaagtgaatttgaatctgaactcatcttcaatattggcaatatgggcattggctatccttggaccaccactgtgacccccatttcttcctcctctgccatgttcttcctcagtattgacagcggtgcttagtcatgcaaccaatgcaatgccgggaaaccctcatgatttatactccatgtatctgcgactgccaatgcttgagcgaggtgatatagagtccagctaatcgcaaagatatgatgtggtatagcagcacaacctgatcgctgcctgcgtcatgtccttcatggtgctccggactatgcgactgccgggtctggcagcccgatgcgagcaggggatcacctcagggaccctcaaggctgcgactagggctttagaagaagctgtcgctgccttgggactgcgtgcgactcagggaactcctcgccctcccccaatcagctcaagggcattcgccagccagcctcacagcgtccctgcgccccgatcaggaggtaggtctcaccctctttggtgcatgcaccgcccctactcattgtgaccacctgctgtagcattcctacccaacttcctcagagcaggcgtggccgctcgcagcgggtcggggtccaggaggaccccctggtcagcggccctgctgggcatccccagcctcttggcggcctacctgggcaactggcagctggagcggcggcagtggaagatgaggctgctggaggagaggagggagcagctgctggcggagcccatcgacctgtttgcggtcgatgagctgccgcccgagtactcccgggtgaccctcacgggcacgtacgatcacgccaaggcggcctttgtgggaccgcggggccggccctccagtgcgggggtgacggagcaggtgggggttgcggcgggttgtcctatggctggggtgcgccgggagtgtggccgctgcctgcttcacggccaggcacggccatctccttgcgagctttacccgtactcccccccaaaacgccgcagagctacctggtcgtcacgccgctcaccagcgcagacggcaagcgcacggcgctggtgaataggggctgggtccccctctcctggcggacagacccagaggaaaggagggtcggagaacccagcggacaggtgcctgggaccggaggtggggggggcggcccagcaagggtctgcttgccgcaccggtatcaatgggcgcgtggccctgtagtcagcacacacctcgctcgcgagactcgccgcaggtcacggtcgtgggcgtggtgcggcacggcgagcgagccggccagtttgtccctcccaacgacctggaggcctgcacctggtactacgttaacaccgctgagctggcgcaggctgcggggcgggacgccgacacgccgctcgtggaggccatcctgggtgagggtggtcggcgcggcgcggggctatctgctgtggtcaggggtccgggcgcgtgggggaggggccagcagggggcggggtcgaagtgcggactgctccagcacgtcgccctgttgggatgaggagtgcgagcgagagcagccattcactcacacctcggcggtaccatgcctgtgcgcccctccctccagtccccgcccgacccctccgacacggttgcgcgccgccctcccaacccccgacagccgcagacgcgcccaccgtggtcaagccgccctcggccatggaggtgctggggggcagggccaggagcttgccggccgtgcccgatgtcgtgcccctgcccaagaccctggacgagctgtgctccttctccgtcatgccgcgcgaccacaccaactacgccgcgacgtggctgaccctgtcggccgccacggccgcgctggcggtcaaggccgtgcgcggcacgatgcgccgggcctgaggctgcagtacccggcacgtgcggatcatgccaggctctgctctcctctgaaacgctgtcccctctccccgtggtcttgtgtccttctctgctcctgctgtgggatcccctttccaggtgccggtgccgggtcagcgcccatcatcaaaggtgcggggggtacatgccgagcgcggcgcatcagagggggtacatcgtgccagacgccatacatgacatgcagaggggaggcggctgtggtcggcgcaaacgcgtccgcaacgtgctcgagccccggcggctgatgactgatcatctgtcagccctgcgcctggccgatcaggtcctgggagggcgcggcatcggccaccgcctgtcgcacctcctccgcatcggggatgacggcctggtcgccggccgcggtgcccgccgcctgcgccaggtccgccgggaagaagccctgctcgccggcgtccggctggccgggcgcgggagtggtcgcgacaggcagtccagcgcccggcgctcccgggctggtctcgtacgccgcgccctcctcctccatgggctgcacgatcccggtcagcgtcagcgctggttcccgcgccggcgccgcgccctccgtggcggacgccaggaaggactcgtcggtccgcgactcggggcgggcggccgcggcggcgggtgcggctgctggcttgctctcctccccgccgccctcgccgaagccatccacgtccatgggctgggagggtgccgagccattacggtccaccagcgcgacggtgggcaggcccaggtcaaccggttcctggtggagaaggaagtgggggttgaacgtgcatgtttggtagtggtgaggctttgagaggtgcgtagtcgcagccatgaagggggtgttgagtcagacctctgggggggcaaaagaggtcctcttacaatccccttacctccttgggcctcacaggcaggtctcgggccggctgcacatcctcatcacctggtttggcagggggggttgcaggtgggatcaggttgatggggacatggtacatgtgttgcatgttcccttgctgtgaacagcatccgctgtgccggctagtagactgaagtctctccttccaggcccctccatccagatacaaagcacagtactgacccgaggcgtaatcgttatcgtgcgccacgcgcttgtcatcgtacgcctggcccccacccctcgcgtccatgtccacctctggcatgtcgggctggggaggaaagggagggtgggacgagggggggggggacgatgcactgacgacggcgcgtccgtcggctgcaaattgcacgcctggcccgtcactccctgcctggcatccaatcattgcagcatgcacagtcaaccaggcaatatcgacacaaaggctcctcaccagctcggtcttgggcgggcggggggccatctgggccgagggcacgggcgggagcaaggccaggttggccagaacctgcaccttgatgcgctccagcgcctcgcgcgtgttggtgttcttcatgttgctcactacgcaacatcggtggggaagaggtggagggcggtggagggtgccctgtggggcaggagtgagcaccctgctcgcgccagccacacacaggaacacccgcagtatgcacagcgtgtggcttgcgccccacctgcaatgcgcagcttgtgcgtgtccatgtagtagtcgtactcccccagcgcgggctcggggatgctgtttggatggggaggggggggctgtaaggagggcaaagggtaggcatgaggctgtgcagaatcccgaaaatgtgggaccaggttggggccaagcggcgcgatgtgagctgctggatgccttgcagcccctcccactggacacatcgccgaccaagagcagctgtcccgttttttcgatcttgagctctatggaaaatgagtctccaactctaatgcacgagccagaaccctgcgcaccctgctaccctccaacacagcgacatcctacactctcgtgccgcccaatccccccaatccccaacgctcactcgtcatccagctcgacgcccagcagctggccggtctcgaagcaccagcagcgcgccacgttgcgcatggtgtagccgccgccgcccagtaccatgagcgggacgttgtaccgcgccaggaactcaatgcagttggaatggccctgatggggcggggagaggtgacggggcatgcagggtgggggcagggatgaggttgcggcaatggaagctgtgctgctgagacacacggaatgtgagcccaaaacacacaggtggccatgttctcggtgtgctcctcagggccctctgagcccaagcccagactcgatctcaaaaccccagcaccccacacctgcatggacaggttgaagcagcccagcttgtccccggacagcgagtctgcgccgccgcagaccacaatcgcgctgggctggtacatctccatgacctggggcgaggatgggggcagggcctgagagatcacggttgcagcttcagggtgcagagttggggtgcctggccagggagaccggtccaggagggtcaggcgctccaccctggtcagagacagctcaggctgcaacatgagcagctcgtagtagcttgtatgccgggcatgcaactccctcctcagactgccctgtcgcccacacaccataccacagcctctcctcccctcaacagaatccagtccagcccaccttggccatgatgggctcaaacacgctcttgtacgactcgtcatccatgccgtcgcccagcggcacgttcaccgcgtagagcttgccaccgtcgtgcccgatgtcgcccacggcgccggtgccggggaagaagtcgccgtacttgtggaaggagacggtcatgacgcggtcggtggtgtagaaggcctcctccacgccgtcgccgtggtggnnnnnnnnnngtcgatgtctacatacagaaccctgcggtgtttgtttttgtgtgcatgcgagtgtgggtgtcgatgcacgttgcgggacagggaggcagggatgatcgaagcctgcactttcctgcgacctctggcatgcagtgaagaagaggcaacaaccaggcagagagggtctgtggcgggcagcgtcccgtgcccagccagaaacttccattgcgtggactgcggacttcccctcgagtcattctcacatgagaacaacacaacaccctgcagcccttacctctggtgcgtcttgaggagctccaggatgcccaggacgatgtcgttgatgtagcagaagccagaggcctcgcccttcttggcatggtgcatgccccccgaccagttcatcaccaggttggcctggccgtcgttgatcatggccgccccgcccaccgagcccccgctgtacatctggaatgagaaaggaggggaggaggagagttcaagtgtgttggccgtgcttgggattggtgtgtagtagtgaacagaacagagggcggtcaaaagtaacaggcaggcacctgacagggttccccgtctgaagaacaagagggcactgtgtgccgagcctgagcgcaccctgaagtactcaaacatgccgtcgaacacagggcagtcggcctcgcccacggggccgaggttgaagcgccgcatctgcatcatgaactcctcctggttgtccggcgtgaccgagttgaggaagtccacataatctggagggccccggggggccgagagggggggtggatgtagataactcgcgcacgggctgcaggcctcctgcttaggttgcatggttccacactcacgtaggttccatatcatgctgctgggcatgtctgctggaatgagacacccgctcgccgacaccccccggcgtaccgtcagcatggaacagcatgatctcctcacgggtacgctccaccggtcgcagaatctgcatttgatccgtaagaccatacccattcaccagctgtgtggtgagcttgacgcgatgcggccgcatagggttgccccccccgtagttgtagttggtcatctcctcatcgtaaaagtagacgcactcgcgccgcttcacagtcgccattctagtctattgtcgactgcttgaccttcgggctgcctggagcgtggtcgtgtgggacttgacttcggctgcctcacaggtggggatgcagcagggatcaccagagcgaggtacggcggtctcgaaccggtcgcaaaggtcttcctcaggcgctaacactcgctaaaacaaatgacgcgctttggtctctggacggccccgccgcactgctgaacacctgacggatggtggttcgcaggaggattttttctcttccgtgatttcccattacataatgtattatgcaactgtgcattaatttcccctgaaagatcttctaggagcctcagtgatctgttctcgtgaatgagacctaatgttgctcctctgagggcgtgaatgtgcccagcattgcccactgggactggcggtgcaggttgttgcttcgcatgtacctgttgcacagagacaataccaaagtacacacttttcaccccttggacggcttcacggaactgcatatccatattcctaggtcttgggccgtcagaaagccaagtgacaagttctgcagctctacgtgaccgctgagcaggtcgcaccatgcctgttgtggagacgcgcgccggcgcgtaatcgcgccatgctgttacactctcgtcgttgcccgacggggccccgggattcgcccaagaaacccaggggcacctcagaaaagctgtcaagcgaagctcccggccgcattctccaccccctcgtcgtgccatgctgacaaccccgcatgctcccctccagggtgtggcacagcttggtgtcgaccttctggcgtgcctctctctcgcgcactgactctgagtcgagtgaggcggagagcagccccggcgccatgacgcagctagacagcattctcgatgggcagcctcaggagtcggtgccggagtccggggacagggatcaccaggaggaccaggagcagcttttatacggtgcgcaggggtgaaatttcgttacattcaatgcccgctcgcgaatgcatgccgctctagagcagctgcccggcattggagcggagcgcctgatagatgttcctgcctgttatcctgtcgctgatgggtcctgggtgtgcatgctgcgtcgcgccggggtcctgctcacgcctcttccccatggtcctgcagaggagcatgccgccagggtaaaggcggaggccgacgcctcggcagcccagcgccgcttcctggtggccagccagcagatggccgaatacctgggtcaaaaggcggacgacacgcgcgtcctggcctccgaggccgggtccatccacagcgccgcggcggagtcgggcgcagcgggcgccgccctggcccccaggtgctccgaactcgccgcctccctgcaggcggcggccgtcgacctcgacaccacggctggccacttcaggaccgagtgcgaagccaccaagcggagtctgtcccaggtgaggcttgcctatgcttttgtagggcagctcatcgtgcatggggtgcagtgaaagacttcccctgattgttcgctggactggcgcatgcatgtcccatgctgcaactcctgtgcaggccaacctgggcgacgccgcgggtggagccatgagccccaagcgcatgcgggaggcccaggacgcagcccgggagggtttggaaggtgcaggggaggggggctgcaccggccaagaggaggcggaggaggcggaggaggcagccccgcagggcaaggtcaggcggtgcaccggactggctgggtgggttcgccggtgatgcctcctgttgcatgctctgagttgtggccctttccaggagcagctggtctggctcctcatccctgacctctgcccctcccccacggcgcggccccctgcctcaatcccccacccccaccctcaccagaacccacatcaccacccgcctgccctcctttccatcaggctggcgccccgctgtcgggcctgacgctgcacgacaccttccgcgagcgcgcgcgctacatcccgctgcgcctggaccccgaggaacggcgcctgctgcgcctgctggaggctgcgctgtctgtctccgagtacaccgaccgcgtagacgtgctgagctggcgcagcaagtccgcgcgcgtgcacgcgcaggtcaaggacatctgcgccatcctgtgcggcctggtggtggcccaggacttccgccgcggccagaagctgatcgtgcagcgcgactttgccgggctggccaccttcttccaggactgcttcgaggtggggcgccggcacaagatcatgaacccggagaagatgcgggacacctacggcaagctcatgtacatgctcatggacgcctcggagccagagatccaggagctgctggagttcaagtgggtcaaggctgggggaatgggagaggggctctgtcttggtcagggggggggtcgaaggaaacgctctagaggcgttgatgacatggccggagccccgtgagagggcagcgggcaggtccagagggttttgtatctgtttaggctgtctgtaccagcatccatggagtgagggtcggaaggttcctgcctcgccacctgctgcaaagtagaccgggaagcagggtgacctctcagctgcccacgttgctaacgccaggcgcgaccctccctgacattccctttggtggtcaccgatgcccaaacactcgctcctcccctccacagctgcatacggccgctgcggacggtgtacacgctgctggagggcgccggcgccctggccctgctggacgatccgctgctggactgcgcgacagcggagatccacgcgtcgggcgtgccgcggcatgaggtccagcgccgcatcaaggtggcttaagaaagggggggaagtggtgtgtgctgaaggccggtgttgaaaggggcgacaggctgagggtgggggcgcgcttgagccatcacccgattcgtgcctggctgccctctggaggcagggaaaccggcgatgcccttgccggcctcacccacgcccccccgtccccccctaggccaaggagcgtgcgagggaggtcctggcgcggcggcaccgctccgccacgctctccgaggacgacgtcctgcgctgcctgtactctatttctgacaacaacacgtacctgcttttcaatcgcgaccccgtggacaagtgcggagcatgggcgggtggcggatggcgcaggggcatgtctgtggcattgattgtagaccgggtcgggacagaggggggtttcttgagtatggagcacccctgtaatgctcttgcatggctcacatgagggcagtcagccatcctgggtgcagccgcggccgatgacacacccgctctcccctcggcaccccattccccaggatgatcgggtacctggaggcgcacttctcccccaagaaggcggagccgggggccagcctggccatccagggcgggtcgcagggcgcgcgcctcacccactcgcatgaacgtcagtacacatacgtcctgcagagcctgacgctgtggcgcgagatctcccacgaggtgagcttggattggttgcagatgggagagggctgggagggggtgagcttgttcgcgggcaccgggagaaggggcagtgagagacattccagggattcaagatcgtggcatgcccccaaggtcgtggccccatagctactgcacggctcccccaccaagaccctttcctctttccctccttcccctccacccacccacccccctctggctccccc

SEQ ID NO: 35679 - DNA, 136 bp, Chlorella protothecoides
agccgatttttgaatcgccaagttgtggggtccagcccgcccccacaacattttggtatcggaaaacaagttgagatctcgtccccggggctccaagccctcctcacatgaccgtgttggtcgcgtactctcgctg

SEQ ID NO: 35680 - DNA, 63 bp, Chlorella protothecoides
cctcaccaggccgaggctgatgctgggctgcgcttggacgctcagccagacgctcctctgggt

SEQ ID NO: 35681 - DNA, 78 bp, Chlorella protothecoides
gcggctcataacacacctccctctcggcgctcatgccggacacatcagcgtttgaaagtctgacataagatagtcaag

SEQ ID NO: 35682 - DNA, 202 bp, Chlorella protothecoides
cgaggagggccctctgggatgggcagcgcagtgtgttggtgctggtgggggttgactttgacggaggtcgaggtcaaccctggcgcccagccgatcacagactccgaacacccagggcaccctcacctggccagcgcgcgcagtgccaccaaacccctcctcatccctcccccccctggcacaggagctgacgagcagcgcg

SEQ ID NO: 35683 - DNA, 69 bp, Chlorella protothecoides
cgcgccgcccgccacggggcacaggcagcattgcggcaacgcggcgcggcccgggtcgggcccgtcccc

SEQ ID NO: 35684 - DNA, 61 bp, Chlorella protothecoides
tgggcctgccatcatcgggcagcgccagcaattccagggctctttgcgtcagctgtgtttg

SEQ ID NO: 35685 - DNA, 61 bp, Chlorella protothecoides
atcctggggtgagggaagctcacatgcatggcttggccgcctgtgaaagtgtgtttgggtg

SEQ ID NO: 35686 - DNA, 33536 bp, Chlorella protothecoides
  modified_base (315)..(324): a, c, t, g, unknown or other
  modified_base (646)..(655): a, c, t, g, unknown or other
  modified_base (1630)..(1639): a, c, t, g, unknown or other
  modified_base (1730)..(1739): a, c, t, g, unknown or other
  modified_base (2224)..(2233): a, c, t, g, unknown or other
  modified_base (3261)..(3270): a, c, t, g, unknown or other
  modified_base (4226)..(4235): a, c, t, g, unknown or other
  modified_base (4528)..(4537): a, c, t, g, unknown or other
  modified_base (4652)..(4661): a, c, t, g, unknown or other
  modified_base (4725)..(4734): a, c, t, g, unknown or other
  modified_base (4901)..(4910): a, c, t, g, unknown or other
  modified_base (5217)..(5226): a, c, t, g, unknown or other
  modified_base (5891)..(5900): a, c, t, g, unknown or other
  modified_base (6911)..(6920): a, c, t, g, unknown or other
  modified_base (7591)..(7600): a, c, t, g, unknown or other
  modified_base (7987)..(7996): a, c, t, g, unknown or other
  modified_base (8541)..(8550): a, c, t, g, unknown or other
  modified_base (9238)..(9247): a, c, t, g, unknown or other
  modified_base (9604)..(9613): a, c, t, g, unknown or other
  modified_base (13312)..(13321): a, c, t, g, unknown or other
  modified_base (13414)..(13423): a, c, t, g, unknown or other
  modified_base (13925)..(13934): a, c, t, g, unknown or other
  modified_base (14220)..(14229): a, c, t, g, unknown or other
  modified_base (14437)..(14446): a, c, t, g, unknown or other
  modified_base (14873)..(14882): a, c, t, g, unknown or other
  modified_base (15110)..(15119): a, c, t, g, unknown or other
  modified_base (15583)..(15592): a, c, t, g, unknown or other
  modified_base (17161)..(17170): a, c, t, g, unknown or other
  modified_base (18539)..(18548): a, c, t, g, unknown or other
  modified_base (19940)..(19949): a, c, t, g, unknown or other
  modified_base (20414)..(20423): a, c, t, g, unknown or other
  modified_base (20817)..(20846): a, c, t, g, unknown or other
  modified_base (20987)..(20996): a, c, t, g, unknown or other
  modified_base (21050)..(21059): a, c, t, g, unknown or other
  modified_base (21113)..(21200): a, c, t, g, unknown or other
  modified_base (21622)..(21631): a, c, t, g, unknown or other
  modified_base (23406)..(23415): a, c, t, g, unknown or other
  modified_base (24115)..(24124): a, c, t, g, unknown or other
  modified_base (24430)..(24439): a, c, t, g, unknown or other
  modified_base (24704)..(24713): a, c, t, g, unknown or other
  modified_base (25203)..(25212): a, c, t, g, unknown or other
  modified_base (25422)..(25431): a, c, t, g, unknown or other
  modified_base (25806)..(25815): a, c, t, g, unknown or other
  modified_base (26618)..(26627): a, c, t, g, unknown or other
  modified_base (27268)..(27277): a, c, t, g, unknown or other
  modified_base (28476)..(28485): a, c, t, g, unknown or other
  modified_base (29056)..(29065): a, c, t, g, unknown or other
  modified_base (29693)..(29702): a, c, t, g, unknown or other
  modified_base (29774)..(29783): a, c, t, g, unknown or other
  modified_base (29856)..(29865): a, c, t, g, unknown or other
  modified_base (30270)..(30279): a, c, t, g, unknown or other
  modified_base (30616)..(30625): a, c, t, g, unknown or other
  modified_base (30829)..(30838): a, c, t, g, unknown or other
  modified_base (32086)..(32095): a, c, t, g, unknown or other
  modified_base (32763)..(32772): a, c, t, g, unknown or other
  modified_base (33085)..(33094): a, c, t, g, unknown or other
cgcccgcgccgtcccgcagcacggcccgggcctgcaggcccgcgcgctcggccccagcagacgcggcgcggtagccgcgctgcgcccaggccgcggccctgggcgccaggtcgtgctgcgccgcgtagggcagcgccaggccacccagcaggcccagcacggccaggcccaccaggatcttgaagggcagcgaaacggagcgggagggcgcggggcggggcggaggcggtgtgtccgaggcgctggccgcggcgcggggagccggcagtggggtgctcagcgcatcggccagcgcgcccagcgcggggccccgcnnnnnnnnnngcgcggggcggggcgggggcggtgtgtccgaggcgctggccgcagcgcggggagccggcagcggggtgctcagcgcgtcggccagcgcgcccagcgcggggccccgccgccggctgggcgtggtggccgtcctcacgctgtggctcggggtcgccgtggtagcgttctgcgccaagcggctgggcaccgtggcggtgctagggtgctatgtgtggggtgttaaaggggggggggatgttgactgaaaggggaggaggctgccaggacgcctgcgaaaggtagaacctcaacaagggtgccagtggggcaggcagaaaccacnnnnnnnnnnttgattgaaaggggaggaggctgccaggtcgcctgcaaaaggtagaacctcaaaaagggtgccagtggggcaggcagaaaccacaagacttgccggggtgctgctggagggagagctgcccccgctggcctgcgaggtctgcgacagtcccagcaggcggcgggtcagttcgtcccgtttcctgtcacagtggggggaaacgggagccgggtggagtcggccgctgcagtcgagggaagcccgggggaggtgatgcctgatcaatgccttggaaaaggcaacgcaactcaccctcgtgcagagaagcccaagtccttgcacttccgctgcagttctgcgtacgacagggtgtccacatcctcagctgttacggacatggtttgcagggaggggcctcggagccgcccagatctgggaaggtaagcgtcgctacagctttctaagcatcgaacaactaaaagtaccggtgcatcaggtatttcaggcgcgccatctacgtgcccatcggcaaacgggttccgtgcacggagggtaccgccaggtaccgaccctcagagcctgctcggcattgtatattcccaaccggaggacaagggcatacctctgctgtcggttgagcaccatcgctttccgcgttaccgcatgatctggggtgggcatggcctccttacagcacgaactatggttgcaaaacatctatcttcctagtggttgtctccatgcatgccggcctgccgctgcagccgggtccatgcatggggaggcgtatcacgagtccaggcctgtcaaggtcatggttaaacatgcctgcgcgcccgccgggcccctcaccgctgcaggggcggaccgacaaaggggtcccgtgtcgcgccgttctggtggccggcctccagggcgtggacctggaccgtgccgtcctcccgcggcgagatggggagggagcccccccccaaccccacctcggcgtccttcatnnnnnnnnnnatgtacattcccaaccggaggacaagggcacacctctgctgtcagttgagcaccatcgccttccgcgttaccgcatgatctggggtgggcnnnnnnnnnntgcgtggacctggaccgtgccatcctcccgcggcgagatggggagggaggtcccccccaaccccacctcggcgtccttcatgaacggcgacgcctggcccgggcccagggatggcgacagggagctgccgtaggcgccgccgccgccccgcggccccagctccaccccgcgatgctggccgccggggcggctgccaaaggcgtgatcggcgtccagctcatcgtcgaagcgctcgaagcggttgcctcccaggccggagaagccgggggccgtgccgtggcgcctgcgccgagccagccacacgcagaccaccacccccacgatggccagcaggaagacgccgatggcgatgcccaccttctggttcttggacaacccgcctgcctcctctgtcgttgcatgacggggtggtgtgggggaggtgttcgacggattccaggagtagggagggcatggagtgggcttgcgcccagcaaacctgtgcnnnnnnnnnnggccagccacacgcagaccaccacccccacaatggccagcaggaagacgccgatggcaatgcccaccttctggttcttggacagcccgcctgcctcctctgtcgtcgcatgacggggtgggtgtggggcaggtgttgaacggattccaggagtgggcttgcgcccagcaaacctgtgcgcagcgcgccgccccggccagatcatggcagggaaagcgccactcaccgttcccggggctcggaggcggggatggcgagggagggggcggcgctgtggagaatgcaaaggaggaaggggtgcgcatgtgattcgattcacaagaggatgccgggtggccctggtgcaggcttcacagacgtctgcgggggtgcaccgtcgcccctgcaaaccctacaatgtcgagcagacaccccctctgggaactccctgcacgtcagaaacctacgcgaggagctggtgcagacgctggccagattgctgaaggccgtgtcgcagccattggagaaggagttgccctgtgtggtggggtcgtggggaggatgaagtctggcctgatccagagccaaggcttctgaatttctgatggtgttcttggcaatgtaccatctctggcatgcggaggcaaacaagtaaaggctgcgatggctagtacacagccaggtgaacatgctgagggagggagccctgcccgccacatgccgcggccgactcacggagaggaggatgttggtggggtagtccagctccgctgacgccatgtaggtcgggatgtcccccgtcagcttgttgttcgcgagggagatggtgttccaggtggcgggcacattggcgtccaagggcgcctgtgtggggggatggtagagtgcgcgggggcggtcaggtaacaggcatacgcctggcgaggcgcccacaatcctcccagtgagcgtgcactccctgcgcatgcagccagccgaccatttgaaaacaccaccaccctaccattgataagccaccaccgccgatcccatacctcacccttccccctnnnnnnnnnnaccctgacgcgggcttcacagacgtctgcggggtgcaccgtcgacgctgcaaaccctacaatgtcgagcagaaactccctctgagaactccctgcatgtcagaaccctacatggggagctggtgcagacactggccagattgctgaaggccgcctcgcagccattggagaaggagttgccctgtgtggtgggtcgaggggaggatgaagtccgacctgatccagagccaaggcttctgaatttctgatggtgttcttggcaatgcacgaccccggcatgcggaggcagacagtttaaggctgtgatggctagtacacagccaggtgagctcgctgaggggggcagccctgcccgccacatgccacggccgactcacggagaggaggatattggtggggtagtccagctccgccgacgccatgtaggtcgggatatctcccgtcagcttgttgttcgcgagggagatggtgttccaggtggcgggcacattggcgtccaagggcgcctgggtgtggggatggtagagtgcgcatgggcggtcaggtaacaggcgttcgcctggagaggcgcccacagtccacccagtgagcgtgcactccccgcgcatgcagcctgccgaccacttgaaaacaccaccaccataccattggtaagccgccgccgccgatcccatcccccaccctctccctcctcagttatcctcccccgttttccccccgtccttcctgcacacccacacccacgcagggaatcacccaccaggttaaagatgcccgactcctgccaggcgttcccgatgctgccctccagcgcattcccgcccgcaaacaggtagtgcaggctggggaaaaaagtggtgccggcggagggcagctccccggtcagcttgttgttgctgaggtccagggaggccagcgcggggtaagcggccagcccgacggggaaggagccggcgnnnnnnnnnntgactcctgcaaggcgttcccgatgctgccctccagcgcgttcccgcccgcaaacagatagcgcaggctggggaaaaacgtggtgccggcggagggcagctcccctgtcagcttgttgccgctgaggtccagggaggccagcgcggggtaggcggccagcccgacggggaaggagccggcgagggcgttgccgcccaggctgagcgcggccagaggcgcggcggctgcggcctcggcactgccctcctcgccccaggcgtttggcaggtccgtcagcgcgttgcccgtgagcnnnnnnnnnngcggaggcaaaggccgggatggcgccagtcagtgagttgttggccagcaccaggctctgcagggcggggagcaggcctaagccggagggcatgctgccactcagctgggcctgtnnnnnnnnnntcggaggcaaaggccggaatggtgccggtcagcgagttgttggccagcaccaggctctgcaggnnnnnnnnnntgcggcggccgcggcctcggcctcgccctcctcgccccaggcgtccggcaggtccgtcagcgcgttgcccgtcagcaccagctggaccaggcgcgtgtgcccggcgagcgcggccggcacgccgcccgtcagccggttgtgggctaggctgagcgactgcagctgcnnnnnnnnnncgagtattgaagcggggggacagtggggaggtgaggggtttgggggagagagggagggttggaagaggtgggggtgacagcccagccccaccagcagcgcgcccatggggtcgagcaccgtgcccatggtccagcgcctggctcgcacaggcagccacagctgcttccagttgtcgcagggcgtatcgagtgccctctgtggagccagaccattggctccacccccagccggccccctcctggaccccacaccaacgcaccgctcccagcttcagttgccacagcgtgctggccgccgaaaaggtgnnnnnnnnnntgaatattgaaggggggggacaatggggaggtgaggggttttggggagagagggagggttggaaggggtggggctaacagcccagccccaccagcagcgcttcaatggggtcgagcaccggaaccaaggtccagcgcctggctcgcacatgcagccacagccgcttccggccgttgcagggggtatcatgtgccctctgtggagccagaccatcggctccacccccagccggccccctcccgaccccacgacaacgcaccactcccagcttcagctgccacagcgtgctggccgccgaaaaggtgtccggcagggtcccgctgagccccgtggaccccgccgccaggtacagcagccccgagtcggcgccaaagaggcagcccgggagggagccggagatgcccgtgcgcgccaggtccaggagggtcaggccgctgctggccagcacgcacatgtcggaggtcagtgtccccgtgaccccggtgttggcattcaagcgcagctcgtgcaacgacacaaggctcagcagggcggtggcgatgttgccgatgtcaccctgttgagttggggaggtggagggtgtggctgagggcatggccctgaatgcagggtatggggaaagtgcatgcagctccgcccccgcagcgcactcggcgcctctgcannnnnnnnnnacacgcacatgtcggatgtcagcgtccccgtgatcccggtgttggcattcaggcgcagctcgtgcaacgacacgaggctcagcagggcggtggcgacgtcgccgatgtcaccctgttgagtcggggaggtgggaggggggggctaagtgcacagccctgtacgcagggctcggggaaagtgcctgcagctgcgcccccgcagcgcactcggcgcctctgcatggcccctgcctctggcacagcatcctgcgcaccgtcagcgagttggagcccaggtacagaaactgcagcttctgaaacttggccagggtcttcccggggaaggggcacgacagggcttcgcctgcgcacgtggccagagacgagcctgaggagcagcggctgcgacgccgcacattcgcacgccgctgtctccccacaacagtccacacgccggggggagcatggctccatccgatacctaggcacagcaacacatggacccctcacccctcgcctcgcaccctctagattgagctggaccagattcccgctggagtcgcagatgctgccgtccagcaggcacagatccaacagggaggcagccccggagcgcatggccgcggccttccaggcccggcaggccgaagtcccgccgcagcaggcttcaaacaggctctccgcggcgtcctgctggtcgtcggtaatctgggtggcgttgagcgcggcgtccacggtgagggtgaaggcaatggcgccccccgacaggttctcgttggccacggagcaggtgaagttgggcgtgctcagcgtgtcgggccagtagtgggctgagttgggggagatgaccacctgctgtgcgtagttggcaccgcgggctgcatgcagggtggtgtggtgttggggaagaaagggggttaggtggaggcccgcaccagcaggtgcactctgggccaagcgctgccgcttagtctgcccgtgcaccatgcccgtgccctggttgtcaggcggtacgctctgtgcgccttgcannnnnnnnnncgagttgggagagatgaccacctgctgtgcatagttggcaccgcggtctgcatgcagggtggtgtgaggtgggggaagaaagggggttaggtggggacccgcaccagcacgtgcatactgggccaagcgcagccactcagcctgcccatgcaccatgcccgtgctctgggtgtcaggcggtacgctctgtgcgccttgcatgccagcgcacttgagtagtactgggaggctgcggcagagggggagaccaccgcggcggcgctgctgcagtacaggcccagtgctccgttgccgctgggagtggccgtgatggtgtaccatgactcctcattgtctgcgctgatgtcggtgaacagcacctcctcgccctacgcagggttggaggtttgcggatctgacaggctggaggcagatcatgcccacacgccgccaatgcacccgcaggaacagctggggcactcaccaccgccacggtggaagactgcgccaggagctgtgtggccaaggcacctccggccatgacggcgaggagtactaatgtatgtatgcgaagcattgtaggcggggtgtgtcccgatatcgtggcctcactgggctgtcgggcggttccgttccgcacaaccgccaggaggagcggaacgttccgatcgccaccagatcctagcccaccnnnnnnnnnnatctgcgccaggagctgtgtggccatggcacctccggccatgacgacgatgagtactaatgtatgtatgcgacgcattgtaggcggggtgtgtcccgatgtcgtggccccaaagggctgtcgggcggttccgttccgcgcaaccgccaggaggagcggaatgttccgatcgccaccagatcctagcccaccgatggatatactagctttaaaagtcaaatgtatgcgaatcggcctacgtatctggagtgttatgcagctcacggttgcaatgaggggtgttcatgggaaagcaagcgcgagcgcttcggcgcgctcaaaggtggtgattccctcttacatcctgggaggacccagggaaggaccactcacgacacgaaggagggtnnnnnnnnnnaaccagctataagagttaatgtatgcgaatcgacctacgtatctgggatgtaatgcagcgcacggttgcaatgaggggtgtttatggaaaagcaagcgcgagagctcggcgcgctcgaaggtggtaattccctcccacatcctggggaggatctgcggaaggaccactcacgacacgaaggagggtgtgaccgcgatttgatgcaggtcggagtctccgctcttgacttgtgctttccaaccctctgttagtcgcacttgtcgaagggaaacttgggaagcagccgtgcgcccaaccctgctgcttgagtctggacaaacactgcaagagacgggatccgaggcttctccttgatcgaccaagccctgatcaggaataatcacctcgcctgcaggagatttgagccatgttcctgaccaggtgatcttcttctcatggtgcagggcgactccttgatcgtacaggcggcacgccaaactgcagccctctcgtcaaacggtcgatgtcattccatctcatgcaggagtgaatatgatagatctgtnnnnnnnnnntttgatcgtccagggcgacacgccaaactgcagccctttagtcaaacggtcgatgtgacacaacctcatgcaggagtgaatatgatagatctgtgaacagcttcagtccagagggtcggatcttccaagtggaatatgccatcgaggccatcaagctggggtccacggccatcgcggtgtgcacatcggaaggtgtggtcctggctgcagagaagcgcgtgacatccccccttctggtaggcgctccgtcgtaggggtgcgtggtacgcgcagcgggctctgtcactgcatgcctcctcaccgccaccattaatgtgcacaaaggcttcgtgtgccctccccacctctcataggagcccgccagcattgaaaaggtggccgaggtggacgcacacattggcgtggccatgagtggtctgacagctgatgcacgcaccctgatcgaccatggccgcgtggaggctcagcagcacgcattcacctacaatgagcccatccctgtggaatcgctcacgcaggtactgatacggaaagtgctacccagcaggcccatgctctggtgcagattcataggagtggggcaacctatcgcaagggctgaatggcttcgagtatatgtcttaactcctcaacctcatccccaatctcctgcagtccctgtgcgacctgtcgctgcgatttggagagnnnnnnnnnncaatgctgtccagcaaacccatgatctgctgcagatccataagagtgggtcaacctatcacaagggccaagcggctttgagtacatgtctcaactcctcaacctcgtgcccattgccctgcagtctctgtgcgacctgtcgctgcgatttggagaggatgaggatggtggggatggtggcatggtaagcagtctaacaacagtgcgccggagaaatggacgagatcctgtgacctggacctgcttggccgcatcgtcggtggccacaaagtgtccccactttctcctacctgcctagggcttgtattgataccatcccgcctaccctctcctcctgcaatgaccccacagagccgannnnnnnnnnagcggctacgaagtgtcctatgtttctcctagctgcctatggcttgtatggatagcgtcttgcctaccctttctcctcctgcaatgaccccacagagccgaccctttggagtggcactcctcattgctggctgggacacagactcagggcccgtcctgtgagtcttcgtaggggtgtggcaaatattaacagcaatcatgtgcgcatcctctgcggacgcgactggtgtgactgtgcatgtgcgagccgtcagtgctggcgctctgcatgagcctttgtgactgcattatattgctcaatagcgatgcacttgcccccatgatcaaactccctcgatcctttccaggttccacactgatccttctggtacatttgtgcggtaccaggccaaggccattggttctgggtctgagggtgcacagacggccctgcaggagggattccgtgccgacatgaccctgaaggaggccgaagagctcactctgtccacgctgaagcaagtcatggaggagaaggtgagacctggtgcagaatgggtgcatgcgtttgtgtcaaggcccagcagtactcgcacagccttcccaacctcatgcatttctggctgcaggtgacgtctaccaacgtggacatcgcgagggtggctccaaaatggcacctgtactctcccagcgaggttgaggaggtgtttgctcgtttgtgaagccagtcttgcccgccgtcacactgctgcgaatgatggtggcgtctggaaggcagcacacattgtaacagcagcctaagtgacagttagcgtgtttgatagtggctcacacaaaatcgaaagtcccagcaggcagctgcacgtactcttgggttctgaagaaaaacagggaagcagtcaaggcacctttgagggtttgcatctgcgccagggcgccaccctcacggcggcccagcccttgatgcaggaaaaatctaactccgcacgtgatcagggaagggcccggcatgcaccccggccgacgccaacaaagccctgatcgagcggggacccaacccataaacacttcgactcgccattctaatattttccgttcacgaattccgctccacatcccattctcgcaatggcttccgtcctgggaaacacctggaagaacgagtatgccgaggagctgattgccactgccaaggccatcgtcgctcccggcaagggcatcctcgctgctgatgagagcacaggaaccatcggcaagcgggtgagaacgcggggttggggtttgggttccggccacgggtaacccgtgcgagatcagccccggtagggtgggcgcgccgtgcccgagcagaccccttgccttgtcgaattcggttcacgacctcttcccatgcacgtgtgcatagcatgctgtccgtgcgtcccgaatctgtcctcggttccgtgcccgtcccaaccctgacccaccccgagtcccggttgcagctggagagcattggcgtggcgaacgaggagtctgcccgccgtaacctgcgcgagctcctgttcaacacccccgacgccaacaagcacatcagcggcgtggtgcgtggggttgtgggcacgttccgggctagggtgtgtcccccggtcccgcggttccgggaggcctatggcccaggtggtggtgctgagtgggtgcagtgtctcctatgccccatggaagacgccctcgtgtgaatgtcaaacaccacaccctcgccacccccatccgtcccctacccaaaccaccagatcctgttcgaggagaccctgtaccagaatgccaacgacggcacgccctttgccaagatcctgaaggacctgggcatgatccccggcatcaaggtggacgcgggcgtggtccccctccctggcactgacggcgagacggagacccagggcctggacaacctgggcaagcgctgcgccaagtactaccagcagggcgctcgcttcgccaagtggcgcgcggtgctgaagatcggggccaaggagccgagcgagctgagcatccaccagaatgcgtacggcctggcgcgctacgcggtcatctgccaggagaacgggctggtgcccatcgtggagccagagatcctctccgacggctcccacggcatcgaggtttgcgccgcgatcacggagcgtgtgctgggcgccgtctacaaggcgctgaacgaccaccacgtgctgctggagggcacgctgctgaagcccaacatggtgctccccggcgcggaggggcccaaggtggacgtgcgcaccgccgcatggctgacggtgcgcacgctgtcgcgcaccgtgcccccggccgtccccggcatcgtcttcctgtccggcgggcagtcggaggaggaggccaccgcccacctggtggccatgaaccaggtcaccgacctgcccaagccctgggcgctgtccttctccttcggccgcgcgctgcagagctccacgctcaaggcctggggcgggaagacggagaacgtgaaggccgcgcaggaggcattcatcgctcgcgcctccgccaacggccaggccacgctgggcaagggagacctggacgccacgggcgagagcctgtacgtgaaggactacaagtactgagtgatccgggaggagggagtgagcggggaagggggcagccacacggggcccgtctcgacctgccacccctcccctcgtcgagccctgcccagggggcgccgcaacgagccatgcgtgtgcatgtgtctggagggcccttccaccgggcgatgtgcgagccatcctcgcctatttcaacacaccgctgccggcatgcgctccactccccccaaaaccacctcgaccctcccagggctcctcccccgccccaccctgcctgctgatatagaaaccagtgttctgtgaacgtttgacatgctcaacgagggtacaggggtgcaccaacagaggaggagtggttcacacagtcggatactcaggcccggaagcagaaggagccgtcgacggtcagggctgccacctgaagcagcaagggcacggggtatgggaaccatggaacccctgcaatgtcgtcagtgtgagtatacagacagaaggttccgcaccacacaccccaccaccaatctccagccgcaccttctcaacgatggcagggtcccgccacggtcctggcgggtcggagagaggggcggggttggtgccgccgtactctttggggagctggtccggggcgatgtactcctgcagctcctccctccagttgctggacaggacctggtgaggaggcatgcatgtgttttgtgggtgtgctggagggggtgggtgccacattgctgcctgggcccaaatgctccagggtcctgcatcgactgggactgaagactcagaggtagcagcagggtgatgtgggcacactgccccgccaagcacacacaaaccaacacacacctgcactttgacttgggtcctggtgtccagcatgtacttgaccatgccccacatgacccggaagctggtcggggcattgatgatgatggacttccacatcagttccgggtagtgggcctgcgtgagttggcagtttggaggggcgtggagggctgggctggcatgtcagcctggcgcacttcagcatgcagcaaatgcttcctcctcccggccagcctatggattgtcaaggctggcaccaggccccacctcaatgcgacgagccctctggnnnnnnnnnnagtggcaatgcggtggcaacgccccccctttaagttccgcaccttggaggtcgatgaggacgagggactggtcgacgcacctgcctgctgccnnnnnnnnnngaatgcttcctcctcccggccagcgtatgggttgtcaaggctggcaccgggccccacctcaatgcgacgagccctctgggcgggagattccacctcacctggtcgatgctgagcaccttctgcacgatggctctgaagtcagaggtcagggtgctcacgcccacacctggcgggggatggcatgcgggtaggtgggggcatggggggcctaggacgacacaggggtgtgcaccacacggtggcgatgcggtggcaacgccccccctttaagtcccgcaccttggaggtcgatgaggacaagggactggtcgacgcacctgcctgctgccaccgagcatgccggggcaatcaggttgatgtagcgctcctgttgctgcagtggggcgggggtaaggaatggatgtgagacccgtcgtcgagcaaggaaagagctggtcccagcgagctgcatgggtgcggcacctgcaacacccccccaccccacatcaccacagcgcagaannnnnnnnnnataggaatggatgtgagacccaccgtcgagcaaagaaagagctggtctcagcaagctgcataggtgcggcacctgcaacagccccccaccccacatcaccacagcgcagaacaccgcggcattacacctgcacatggtagcgcacacatcgctcttccgtggtgaacttgaagagctgctccagatcgatgttccccggctgctgcacatacacggggcggcccgccctgtcaacgccatagcagcctggtgcgatgagggtgccatgggggaagggggggggggnnnnnnnnnntggcccgccctgtcaacaccatagcagcctggtgtgatgagggtgccatggggggggaggggggcatgaactgtgatgcgtgtcaagccacatagaagtggtatggaaacggcggcgcaggcgggctcccaccttaaagatcaccaacttgacccaggcactacgaaagacccaccctctgggtaaaacttggcaaactcaggcttcnnnnnnnnnncaagccatacagaagtagcatggatatggcggcgcaggcgggctcccaccttaaaagatcaccaattcgctccaggcactacgaaagacccaccttctgggtaaaacttggcaaactcaggcttctcattgaacacgaaatcttgcagcaccctgtcggctccatactcctccctccactgcattgtgcggggagaatgaggaggctgaagacacaatcgtttcctcctccatgctgcgtgcacaacgctcacccctgcatagcagccagagccgctttcagcatcctgtgctgcgttgctgttgctgctctccccaaacctgaatccaatgaaaatcaacctcctcgcataccttgagggtcgacaggaacatggcgcgagcagctgcgacgtcgtgcttcctggcccgaaggaatcgcctcagtnnnnnnnnnncctctccccaaacctgaatccaatcaaaatcaacctccccgcacaccttgagggttgacaggaacatggcgcgagcagctgcaacgtcatgcttcctggcccgaaggaatcgcctcagtgtgagcgtgtctgtgaagatggtgatagatacttgagtcaagtgccggcctgcagcaggagactcaatccctattcacctgctgggccagggggagcccaggcctgtgnnnnnnnnnnaatagatgcttgcgtcaagcgccggcctgcagcaggagactcaattcctattcatctgctgggccagggggagcccaggcctgtgtttctctacaccactggcttactgtgttggggcggtatgttgacgctgagctccagctcatctctgagctgctgtatcaatataccctgttggccggacggggtgcagaaggcagtttcctgggcagccctattctgcacatgtccaacccctttccttcttccgggctacccctcccaactgctccagccccctacctcatcggcgagggacacaccccacatactgaaacactctgcatcttccttgctgactggtatgtagtcgtcggcatcctgcgcatttgttgtggcatggggtctccatgcgacctgtggaatttggactctacaccctggcccccagcatggctcgttggtccctcgagaggcacccaccnnnnnnnnnncactctacaccctggctaccagcacggctcgttggtccctcgagaggcacccaccacgcgcaccctggtcgtggcaataacatccggtaggctgttgtatatggatcgtagatacgaagccattccgccgtgttccggaggggcacagcccaagagggatgcccttgtacccccacgagagacgccagcccctgaggagaggaggcgaaacgtccaagcacacaaccgaatgcgttgggcgctccaagacaattttcaataacaaattatcttgctccgagtacttaggcggaggaggtttccatttccgccgttgttgcggctcaaaaattgacggcgttgttacgtcatcagggcgccggcatttgaacaccattccacaccatccagcaagggcaacccagcacacagactgccgcagcaagacgtgctgcaggtatgtattattgtagcgagcacaggaggcaacaattagcacaatctgggcctgatctatgcctaagcggagccagtggcagaggaagagggcagtgcacgcacgtcacgtctccttcgccaccttcctttctgcaatcatcgcgcgatagtcctctggggtgagcagcgtcccgaacaaccggtcaacaaaggtgaagtagtgtccgtagttcttgttgtacatggtgtgatggatggtgtggtagtaggcccccatcacagggggtacctgtgggaatgggtatgggagtagctgtttctgtccctgtaaaatccacaggcaggaaggccagcatgggtgtcaatatgaatctgtgtccttccaatgcgcccttccaccctaagctgggcgatgcatagactgtgctgccgcgcaaggaatgcatgtgatcccagatgggcccccggcggtcaccttaccttgccgtcaatgttgtcatggatgttgttggtccagatgccagtagcaaagagcaggagctcgtgggtgagcaggtgcatgggcacaaaccagagcatgaaggtgtagggacacgcctgcacaaagggaggaaagaaccgcttgggcacaaggggagtccggaccaggcgcacaaacagttaatcggccgcctgttctcgatgcactcaagcccctgacacaatgaccagatgcaatgccaagcttgtcacccatggggctcagcagggcacgcacctgcagcatgccgtctatggggtggaaagccaggcccgcaaagggcgacagagtgtgctccttgttgtacttatggtggatgtagtgcagccacttgtaccccggcttgatctcgtgcagcaggcggtgcgcccagtagacaaagaactccaccgacagcatgtacgtgaaaaagtacactacgtacatggggaggcccacgtccgaaaccctggcgacaagacaggggcagcggagagggcgtgttggctagagcaatcggctgatgagaagaccagccgtgaggctcgtaagaacaccagccctggggctaatgggttgcaccccacagaatctgacccgagcctggcacggggaccacaaccagcctctcatccacaaaccaggtcaaatannnnnnnnnnactgatgagaagaccagccgtgaggctcataagaacaccagccctagggctaatgggttgcaccccacaaaatctgaccccagcctggcacggggaccacaatcagcctctcatccacaaaccaggtcaaatacatgcaggagccaatcctcatccacacaaacctgctgtatgtcctggtccagcccttttctatcgcaaactcattgaacgccgggagcatggcgtagaggggcatcgagatgcttgccacctgcgttgagttgaatgtcacaatattttaaggaggtgcaacattgtacagcacgagcgcaaacctggagttgcagatgctgccagaaccagcgacttcaccggaaaggcattgtgagccagtcttctgctgaagtcaaccctgctgattctttgtcggcatgcgggtgggactcccagcctgccagtgaaccgacaccataccttcatctgctccagctgcgcacccaagcttggaatctccccaggcttgaacagctgcgatccgaacgcgtagtatgtgtagtagacccacacgccgcccagcacgtagtagagaatggccaccataatccagttccgcagccagctttgtacatacggcggcatcgccgcacgccattcgtttgggagccagaagagcgccaggttgtccttgaaagcgttctcttctcggaactctagcagctgctcttggcgccgggtgagggaggcgggcgcgggggtcccccacgcttcgaccgaaccgggaatgccggtgccactgaccgtcaggtccaggccctcatcacgccccaagccatctcccctcgaccctagtttccagacgaggacgtcggtgagagggctggcgtagatcgccacggctgttgctgccaggagcgcgaccactaaagggccggccctcatgctgagctgtcaaggctgctgaccccgtcacagaatgcaagcaatgtgatcaaaatatgtaaacataggggtataactcattgcagaccgcgtcctgggttctgtggcatctgtaagttggggcgcatggcaacgtcaccccgccccgctttctttcgagacactcggactccttttattcaaaagatttcgctctgtggctacgtaagggacacgatgcctctattggggcggaagaagtgccgatacacgtgcaaatttcatggtcccagaggtctattgctataagctctgtatgtggtggactgagtgagcatttaccattgcatttagtgagaatcgctctgacatagtagatgcgcttttgcctggctcggcaaccatgctgccgacaccatccgccctctccagacttggtcaatcccctgccagcttggactcaaagcannnnnnnnnnaagataggagatgcgcttttgcctggctcggcaacatgccgccgacaccatccgcactctccagacttgatcaatcccctgccagcttggactcaaagcatgtcagacaaatggcgaatgcctgcagggatattgattctcagctgggtgagaggatcctgtgtccagcatgatgtctgcatcctcgagccttccacacgcttcagaccacccgtttgacgaatgtaccctcatatatcatgcaatctggaaacgtgcctgcagcagcgtcatggggtatgaaaagtccatggtgaagctgtcatcgccaaccctcccaaactgtagcacagtccgatcctgcatgggtacatgaggaacaggtggtggatttacctacttctcggaactttcacgaatgttgagtgacatctcccagacaggggagcacccgggagctttgtggtgtaccgaggagacctggccgcccttgatgcatgattccactgctttacgcatgcatccctgtaccttccccgcatccctgcaccaacctcattttccgaggtgatgagctggaaattcttcacgcttgcctgtgtgactcgccctccaaagttcaagcagtatgcctgtgcacgggagggtgcaagtatgttgcagactgcaggccgtttggacaatagggtacacccctgggcgacgaatctcaatcatcaccctctgcaagcaatttggcacacctgcagcatttgattccactttggtggtttgttgatcagatgtatctcagttttgctgttgccatctttgagcctgcagaagcacatggggtggttgggattgggataagggtgggacgtgtgcggaggtgtccatcttgacattcaatgatcttggtcagaacatcttcccacaacttctgaacgtcacctcgtgcacaatggctgagtaccatccagtgaggggcggcgtgccttgggggtgtccttcttggggtcgagcaggggaagcgccacgctcatctgcgacagtttgaagcgtactcacccagtcatcacaatttatgattgcatcgctgctgaccatgcggcagcgatgcgatctggttgtcagatgtcgtcaccttgagactcaccttccgtgggcccttggcacccaatgagctccgcttgaaacccacagctccaagttctgaggatgctgcacataagaagaagagaggtcggtgtgagcttggtcaagtatgcagcgggttctggagacttgaaggtgtagccgaacaagacatgatttgctggaccacttcttgaccctgcaggtacttcttagcagactgctttgcctccttcttacaccccaatgccccatttccccaaagcaaagcccaagcgaccttctgtcaagagggtnnnnnnnnnncgaggatgctgcacataagaagaggagaggtcggtgtgtccttggtcaagtatgcagcgggttctggagacttgacggtgtagccgaacaagccatgatctgctggaccacagcggacttcttgaccctgcaggtacttcttagcaaactgctttgcctccttcttacaccacaacgccccctttccccaaagcaaaagcccaagcgaccttctgtcaagagggtgaagtccgtccccatactgttggtgtggagtgatccacaaagcccaggaccatggaggctgtgatcgccggcctccatctgatcccacagtttgagaggggaaggacatgtggtgcattccaatccacacaagatgcactgcgatacgatttgcaatgtcaatccttcaaagaccacccgctcgtggatgcctcaccgagatgatgtactttgctgctgttcctcgtccctttcgcttgnnnnnnnnnnagatcgccggcctccatctgatctcacagtttgagaagggaaggccatgtggtgcattcaatccacacaagatgcactgcgatacaatctgcaatgtcaatccttcaaagaccactcgctcgtagatgcctcaccgagatgatgtattttgctgctgttcctcgtccctttcgcttgatggcggtaaggatggtgggaggcgtgcctgacaaagatgccccatcgagctcgaggagtaggctgaactgcataacgaccaccagtcaacagccaatgtgatgtatgcatgccatagaactctttgaaaggcctgaaattgcagatctcagcaattcgcactctaatcagatgtcagcagcaattgatggcacccgacagcttcagtgcgatgagnnnnnnnnnnnnnnnnnnnnnnnnnnnnnncccgatgtcgctgaacgcggcattgcaggggagcagcgaaaggtcctggctggatcagcaagttcctggggaggtggcatgacagatggactgaaaaatggtgaagtcccttgtggcaacaagcttggcaaggccgccacnnnnnnnnnnaaatataccccttgcgcccctattgctcactgtgcaaggcttgaacatgccccnnnnnnnnnngaatacaccccttgcgcccctagtgctcactgtgcaaggcttgaacatgcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggtggcatgacaggtggactgagaaatggtgaagtcctttgtggcaacaagcttggcaaggccgccacacaattctgaggtcttccatgaaatgcaatgcctctaaaatgcagcaacgcatgatccaagcctcctggctcaggaaaccatggagcagatgttaattcatcattctgcctgtccaatcatcgtcaagcaggtttacctgagaccctgccggttgttggacctgattgcattccgaagggcagcctcaagggttgaaccgggttccttgctccgcatggggttgtctctgatcgccttggattgggacctcaggatggtcgctgtgggtgccttcttctctgctacacctgcagtctcaactctggcctcggataggggtccagcagaggccgccatgaagctactcttgnnnnnnnnnntcttggattgggacctcaggatggttgctgtgggtgccttcttctctgctacagctacagtctcaaccctggcctcggacagggtcccagcagaggccgccatgaagctactcttgcgctgatgtgctgcagaagccgccctgatggtgattgcagactcccctgactcgcccagtcttgttcccgatgatgctgtcagtgtatttgcggtatcggggccttctgtcgctgcactcacagacttgatgccattcgtacgaggtaaaggccatgctggtatggcctgctcaggtctgcgtgtcgtctgtggctgcaacaatgccgactgacgtggagtggcagcggacactgtggccctgtgatggcaacagaccatgggtaagcctctgaagaggtaccagcaaaaacacaacaggtgatacttcagtattggactcaaaatcttgcgcgctcagcagcaggcgtgcagggctcaccttgcagacaagggctggtaaccgggcttgggctgaaccccctttgacggccggttgtacagctcattgttgtgtgtagacattgctgtgaaatttaaggggtgcacacatggcttggaatctgatgtgggacttgaaaaaagtattgccacctgaggcaaaaagcgtccctgtcgaaaatgccctggccctatgcgccccgcacctccgccgccgagatatggtgaggcgtcggccatcttcgcccaagtccgagcggtgacaggtcggaccggctgcgacctctgtgattcatgttcactatgtttaccctcagatgttgaggtcacaggtctgtgccgtggggagttggaaggctgtccggtcagacatgttcgttgcggcgactgtgttggaaatgacaatttgaaggtacacatcccgggacattcaaatctgaagcaaaaccaaccactacgattcccgcatgatgcttcgtgcctcctgggtgtggcgacagcaggtggacgagccctagctgactgcatcccctcaacgaccgaaatatcacaagatagatctggacgcactcaaggcaccttcgatcatatccaattggatgggaccgaaatgttcttggtctcgagtagagatcctccgtgacgatctcagagtgatttcgtttccatggtggatggatttcccacggccgattcgtgggagagcgcgcgcgccagaccaagtcgatacatgcatgcagaggcgaggcgaggtacccggtcgtggccaaactgatgtattccacgaaataagttaataagaaccgaacaagatgacgtcccagggtatgatgctgcggaacatggccctcgtgggcaacactgccagcgccactatgccagcgggccaccggcctgcgttcgaggccggcgtccaaatgctttttcagcgctggacagcgctgcaactgggagttttaaatgagtggggcggttccaacagtagagagaaggctgcaggcatccagcacgaggtgctggaatggttttatggcaagaaatgtcacgaaatgctggacctggcagacctactcgaccaggcaatttcagaggacttcaacatccaggcagaggatgacagtccgtaccaggtgcgatgatttggattggagctcggcgccagagactgcaagaccactgcaccctacatgaaagcagaagatagcggatagcacctccagcaggaccagaggaggcactcgtgtcctcctccaaagattcacccctccgccgcgcctcttcttcatcccagctggctagnnnnnnnnnntgatgatttagattggagctcggcgccagagactgcaaggccactgcaccctacatgaaagccacccagaagatagtggatagcacctccagcaggaccagagcaggcaccgtgtcctcctccaaagattcacccctcccccgcgcctcttcttcatcccagctggctaggtcattggtcaacatgcacaatcaggtggctcaagggaactacgagtatgtgcaccagctgcaggccaccccagcaggagcggctgcctcctcgcagaaggcacaggtgggcggagtggatgcgtgtggggtcctgtggtagccctccttgcagcctggattgcgatgctgaagattcaccagctgctatgcgaggatctgggtcttctctttggtgttatgatcttttgggtggccctggaacccagctcccctcaatcctgtcggatgatgcagcctgctgaagaggagggttccagctcatcagacgagggcagcagcagcgacgatgaggtaggtgcccttggggccaaaattgatccgagggtgctgcagtctgggttgtccaaggttccaaaggtatgcgcatactgggacagggtgaaagctggagcagaggttggtcatgatgacttgtacacggtctctcacgaggcattcaaaaccacacagcctgcgcgcatcctcactcaatcgttctgcagggcgannnnnnnnnncagctggagcagaggttggtcatgatatgacttgtacacgatctctcacgaggcattcgcaaccacacagcctgcgtgcatcctcactcaatcgttctgcagggcgaggagggcatggatattgatgaggcccccgccccggctgcgcccaaggctccggtagtagatgcggatggcttcgagctggtccagcggaaagggcggggcaagggtcggccatgatgcttcatctgatcgctgcctcaggccccaatggcattttgctgcatcccattcgcttgaagtgcttgttacaggaagcctgcnnnnnnnnnnttgtcattttgctgcatcacatccgcttgaagtgcttgttacaggaagcctgctcgcatccaggacggggcacatgtgggatgaccaaaggcaaaagcttccttggacaagagtgctgatgagatacacagaggggacatgaaacggtggtggtgcaaatctcaccccttaattaaaaagggcgcgtgacgtgccattcgacgagtgaatcgacaggtcgacatccagacacgttgggcttccagtgcagggagacgtacacctnnnnnnnnnntttaattgaaaagggcgcatgacatgccattcgacgagtgaatcggcaggtcgacatccagacacgctgggcttccagtgcagggagacgtacacctccccagcccaccatgagtaactgacgatccacatcactctgcctcgagggggatgttgagcctggtgccgctcaccacaattcctccgcgcttgcccacctccaccgacccccccaggatgtccgcatacgcctctggcagtgggaactcatcaggaggcgccagccacagcctcagcaggtggcggcgcaggttcgggtcctgtgccgggaggaatggggtgggatggagtgtctgatcatggtgtggaatgggcctgcataagttgttgactgtgtgaatttctgcacatggcagcagggcctgagcagtaggtccagagcgcgtcgtcaacacctccctgcaggggcacacacgcgcagtggcagcggcaggcctcacctcggcgtcatnnnnnnnnnntacatcgtcaatacctccctgcaggggtacacacgcgcaatggcagcggcaggcctcacctcggcgtcatcaacaaacgctgaccgggcatgcagaaccgtgtggttggagagcagctggatgtcgcctgcaaagtgagaaacgtcgcacggtgggtcaagtttgcagcgttgaggagggggcgcaactgtgacacagaaaggcgaggannnnnnnnnnacctgcaaagtgagaaacgtcgcacagtgggtcaagttcgcagcgttgagggaagggcgcaactgtgacacagaaaggcgaggacggacttcgtgaatttcccaaacatccttcccacctggctgcagctggtagcggatggagtggcgcggggaggctgccagctcgtcaaacaatctgatggcctgtgggaaagggagggaacatgtcgatgagccctcaagtgatgagtcattgcaggtgagccattgctcagcacctcttgacgcaggagtgaagatgccaccccccgagtattgacgcgacagatgtcagggtgcattcttcagtcccagataagatctgaggactctccatacctcgaggtgggcaggnnnnnnnnnngtttgatggcctgtgggacagggagggaacatgtcgatgagtcctcaagtgatgaatcattgcaggtgaaccattgtttagcacctcttgacgcaggagtaaagatgcccccccccctgagcataggcgcggcaaatgtcagggtgcattctttagtcccagataagatcagaggactctccatacctcgaggtgggcaggggtcagtcgagggactgcctcatggcgctgactcagcaggtagtagtttgacgaccagttcacggtgaggttgccctgtgcagcatggtacagaatggagatgttgaacatgagcagctcctgctgtcggggtgttgcgtcccgagactgcgcggcgctcgcagtgcacagcaatgccggcgcacgggccgggcccgctttgtcttggcaaagtccaacacttccacccccaggcagccctcgtcgtcgaacgttcaatggcacatgctccctctgcgcaccaggaagtagttgaaggcggggatggcgaagaagggctgcttcccggctgggacctcgcccttcctgtcaaagtaccagtcctcagtcatgatgggtcccaggtcggggcgcagcctgaggaactcgttgtgcactgtggcgccgtggggcgaggggggtgctgaagtgggtgctctaccagctcggtgcatgcggtgcgacgctccagctcccagcgctgtgccatacgctgcacatgcacgcagtgtgaacaaaggcaggcagcgcagtctcctcgagtcctcttaacccccagcgccctgatacctgcccatgaagannnnnnnnnncggcaaagttcagcacttccaaccccaggcagccctcaccgccgaatgctcaatggcacgcgccacctctgcgcacctggaagtagttgaaggcggggatggcgaagaagggctgcttcccggctgggacctcgcccttcctgtcaaagtaccagttctcagtcatgacgggtcccaggtcagggcgcagcttgaggaactcgttgtgcactgcagcgtgatggggcgagggaggtgttgaacttggtgctctccccgcttggtgcatgtgatgcgacgcgccagctcccagcgttgtgccattcgctgcacatgcacgcagtttgaacaaagcaggccccgcagtctcctcaagtctctcaaaccccagcgccctgatacctgcccatgaagaggcccactggctctccccaccctgccgtgcctcattcaggcacagaagcgctgcaaaagggtgggtattccaccggtgatgcacttcctcgagctgggaagcttcaacaagggctggcaagtggatcagagtgcagtcgcaggagaccctcaggtagtgcccatacccaacccccatgccgatgggtgcatgtccgatcacggcggctcaccgacaaggtcggccgcgtcgttgtggaagggctgcnnnnnnnnnngaagggtgtgaatttcaccggtcatgcacttcctcgagctggaaagcttcaccaagggctgacaagtgggtcaaagtgcactcccaggagactcccaggtagaacccatacccaacccccatgctgatgggtgcatatccgatcacgcaggctcaccgacgaggtcggccgcgtcgttgtggaagggctgcgctacacttgtggcgtctgcagagggcagaggggtggccgattcgtattctggaagattttaaagagcatgttggagtaaactgcgtaacaaatagaatgggtccactgggcaatcgtccctgcatgccagacaggtccaccacgtgagagcgctcacagagtctggtgctggggctggcagggtcgtgcccaatgtccttgatgtggcccacaagatgccccttgtggttgttggagaccgctttaccccagtgtaggcctatgatccagtaggcggcgactgtctgctcccgactccagcgcccgacgggaaggcctgaaatcagctggaacccacgaccgtggaccgcctcaacccggaagcccgtcaggatggggcccagagtcggcagggacacgttgtccaaactcaggccctgcaatacaacaagggcatctcgtaggtaattcgtgcgccctggagccgcacatgtcgctgcacctcggccctggcccctttccggtgcccatcccacctcgaggatctgtccggactcgatcgcagcgtcaacggcagcctccagctccgcaatgtgctcctcgctcaactggaacctccattcttctgggcggtgaatcagctcgtcggcgtaccagacggcaggcccgctaacaggcttcagaggcaccacccccctcctgtagggtgcattgaaacttgcggctggaacagcacacgccaggggggagtggcattgaacctaaaagcctcaaatgaagttgtaatctggtgaaaagggagtctcttaccctgttgtcgccttgtcgggaatgggaaagagatctgctgccgcgggcatggtttcggaatctacaggtcaagtacgacgcacacggtggacaaatgaatatcggagggagaaggtttcggccacggtgaaaaatgtgctcaagatctcgataggaaatgtgtagtcttcctgcgttccagggcacgtcgcgagctttgccagaacacgggagtgttnnnnnnnnnnagacaaatgaatgtcggagggagaaggtttcggccacagtggaaaatgtgctgaagattttgatagaaatggtgtagtcttcctgcgttccagggcacatcgcgagctttgccagaacacgggagtgttccagcaagcggaacttggacgaacgaaccagaagccgggcgggagtcggccctgtccggtgccagcaaagcggttcgggagaatccctcaaaggacgtaatgggataataattgtggtcaacgcccgatgagaatacctatgtcctgattcggcaggccctctgtcacatcggaatctcggttgagactcaccccggatggaacacgtagcgaactccggaggagcccgcctcgcgaacgggacagatcaaatgccgcgtacttttccgcagcagcactcactccctggcctccatgcacttcatttccctaaatccacttctcaacgcgtgagagatatggaaaccatggcccgagctgtctcaactggcccgtcgatgcagagaaccatgcgtacaaaggtggtcctgaacatggctgcggtctcaacagggaggcaggnnnnnnnnnncgcgtacaaatgtgttcctgaacatggctgcggtctcgacagggaggcaggtccacatccccactccgctctcgcacttgaactgcccctcctcgcccatatctttccaggtgaagagtgacacatgaattaattgatcgtaaggtcctcatactcaagcctgctgcatgactctgcatggccagctcaccataggggcctgacgctgaacacatgctaacctccccccccccttccccccccatcaggatgtggctgctgccgcagtgctctccgagacggtgtaccgcgctgtggactttggggaaggccgggctgaagaagccctgctcgccttgcagtctcgcatgccggtgccgatcaagctggagcatgttgggtggagccccgcagggcagaggcagaggtgagctgcacatgggactggaggtgtcagcgtggaggatggactgcaaggcaggctctgcagagcgcagcctggcaatgcccatctcgcacagcgacatgacaggtccagtgcatctccacaggtacctcatagcttccatggatgacgccctttacgtcgctttcttaggcaagccatgagggttggtgcatcaggcagaataaacccgatgctctacannnnnnnnnnagtggaggatggactgcgaggcaggccctgcagagcgcagccctggcaatgcccatctcgcacagcgacatnnnnnnnnnngtgagatgggctctttcctgaaccgaaattcttggctcccttggatcagctggggcgcagccttgtgaagtgnnnnnnnnnnacgagatgggctcattcctgaaccgcaattcctggctccctcggatcagctggggcgcagccttgtgaagtggagtccgcccacccaaggcatctcctcatgcgtctctcatggcacctccacaccggaccttcccaggcaccaagctcccccgggaccatatggccaacctggacgcacgtctcacacggctctggccggactcccctgccgcagctcactctgggtactctggccgcgcgagcctcatccccatccagcagctgtttgccctggcagccgtccaggggaaacgtctcgtccttgcaggtcagggacgaagcgctgtatcgcttgagtagggcgggcatatcatttcatatggagctgagcaactggaagcctgccctgaccggcagcgcaccnnnnnnnnnngcttgcaggtcagggacgaagcgctgtattgcctgagtagggcgggcatgtcatttcatttggagctgagcatctggaagcctgccctgaccggcagcgcaccaatccatcctttcatcgccctcccatcctgcacactcaacccatgcgcggccacccctacctgtgcaggccactccatgggaggagcagtggccacgctgtgcgcgctgagcctgctgcgctccttgcctctgtccgcgcacgggctggtggcatgcgtgggcttcgccaccccccctctggggaacgcacagctggcggggttggtgacgggtgagggctgggactcgcggannnnnnnnnnggtggaggagcagtttgcagagtcttggcgctgcccgggatcaacggtcttccctcctcggaccgagcactgtgcatggtggtctgctctggcaatcgacgggacctgtctttgctacgcgcgttggcgccgttcccgaacctccagcctcaccaggcaggaggtagttgtgtatccgcgagtcccagccctcacccgtcaccnnnnnnnnnntgccaccccccccttggggaacgcacacctggcggggatggtgacgggtgagggctgggactcgcggatccacaactacctcctgcctggtgaggccggaggttggggaatggggtcgatgcgcgcagcaatgacgggtcccttcgagtgtcagagcagaccaccatgcacagtgctcggtccgaggagggaagaccgttgataccgggcagcagcaagactctgcaaactgcttctccacaacgcactcccacagacttctcccgcacaaccccgcagaggactgggtgccagagctcatcaactctttgcgccggctgaaccggccccacgagggagagcggaagggcctggtggaggacagcaaatacgcagcccgcaccgccaccgccatccacgagcgggtttgttgtggcacggggcccagacatcggccttttcgggccgccctttcccgtcgccctgctgcgaggcgtgtgggcctcgctgcgtgagggttccggcagcgtgccggccacactggtgcgtggttttcctggaaaggggatctggctcccatgacatggccgtgctcgggatgattcatgtccatctgggacccggcgcctgcatgcacagagcaggtgtcagccccatcctggtgcggtcccccagcacagcatgcccattctggcgaatcaaagcccagctccttccactcctctgcgccctcccctcaacacccgctcctgtactcctgcaggcagccgcaggggccctgggcatgcggctgcctggcttggcaggcggggcgatccgtgccctgggatcgacggtcctccacacctgcacacgcttccttcccctggccctgctgccactgggacaacagctgcacctgcccggtcacagggccaggggcgtgctggacccagcgtgggacccgcacccgctgatcccagcgcgccccaggggcttcctgaagatgcaccgcatgatcagctaccgcaccaggctcctggagttgtgcgtggactagggaccccgcacgctgactggtcacaagccgtgccccaactaataacagtgctgcgttcccccgcccatgcgcatgggttgtagcctgggatcgagggacgggaaggagagcaagcgaaccagcggaagggtgtacggagaacttacacggagtgccaaccagtaaggaactccccctaattgctataacctgtcgtcacatttccacgcttgcacatcgccgtgcacacnnnnnnnnnnagtatggagaacttacacggagtgccagccagtaaggaactcccccaaattgctttaatatgtcttcagatttccacgcttgcacatcgccgtgcacaccccggcgtctaatgcgagttttaaaggtgccccgccgcctggaaccaaatgccagacgcggggcatctggggcgcgagatctggctcaaacagtttttgtgcaggctcatggggagggattctggaggagaatcacacgctccacaaatatgatggcccgtttgcagacaaccgggctgtcgggacgacaacatcgccagggaatatggtagccattgccagcgagtgaactgggcgccatggcgaggcggtgcggatggcatgcccccttcgtcctcccccttgccctttacatgatggccatgttgaggggaggggccggggacgccacccccctcaccgaggccagcgaaccgcccccctccccgagtgtggacggctccacctccctgacggagggggccgccctcatggcccagcgcagcctgttcaagcagtcatcgacgttgctcaatacctgggattaccccgggagcgagccgtgccccaataatgagatcgaaatctcgtctggctggcggggggtgacctgctccaatggggtcgttgttgccatgtgagtgcccatnnnnnnnnnngtacctggaattatcccgggagcgagccgtgccccaataacgagagcgaaatctcgtctgcctggcggggggtgacctgctccagtggggtcgttgttgccatgtgagtgcccatggtgcggggagtggacgtgtgatcgaacaaaaagtgcacacgaaatgccagtatgtgcggccatgatcctgcaccctcacatacctcggccctgctggaccccctcgcctggacccacacctgccccgcagcaccccctcccgtcgatgtgctccgttcccccttccctctccctctccaaaccccgtccccaatcgnnnnnnnnnnggcagagcatggtctgtgccagaccctccctcgtccttcccagaaggggcgggcgccgacacacgcgtcagcaggcccggcgaccacgaagcagctgggcaggaggacagacgatccccatccctcctcaacgggtggcgcggcacgcacccgtcagcgcgttgtcagccaggttcaaggacagcaggtcggggaaggcccaggcctctggcaggctgccggtcaggccattgttcttcaggttcatggtcagcaggctgcccagggccgaaagagcaggggaaagctgacccccaaggcccaggtcctccaggtgactgggtggggcgagggtgcgattggggacggggtttggagagggagagagaagggggaacggagcacattgacagggtgctgcggggcaggtgtaggtccaggcgagggggtccagcagggccga

SEQ ID NO: 35687 - DNA, 61 bp, Chlorella protothecoides
gaacaaagtgtccctcaaacattcatgcctacccatccactgggcatgagacgaccattca

SEQ ID NO: 35688 - DNA, 101 bp, Chlorella protothecoides
tggcaggacaggctgtacagcagggcgagtgtgcagcaatgcgaggggtggcacgaatgtgcttggatcaggctcgcatgctaccatgtggcctcaatcca

SEQ ID NO: 35689 - DNA, 126 bp, Chlorella protothecoides
ggacataccgtgcgctatgcctgcgcgcagcagggatggaagggagagcaggtctgaggcaagggagcagggggagccagggccacccggcctgcgacccagaccctgccacaccattcctcacgt

SEQ ID NO: 35690 - DNA, 76 bp, Chlorella protothecoides
catgcatgcatgcgacccggggtatcacgaggcggatagggaaatgttgcgacagagaaatgctgcggcaaagcac

SEQ ID NO: 35691 - DNA, 62 bp, Chlorella protothecoides
cgagtctgtggagccgtgggggtagatctgcagagggggggagggggggggggggggggggg

SEQ ID NO: 35692 - DNA, 79 bp, Chlorella protothecoides
attcccacccacccaacaagagtgcacgtcacagacacacccctcccccacccgcggctcactggcatcctccggcgag

SEQ ID NO: 35693 - DNA, 112 bp, Chlorella protothecoides
cccccctcccccccccccccccccccctcatccaacagagatggactttggggactcggggatgggcgagatgggcaggcctcggaagatgagcaagagcgtgtccatgggc

SEQ ID NO: 35694 - DNA, 64 bp, Chlorella protothecoides
ctgctgcagatgatccattcgtggtaggtgctgaggagggggggccagcaaccccggccgctgc

SEQ ID NO: 35695 - DNA, 61 bp, Chlorella protothecoides
gtctactcccactacgctgccctccctggtagggctgacatcgcatgtcatcccatgcact

SEQ ID NO: 35696 - DNA, 61 bp, Chlorella protothecoides
tccgccaatgacgtccccaccacctccaccgaagaagtccccgccacctctgccgacagag

SEQ ID NO: 35697 - DNA, 61 bp, Chlorella protothecoides
cgaccccctacggcacgagagaccatgcgaccccacggggtcccacgcacagtcgagggac

SEQ ID NO: 35698 - DNA, 151 bp, Chlorella protothecoides
aaacgcaagccccgcgccctgcgcaccttccagaggcggtcacagagcccggtgatgtaggccgacccggagccgccgatggagaagggggtgttgacgatggtaccccccaggggtatggcaaagacgctgcctccggccactcggtccc

SEQ ID NO: 35699 - DNA, 62 bp, Chlorella protothecoides
ccctggcctcgcaacaggcaagctgcatgtcccggcgccttctctgaaggcgcctggggggc

SEQ ID NO: 35700 - DNA, 900 bp, Chlorella protothecoides
  modified_base (293)..(302): a, c, t, g, unknown or other
  modified_base (763)..(807): a, c, t, g, unknown or other
ggggcagggatggtggtggggggcagggatgttgggggggcggcggcagggtgcgagccaggccgaggtgtgtgaagggcgagggcagggatctggcaggccgaggggggccgcggccgtgcctccggcccagcgccacccacgtgcccgacgcgcctgatccccgaccgcaccgagcccaccccccccacccgccagctccttggagaaaaggcaaccaggtttgcttggccctggcagcaggggtttcccatcccctccggcagtatccatggggcgatggggtggggtgnnnnnnnnnncaccgcaccgagcccacaccccccacccgcccgctccttggagaaaaggcagaccaggtttgcttggccctggcagcaggggattcccatcccctccagcagtatccatggggcgatggggtggggtggggtggtggtgtacgacacactccctctcgcctggcagcggctcggggggggcgccgggggggtgcggctcacaggaagcccgtgccccagttcaggctcaacccgccgagcccagactgcggctgcggaacacggaaaaggaagggggtcgcaggtgagtgccgtgtggggcgaccaggggccgcccagctggggggaccacccacgacgccgcacccagcctcaccgtcctgcgggagtcgcggtcacgccagcacggcccctcggcccacccactcccgacccactcccgccctccaccgcctcccccacctgctgctggccgttgccgnnnnnnnnnnnnnnnnnnnnnnnnnnnnnnnnnnnnnnnnnnnnncgggctgcgcccagaggccgtagcggtacgcggcctcggcgctgccctggtcgccggtgccctgggcccccgccggcaccgaccccgggcgcc

SEQ ID NO: 35701 - DNA, 92 bp, Chlorella protothecoides
agtgcccatcgcatgcatcaataatgttctcagaacattacaggaccaggaaccctcactgcctcgacctgttctggccagggcacgtcccc

SEQ ID NO: 35702 - DNA, 61 bp, Chlorella protothecoides
gcggccgatcgccatggccggtctccaaaagctttccggagtggtagtggaagcatggaac

SEQ ID NO: 35703 - DNA, 62 bp, Chlorella protothecoides
gggtgcgtattttgaggagggtggggcgtcagggaggggcagagacgtgggagacttcgccg

SEQ ID NO: 35704 - DNA, 80 bp, Chlorella protothecoides
aggggcagagacgtgggagacttcgccgggctacagggatcgtgctaggaggagtggggtggaaaaggggaagtatgcat

SEQ ID NO: 35705 - DNA, 5348 bp, Chlorella protothecoides
  modified_base (307)..(316): a, c, t, g, unknown or other
  modified_base (936)..(945): a, c, t, g, unknown or other
  modified_base (1267)..(1276): a, c, t, g, unknown or other
  modified_base (2054)..(2063): a, c, t, g, unknown or other
  modified_base (2158)..(2187): a, c, t, g, unknown or other
  modified_base (2456)..(2465): a, c, t, g, unknown or other
  modified_base (2526)..(2535): a, c, t, g, unknown or other
  modified_base (2719)..(2728): a, c, t, g, unknown or other
  modified_base (3264)..(3273): a, c, t, g, unknown or other
  modified_base (3528)..(3537): a, c, t, g, unknown or other
gcggcgcgccgtcggcggggcctgcgtcgcgggaccccggcgcccccgcgccagcggtcgtgaaggccacgctgctgatgcccagttgctgcgcgcccagcgtgcgcagcgtggcgtcctgcgcggtctcgcgctcgtagcggccggagggcgccacgggcagcgctgccggctgcgggagttgttggggggcggggactttgcatgcaggacacgcgaggcctggggtatgggtcggccgaagcggcaccgatgcaagtgccgaggctggcattggatcgccccgcctgcttctagattgacaggnnnnnnnnnngcgaggcctggggtgtgggtcggccaaagcggcaccaatgcaagtgccgaggctgacattagatcgccccgcctgcttctagattgacaggccctccctctcctcatatccaacccccaccccccaccccccaccttcttcttgggctgagtcgggggggcatgcgcaccgtcggcctgcacggcgcggaggagggccagcaccttgtcgaaggagcggccggggacaagcagcatggagttgcggtcccgcagctggagctcgttggccaggacgcggcgcagggtggcctcctcagcgtcgccctcctttccacccacgccgcccgcccccgcagcctcctcgctgggggcgccgaggggcgggaggccggggtccacggcctcggggccctccaccggctccaggtcctggggaccctcctcgatggccgccgacttgtcgatcttgccggtcaggtacagctccaggtcctggggtggcgcacgaggcgggggtgattgagggggggcaacacgcactcggaatctcgtgcaggcccttgcaaggacaggaccagcagtcctctggtagacgagcttgagagacgcaggtgagcgctcgccctccgctggacagcnnnnnnnnnnaggtggcgcatgaggcggggtaaattgaagggtggcaacacgcactcggaatcttgtgcaggttcttgcaaggacaggatcagcagttctctggtagacgagcttgagagacacaggtgagcgctcgccctccgctggacagcagtgtgcgactcctggcacggcccgagatgtggtcaccatggggcggtgcccctcgtgctcccagatgcatccaggcccgctgcctcactaccccaacgcgcgaggaagatgcaatcagatccacacggcccaccacaccggcatgcgccagcccaggggctaaccttgcggtcgatgnnnnnnnnnncggcacggcccgagatgtggtcaccacggggcggtgccacttgtgctcccagatgcatccaggcctgctgcctcactaccccaaagcgcgaggaagatgcaatcaaaaccacacggcccaccacaccggcatgcaccagcccaggggctaaccttgcggtcgatgaaggtgacctgcccgaccccggcctccctggccttcttgaagtagtcggcatacttgaaggtggggcccaagttcctggcatagaagagcagggctcccagatcgtagaaggcgccgtccttggcctgagacttgtaggccgtccgggcagagcgggggagggcgaaacgggtgccaaagtgcacccggtcccccaccgtggtgacctcctcgagacgcccaccgctcacgtactcccgcaggagccggagcggatccatgtcgttacgaagacgccggtcgtgggggtgctatcactgcgacattggagtcaggccagaggcgccgagcgacagcgtcagcggcaatccacaccgcacgcacttggctaatcggaggtccagtgtcgggcgtccaaaactagaaaacaaaggggaaggtcagcgattgtaatgaccgcagatcgggtgcatgcgtctcgcaaggagttctctgcagtgtcgaggatcccggcctcggcgaagctccatcccacccgagggcgcaagtgaatagggcatgctaagtccgaaatgtcttgacccgatacgtcttcaagcagctgcacgattgactccaaattccggtcatgatnnnnnnnnnnggactgcagattggatgcatgcgtctcgggaaaatttctctgcagtgtcgaggatcccggccttggcgaagctccatcccacccgagggcgcaannnnnnnnnnnnnnnnnnnnnnnnnnnnnnctgtgatgaccagcaatgccttgcgtactccaccgcccactatgagtctcatctatttgctggtgattacatgagacactaggattggaagaaaaaggtttgcttctgcaaacccaggtgcagaggaaacagttggagtaacaatatggaatgccctggaggtgccgcactgacaaccaatcggactgtagctgggagatacggaggctggagcatgcgtcatatctatgccatgtgccggaaggggttcacaatggcgggcaagtcannnnnnnnnnggtttgcttctgcaaactcaggtgcagagaaaacagttggagtaacaatatggaatgcccnnnnnnnnnnaggaggccgaagcatgcgtcacatctatgccatgtgacggaaggggttcacaatggcgggcaagtcagaggcttgccgggcctgcaaagggggggtaaagaatggtggatgggaacaccgaccttagtggcatatggccgagaatctgcacctcccgatacgagactccccgtcaacacacctnnnnnnnnnnaggatgggaataccgaccttgatggcacgtggccgagaatctgcaccccccgatacgagactccccgtcaacacaccttggcggacaactgatccagggccgcgttctcccattccttgttgtggaagctcgcgggcgtggcgaacaatgacgtcgtgtacgagctggccactgcgcatcagggtaatgagggttggaggtgggtgtcgtgtcgagggcggtcacgctgcatgggctgcagtgcagactctatcgccatgcgtataagatggttttcagtcatgactcaccagtggcaaatgccaggctgccgagcagggcgggcaccaccttgcgggcggggacgacgtagttgagcaccatgtcggaggtatgggactttgggctggctgctggctcctaggctggtttgtggatcgaggggtgcttgatgaagacctgtatgtttgtttataattttatgggatgggtatgctgcgtatttatgctgtccctacagtcgactgccccatggacgcggacacctagccagggcnnnnnnnnnngtgtttgtttataattttctgggatgggtatgttgcgtatttatgctgtccctacagtcgacagccccatggacgcggacacctagccagggcacgtatccaggtcgcgtattctcatgctgcgcatgcttcggcgacgtgcatggacggggtgccctcccgttccccgccctgctgcgcctgcagccgaagctgggcgccaccccctgaagacagtgatgaacatgtaccgagggtggtgtgtatctctgtcannnnnnnnnntcctggagccgaagctgggcgcccacccctgaagacagtgatgaatatgtaccgagggtggtgtgtatctctgtcatgccctcgtggacgctccgccagtcggcaccatcaagtggagggcatgcagcccatgtggaccgagctccgtcgttacgcggcagccactccgtcgcatgcagcctgtcccttcactctgtcaacttttaaacaaagggatcaccaccatatgattgccaaagggggaaagcacgagaaatgtacatggacaaggatggagggtgggggatggcaggagggctcgagggatggagggcgctgcgcgcagcatcctcacacctcctcagcacagcgcgttgtttccgaatgcacgcctggcgacatacgccaggcgtggcagcgcggggcatgggaggagtgatgcacgcactccagcgcgtcccctccttgcatccccggccaccgtcggccgccccacacgcggccgcgaccgggcccccccttgaccaccctaggtcctcaggccttgaactccagcatcatgttgttctccggggccaggccgacacaggcgcggaagacgttctccagcatggcacgctgcttggccagcgcgttgaccacgggcgtgccctgcggcaccagcggcgcctttgtcaggtaggacagcagcacggccacggggtgcaggcccgccagctcctcgccatcgcgcgccagccggatgcgcgtcagcagctcggccaggatgaccaggtccaggatgatgggcgcggccaggaggctgtcctcgcacgtgttgtgcatggcgatggtgttgcgcccgcccatgaagatctccgacacgtactcgtccagtgcgcgcttggagtcggcgacgtagggcacgtacttgatgaccaccacatggtccgggtgctcccccggggcgtagagtagctcgttggacagcaccatgtcgtccacaacgttggacttggagatctccttggagcggaaggtggcgggggcagacaggttcatgccgtcgttgttgcccaggtggttgtacgacacgatgctgaccggcttgatccccgcgcccaccaggtagtccaccagcacgctcttcatcttggtctgccccgacttgaagtcgtcgccgccgatgagggaccccgcctctgtggccagctcgatcagcccggggacaaaggtgttctgaggcgagccgttgacgaagggcacgccctcctgcacgcaggccagcgcgtagagggtggagggcgcgatctcggcctcgtcccgctccaccgcggccagcaggttggccgccgtgtcgttcaggccctccagcacctccgcgtagcgctcggtgttggcggtccagagcaccaccaccgagtccagcgagtgtgctgcgcggaagtcgcggatgtgcccgcgcacggccgccacctgctccgcgcggctccccttgatcaggttgtcggcgcggccgacctggttggccgcgatgaagtcggggtcgtagatgccgggcaggggcacggtgccgcgcatgtagggcaccagctgcttctgcagctcaaagtccagcacacgcgcgcgctccatggcgtccgccaggttcaggctggagatgtcccagcccccgaccacgatgtcgttggggtgcaccatgggcagcagggaggagaagggaacgtgcacctcctcgccctggtagttgcccacgcggcacgtcgccgcgtgcgtcagcgacccgtagtagttgggcttgcgcagaccgtccttggtcatccaggtgatgccgctgagggaggagggggggg

SEQ ID NO: 35706 - DNA, 61 bp, Chlorella protothecoides
gactctaccgacacattgagagtgtggaggtccctccactcccccaaccgagctcacagag

SEQ ID NO: 35707 - DNA, 80 bp, Chlorella protothecoides
cagtctgctgttccacggaaaggtccaatggatttcccctgcctgtcggcgtccccaacaaggtctcccctcctactccc

SEQ ID NO: 35708 - DNA, 61 bp, Chlorella protothecoides
gcagcacgagctgccagccaccaggcgccccaggggcggcgcggactagcatgttggcggc

SEQ ID NO: 35709 - DNA, 90 bp, Chlorella protothecoides
gtgagcatcagtgcgggtccagggaggcaggtgtcggatagaacaaggcggtgtgcggggaattcaaggtccccctcatcgccatcgggg

SEQ ID NO: 35710 - DNA, 81 bp, Chlorella protothecoides
tctgcagctggaaaatgaactctcacacagggctgccccatgtgcccactcccacctccaaggaagttgaggatgagtggg

SEQ ID NO: 35711 - DNA, 78 bp, Chlorella protothecoides
gattcaacgaggcgaacagaagctgttgaagtatgcagttccatctttatgcgcatggatctcatgactcggatccag

SEQ ID NO: 35712 - DNA, 61 bp, Chlorella protothecoides
gatggcggcgcagccggcctgcaggctggcggtggttcgcgagtcggcgatgatgcgcacc

SEQ ID NO: 35713 - DNA, 61 bp, Chlorella protothecoides
cagcggggtgtctcacatcccagaccattctcccaccctgccgttctgttcaggaagccgc

SEQ ID NO: 35714 - DNA, 61 bp, Chlorella protothecoides
cgtcctggccagcatcccgccctacgccacaggcgccgccctcgtcctggtcggcgccatc

SEQ ID NO: 35715 - DNA, 75 bp, Chlorella protothecoides
gctgcgattccagaggacgggcttcttgggactcccccgggcctgggaggcagtggcgggggggggggggggggg

SEQ ID NO: 35716 - DNA, 144 bp, Chlorella protothecoides
gagtactgcatgatggtttatactgttataattggggggaaatggcaatgacacaggatcaagacggtctagtctctgatgaacacgctcggtcagtatttacagagggcagaacccagcgcccaatggtaatcactgtcgagg

SEQ ID NO: 35717 - DNA, 428 bp, Chlorella protothecoides
  modified_base (163)..(344): a, c, t, g, unknown or other
gggtggcggcagggacaatcccgaccgcccgtgggccgtgctccgtggagccctacgacgcctccaggcgcgcacacccaatccctgatgcccagtcccctcctcccaatcccaaaggtcgtcccaaactttcggatacggaccatccccgtcctgggcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgccggcctcgtgcgcaggtgctgtcggccctcttctcgcccatcagacctggggacagccgggcacttctccctgccaaat

SEQ ID NO: 35718 - DNA, 63 bp, Chlorella protothecoides
cagaacgtggggccatttgtgtcctgaggcttgttccttacccttgctctcaaatcccgatcg

SEQ ID NO: 35719 - DNA, 61 bp, Chlorella protothecoides
gagggattgctgcggcgtcgaagctgggtgcaggctcagtgcagtgaggaggaaggggaga

SEQ ID NO: 35720 - DNA, 61 bp, Chlorella protothecoides
tcagtgcagtgaggaggaaggggagaatggctcctgggttgggggcagggctgctggagat

SEQ ID NO: 35721 - DNA, 61 bp, Chlorella protothecoides
tgatgccgcgtgcaaggctgagcagctgcccctgcgctgcgcgctgcacagccccaccttg

SEQ ID NO: 35722 - DNA, 370 bp, Chlorella protothecoides
  modified_base (101)..(298): a, c, t, g, unknown or other
ctgcaagtcgcagcgccggcctagcacagcgcctttgtatcgatcgactgattgaatccatctgtcgtgtccctggaggcgatagcgctggtcggcctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgaggtagcggggtagcctgggcctgcaggattgtgccgcctgccaaatcttgtcggatgtgctcatgaa

SEQ ID NO: 35723 - DNA, 61 bp, Chlorella protothecoides
gggacctccttgcaatgcccagagcgtccggggcaggacacttgggaccaaaactggaatg

SEQ ID NO: 35724 - DNA, 84 bp, Chlorella protothecoides
tgacttgccctgggtctcccccggcaaaggtgtacgcgcaatcgttagtgcttctcggtatgcccctcactttcaggtgcggcg

SEQ ID NO: 35725 - DNA, 61 bp, Chlorella protothecoides
ttcacagggcgtgtaccgtgcatgtacgctatgcaacgccgcgtcggggtcagagtcagtc

SEQ ID NO: 35726 - DNA, 61 bp, Chlorella protothecoides
aagcacggcagctggccccacctgtccttcatccttcctcaggacaccccccaccgcctgt

SEQ ID NO: 35727 - DNA, 61 bp, Chlorella protothecoides
gctgctgcccgccgccgggcgcctggtgaacgccgcggtcgcgtcgctggggccagagtac

SEQ ID NO: 35728 - DNA, 76 bp, Chlorella protothecoides
ctgtgcccactctgtgcatggcagcatgggagagtcccagtcggttgggggcatgggagagcgcacgtgccgtggg

SEQ ID NO: 35729 - DNA, 61 bp, Chlorella protothecoides
atcgaatactggactattcctgggctttgccgagccgatgcagactggaacaagtgatgat

SEQ ID NO: 35730 - DNA, 127 bp, Chlorella protothecoides
gggatgagatagcgccgtgctcttcggcaaggcagctggataatcagccctcaagcggcggcttcaggccgggacacgcctgcaccaggcttgaacactctcaagccatgctgccatgggccatcct

SEQ ID NO: 35731 - DNA, 80 bp, Chlorella protothecoides
agctcagaagcggtgcctcggcgaggcccaactgaggtggagctggtccacgaaaggcgagactggcgagacctggagga

SEQ ID NO: 35732 - DNA, 69 bp, Chlorella protothecoides
cacagaaggggtggagatctccctgattttaaacatgatgggagtgctggagtgctggagggtgctgcg

SEQ ID NO: 35733 - DNA, 119 bp, Chlorella protothecoides
atcgacctcgcatgttggcatcccgggtgtccaggagccatggtgtcggtctgatcaggccgatggctccccgatcaagcgatccaggcgatcgggagggcatcgtcgtcggcagcaac

SEQ ID NO: 35734 - DNA, 15504 bp, Chlorella protothecoides
  modified_base (1031)..(1040): a, c, t, g, unknown or other
  modified_base (2928)..(2937): a, c, t, g, unknown or other
  modified_base (3004)..(3013): a, c, t, g, unknown or other
  modified_base (3112)..(3121): a, c, t, g, unknown or other
  modified_base (3616)..(3625): a, c, t, g, unknown or other
  modified_base (3820)..(3829): a, c, t, g, unknown or other
  modified_base (4220)..(4229): a, c, t, g, unknown or other
  modified_base (5199)..(5208): a, c, t, g, unknown or other
  modified_base (5718)..(5727): a, c, t, g, unknown or other
  modified_base (8263)..(8328): a, c, t, g, unknown or other
  modified_base (12421)..(12430): a, c, t, g, unknown or other
  modified_base (13316)..(13388): a, c, t, g, unknown or other
  modified_base (13821)..(13830): a, c, t, g, unknown or other
  modified_base (15395)..(15404): a, c, t, g, unknown or other
gacggcagcgagtcaccacaacctgcaccagtgtcaacagtgctaagattctggtcctcgctctccatccaccatgcagcatgtttgtccagagcggttgcggatgcggagtcatgcgccggattttcaactgtccgtgtacagggttcgggataagaaatgctggccccgaatagatgaggcatgcagactcaggatggcaggtgggtcactgtgaccctgccgcatggtctccagggccaggaccctgccccatcttccccgccgcagccccgctggggtggccagtcacggggcaaggcaggccatactgcgcaaaggtggtgtagatctgcatcttcacccggtccagaccggcctccagcgagtccagcgccgggcgcacccgcagctcaaatgcctcagggctgcctgtgcattgcggatgttttgaatggctcactgagcacccagcacctggtcatggcatccggggcttgcgggccgaacctacatcagattatgagcccatgttccaatggcatggggcgcgaggccattttccccggatccacagcccctgtgcctaccagccagctcatccttgaagtagaagtcgatgacataccgaacctcctgcccgcaccgatcaatgtaccagtcatggcggtcaaagggtaacggccccccaaaccaggaccggatgcgagccaggggactgcgaggggtgggtggggatgaggagtcagggaagtggcgccatacacgctggcagcaagtgcattcacagacacgaggcaggtggaagagccttggaggtttccatgcgtccgaaccttcagggcatgcacaaccctttccgagcagtacacatacccaccagctccctcaaaactaagataatatccatactctgcggcgcacactggcccgagttctccctggctcacccattcctcccctattcccgttctcacctgaggtcatctggccgtcccctgaacctgagcagggagggcgaacagcagtgatcccggtgcagcgattcccannnnnnnnnngcctcaaaattaagatactcgctatactctgcggcgcaaactggcccgggttacccctggctcgccctttcctcctctactcccgttctcacctgaggtcatctggtcgtcccctgaacctgagcagggagggcgcacagcagtgatcccggtgcagcgattcccaggccatcacatggctccatgtgatctcgttcatgctgttgtgggcgtggatgacagagtccatgtcgtcctcttcgatgtcgtcgccctttcccttgcgacgcagggctgccaacgagggcatgggtggatgaggggcatggggagagggatactactggaaggcgtgcaaggagtgtataagcctgtccttctgccgtgctgcaacatctgtgaggccttgtatcagggcgaaacaggtgccccggacgacgcaagccacacgtaccgttgaagaacatctgtggggaggggtacacccaggtagactccgtgttacccttggggatattggacaccaccctctgtgtggacagcagcttcttctggccgggggatggctgctggttgggctcggcaggcatgttgttgctggggtccaggatttcggtcttggctggggcaagctcgtcgatgcgctgattgtacacattgtacaccgctttgacacgaagggactccggcaccggacaagacgagtctccttcgctagtgctcagctctgatgcgccgttgctgccaattgcatgattctctttgctctggcctgcgcccatgcctgtcccgacggtcagaggctagcgagaggataggcgtcttaaaatagtccttctataggaatcagactgtatcctgtaaaccacggattaattgtcatcttccaatggccgacggccccctgtattactcacatgcaactctgcggagaggtcatccgcgcccgcctgagatctggaattgaaaactggacgggagctgcaacgggagcaatagcattgggcccccacgcctgcctcgccaatcatattagcaagcgacaggaagtaactgtgaggctacctggatcaatcttcgtctgctgttgaaattcgggatggtgggccgggatgaggacgagtaccccgacgaggtggaggagcgattggtgaatgaggaatacaaagtctggaagaagaacacaccgttcctatacggtaaggagccgaggacgagcggaacgaacaccatggaacgcccttcccggcagacgccctcagagcagctgtcgtcaagtgcctgcaatccccccccgccgcagatttggtgatcacgcatgcgttggagtggccgagtctcactgtgcaatggctgccggtgagtggtgttgacctgggctgtcacgcaggacgctggtccaggggcttggagagttgggagccttgtgtgtgtcgttctgggacgctcaagcctccaggcccgctgtccatgcagatgaaggaggagaacacggagcagggtgtttccaagcagcagctgatcctgggaacacacacatcagagggggagcaaaactacctgatgcgtgcagaggtgtccctgcctctggaggagacggagaccgacaacaggtgggacgagtaagcctgggcggctggggatggagcttgacaatctcttgatggctaaaaatcacaggttttcactcacatccacacaaactccccatcctccagagggtacgacgatgagcgcggcgaagtaggtggctttgggggcaccaccggccgcatcaacatcgttcagcagatcaaccatgatggcgaggtcaatcgcgcccggcactgtccccaggcgcgtcttatgtgtgtgtgtgtgtgcgcgcttgggctggagcggctgacgacgacgcttctgtgtgctgggnnnnnnnnnntgagtgagcctgggtggctggggatggagcttgatgatctcttgatggctaaaaatcacaggttttnnnnnnnnnngacccggctgagggctggcgtgcatgctaagcccaggcaaccactgaccctcttctcctcggccccatcctcgcagaaccacttcctcattgccaccannnnnnnnnngtgtgtgtgtgtgtgtgctggggctggaacggctgacgacgacgcttctgtgtgctggggtttgggagcactggagaacccagctgagggctggcgtgcatcctgagcccaggcgaccactgaccctcttctcctcggccccaccctcgcagaaccacttcctcattgccaccaagaccgtcagcgcggatgtgtacgtcttcgactactccaagcatccctccaagcccgcgcccgacgggctctgcaagcctgacatcaggctggcggggcacaagaacgaggggtatggcctgtcctggagccagctccaggagggctacctcctctccggctcagacgacgcccaaatctgtgtttgggacgtcaagggcaccacccaatccaaccgggtaagcggaggcggtcggccggggcccaggaagaccgtgttggtggtgcaggtttcttgcggggtttgccacgacgctgattgagcggtgaagggcacctgannnnnnnnnncggtggtgcaggtttctcgcgggggttgccatgacgctgattgagcggtgaagggcacctgaagcgtgcaatggggagagcttggttgggcgccactggctgaagagggtgtccatcttgaggcgctctgtgcatcctaacgacatccctccatccagtccttaccttcaccgaccccttcctcgcagcaactgnnnnnnnnnnggagcttgattgggtgccactggctgaagagggtatccatctcaaggctctctgtgcatcccaacgacatccctccatccagtccttcccttcaccgaccccttcctcgcagcaactgcaagcgctgcacatctaccaggggcatgggggtgtggtggaggacgttgcgtggcacccccgtcatgcccccattttcggatcggtgggcgacgacaagaagctcattatctgggacatgcgcaagcccagcgaagggggtgcgtcagagggcggggtcgggtggggaccgggacgaggacgtgggtgataggctgccgatgagctttcaataagtgccaccgccatcctgcaaatgcctgtcgcccgctgtcctgtcgtgtcttcaagacannnnnnnnnnggagggcggggccgggtgggggctgggacgaggacatgggtgacaggctgccgatgagctttcaatacgtgccaccgccatcctgcacatgcctgccgcccgctgtcctgtcgtgtcttcaagacatgcctctggtgctgctggcccaccacccatgcctgaccccctcacccaacacacacgcgcgcaacagccatcgatcagtcgctggaggcgcacggcgctgaggtcaactgcttggccttcaacccgcacaacgaattcatccttgccacggggtcggcggaccgcaccgtggcgctgtgggacctgcgcaacacatcgcgcaagctgcacctgctggagtcccacagcgaggaggtgttccaggtgggctggagcccccaccacgagaccgtgctggccagctccggcgccgaccgccggctcatggtctgggacctggcgcgcatcggcgacgagcaggtgggcgccctgggagggatgcagtgcgtgggtgggggaagggggtgggtttcagggtgttgaggctggatttggaggggcatggcgtgctgagccccctgcgtgccgcatgggttgctgtgccagtgcgctgcctgcaagcggccgggccaaggatgttgcgagggagctgccacgaaactccgatccaccatatgcccaacacgcagtcgcctgaggacgccgaggacggcccgccggagctgctcttcatccatggcggccacactgccaagatctctgactttgccttcaatgccacggacgagtgggtgatggcctcggtggcggaggacaacatcctccagatctggcagctggcggacaacatctgggcggactgagggattcgaccaggcgaggcaggtgttcggctgcgagcagacccctcgggtgggctgtgacgacatcctggggacacagcagcacatcgtgtattcctcctgcctccccatttggtcgaccnnnnnnnnnnattcggctgcgagcagaccctcgggtgggctgtaacaacatcctggggacacagcagcacatcgtttattcctcctgcctccccatttggtcgaccatgaccgtcccctggccacttgcgccacttgcttctgacagcgatttgtacaggggaggggcattcttctcagcagcaaagcgcttcatcagcatggggaagggagtggacgcaggctgcacgcggtcaaccagcaggcactcagatgccaaagtcgaagggcaccgccacgctgtttgtcgcaaagttgttggctgcgcgcagggaaaggggggtatgtggatgagtcgagtgtccacatcccgaggcaggacaatttcaagccttcatcaagggacttcaaggagggcgcggatgaagaggaagaatcccacataaacagccagccaggatcgacaccacatttgagctgtgcaaacaggaccctcccggtccaagcatcaactcaccccaggggtcgccgaggtgtgtgcnnnnnnnnnngaaaatcccacatacacagccagccgggatcgacaccacattcaagctgtgcaagcaggaccctcccggtcctagcatcgactcaccccaggggtcgccgaggtgtgtgcccagggcttggagtgggctgagcccattggctgcgtgctgggagatgatccccaggaaggccagcatggccagccgcccgttcttgatctcctacggcagcagagggggccaagggggggctgagccttcctcaccagcaagcacagcctggatgcccaggacacactgcgaactgtcgtccagtgcgcaccttggtcttgagctcctccaggttgcccttggacagccccagggggtcgaactgaccaccaggccagatgcgacgctcgccctcggcgccgttcctgaggatctccacggagccgatggcgatgaactcctgcgcgatgcaccaaatgccttgggatgtggaccgagccttgtacctcatgtgtggaaggcatggcctcacaccaaggcctaattttgtccaaaaccaatcgagcattgctggcaggacaactctcaaactttcccgcttcactcacgatggcggagagttcgcccaggttcagagggatggggaccccaaagtaggtggcaggctcgccgttgatgacggggaggggtgctgagtaccagtcaccctggcccaggagctctgccccaaggatgcctgtggtgcgggggcgccgacagggttggtgagatgaaaatgatgagcggcaacattgcaccagggaagactttgtgccctctttccccgaagcacccatctcacctgccactcccaacattgcccatcgcccgttgatgagctctccctcctggaagcgcgtcaggttctcaggaacagagccgagacgaagggggtcttttgggggggggagggggggggatacatggggtggtgaggaaagagcatcagcgagactgaagcaaagtgcaagtcaagccattttccagcaaacagcatgctgctctgcattctcctgagaatcgtcatgagcacacaagctcagctcaccgaatccgtaggacctgcggtgcagaagtgtggaaacgggtcatgacgtagcataccaactcacaagtaggacaaccccatccatgtcgatctgtctgctcggtgggccgggcccttcccaatatcaaggactcacgctgggagcttgttgaggtagtccggggtgtctgctccggggaaccagttgcccgcgctgccggccatgaccaccctcgacccgttgctcggccccatacaagggcgccgggcgaccgcccgcccgccatgcacgaagctcgctcctgagaggcaggtcgatgccatggtgccgttcagtagatcaactcagggtgtcgaggtgatgagatcgagcatccagccccgcatcaccccgctgtaagtccgctagccggggaggcaatcttcaggatatcgtaaattgatgttggaaagcaggaaggcacaagatgatgcaccgattgaggcgacgattaccgcccgcctgagcccattgagggaggaatcgagacttgttatcgccccaaatagctccatgatggcgtgcatgactgtgcagcccctggcaactgcccggccctgtttcgcgagggcactgggggcaggccccctggtgggcccacgcccctccggcacagctcaggtgagcaagcggtggtgcaggggcgcagcgggtcccttggtcctcttgaatagacgcacaacggctcatcccgcccggcacagggctggaggatcgcggctgagaagaccgagtctgcgcccaagaagaaggtggtggatcggcccatctggttcccgggcaacgaccccgagattcccgactacctcgatggcaccctggccggaggtgactggggtgttgtggattctctctctagactcccgagcccggtttgccccccccaccccccacccccactgtttgtcttctgtgtctaggtgtcgccatgaattgtagaggcatccatgcatggagcaccagccccaccacattatctctgccctgttccttggaaacaacctgccccctctctcacctcccccccgttctgcagactacggcttcgaccccctaggccttggctccgagccggagcagctgcgctggaatgtccagtctgaggtctttcacgcccgcaccgccatgacggcggtggccggcatcctggccgtgtccatcctgcacggcgccaaccccgcggtgccgcagtggtacgacgcgggcaaggtctacctggagcagaaccccaacgtgtccctgggagcgctgatctggaccaccatcgcactgagtgggtttgtggagttcaagcgcctggcggactggaggaagcctgggagccaggccgaccagtggttcctggggatccagaaggagttcaaggtgagccagggtgtggggtgagaggctggagagtggggcatgcctctctgcgcggcgggtgggtgatggtgggaatctagagggcgtgcggcacnnnnnnnnnnnnnnnnnnnnnnnnnnnnnnnnnnnnnnnnnnnnnnnnnnnnnnnnnnnnnnnnnngcagtgcagcaacccatcgatccggcgaagccctcaaaccaccgtgtcgtccatggacctgcagggaaaggagaatggctacccgggcggtgccttcttcgaccccttggggtactctcgcggcagcgaggccaagtaccaggagtacaagtggaaggagatcaagaatggccggcttgccctggtgaggcatgggagcctgtccggctgggacagcagttgaatgaccatggcgttggacccattcctttccggtagaagcaatcatcgcaactgtagaactccaatgcacaaaccacaaccctgcgcacaggtggcgctggtgggctttgcgctccagtacctggcaaccggaaagggacccctcgacaacctggccgaccacctggccgacccgtggcacaacaacttcatccacaacggagtgtctgttcctttcatcaagacgctctgaatatgtggtgtatgctgcacgagaagaagtcatgtttgttgcaaggttcccgactgttcacctggggcaggctgtcccatcgcaatctgtagaaataccccttctctgggagattatcatacagacggagtccgacttgggaagaatttgtaggcttggtgaaattttatcgtgtggggcggaggaggatggtcgtctggctcgccatgatgaaatccgcgaggatggtggccctcgccgcggatctgtttgttacccggggctcgacagacgcagcacgcccgacaggtccgagaggtttgaactcggcgcccaggaactgtgcagaattgctaaagtacgtaccccagacacatctgaagaaaagatgggacactccacaagtgtcgaggggagactgttgtgatgggtgacggcctcaaggcgaccccggtgctgcgccctataaatagcaacctcgcagcagtatccggctggggcaaggtgagcttcgtgaattgttagagatatcgcttgttcgcctagcatgtcgattcgacatggctagttgggctcggcatgagttccaggctttactgagcgcgcccttgcagggaacagttgacggcagtcgagctccccgggccgtggcgcacagaccccactcccgacgagatggcatccccctgcgtcccggaactgggcgtcagccttccaaagtccgcctctccgttcggctcaggtgagcatcggcccatcggatgtggatatttgtcgtggcacttgtggaatgctcaggttccacacctcacccacatgcagggtggatgcctggcaagccggcgacttccagctggactccgatgagctcaaggacaccatcctcttccaggccacgcgccagcgcgcagctgccctgcagatcagcttgagacaggggagtgggcgccaccacgtccgccgaccgacgcaggtggcgctccctcccctgcctcctccacctccggaggtgactgaggaggagaccgtgctccaggaggaggagggggcagcggccgcatcggtagcgggcatggcggcggagggccaggcgaggccggctgccacccccccggtgcagctggcgccccaccccagcccagcgtgcacgatgccggcgtcctcccagggccggccctcccgctcgcagacgagggtggagggcgtgcccgagtggttcacggccgccagggggaaggggcctcgccgcagcgccccgctccatcagccccgggccacgccgcgtcccgccttcacgcccgtggaaggggtgccggagcgcgacagcgtggcgggcccaggcgccggctggccccggggctggctccacatggccggcggcggtgcggatgccggcgacggcgaccccgccaccgcatcgaccggccgggctcggtctgcagagggccgccgcgggtccctggacaggaccctggacatgcgcacccccgagcccggcgatcccgcgccgcctcagccccagcccgggcctgtaccgcagtcggacgacgacgacgacgacaactgcgactttggcggccaggagtatggtgcggagacggtcgacggccgaaatttcgaggcgggcgggggtgtctgtgggattgcatcccccctgcatcctgttctgtggtgtggtcgtggccccagcctttcaaccagtacacttcaccaggatgctctgaaactcaatcccaccttcatctgccaggtgacgggtgggacgaccatgatgacggcggcggcgacccggtgcaggaccccacgccattcgcagaggtggcacacacgggcacagacgccggcgtggcaggccccacgccgaggcccgcgctcaacccggcacccgcgccgaagccgcggcgacaggcgcaacgccactcgcctgggcacaggttgcgcaatgagctcggcaagcgcaagagcctgtccagcggtgcgggggtgatgtgctgggtgtggcgaggctggaatgtggggcgcctgtgtcgggtgcgggaggccttgtccattcagggtgaaccacatggtctgggtatgactgtgcgctcatgctctgcagcatgcacctgagcaggccgctgtctggggaggacgcagtgccccaaacctcgagctcccagccccactaccccgcaacccccctcccgccccatgccagcccccggcatcggtcgctatgagatcgcgcccggcatccggcgctccagccgcgccccggagcggccgctcatgtggtggctgggggagaacaaggagtactcccgcagcgcacacaagtgagaagagtggtggggtcgtttggggcaaggcgcagcgtatgatggccattgaaagcgtcgagctcctgctacgggcgtgtgcgcatgtcgccgcagtctgactgcttcctgatctgtcgcaatcctcgccaaggtcccccccagccttcacacaccttcttccaaccccttgccccacaggaccatgcccaccatccgcgccatcatccaccacgaccccaacacgccctggcagacagtgacagaccccttcccgggggcaaggaagcgacgcgacgcgctcgccgcggcgaagctggaggcgcggctggacgccgcgggcgacgccgtcccgccggctgcagaaggcgaggccgaggccgctgccagtccccgtgcatcaggaggtggtgccaagcacgcagcaccggcgcgcggggggaagggcgggcggggacagggtcggcgcacggcaacttcctccagacgatgactcggcgggatgcccgcctccatgaccttgaccccctgcttgcccatgttgttgcctgacgcccggcccccggcaacgcacagccgccgagcccgctgccttgacccttccgcctcatttacaatgtcacactgggccagtgcaagcagggagcatcggagaggaggggtgtcattgggagtatcaccccccttccccatctgcccatcatcatcgccgtgtggtcgtcgagcgtggcttgctcttggcctccgcctcggtgacggggtgtagcagtatatgattcttggccgtggccgggttgtgctcctgcgcgccccgcatccagtcgtagctgacggcgtaggcgaagatgctgccgtccttgctgtaggcggtgcaggggatgggggcgttggcggcgctgaaggccttgagtcgctgcttgctgtccttgtcccagaagctgaaggagccgtcgccgccggcgcttgcaaaggtgccgtactgggggtggaagttgagcgagttcacggggaagacgtccttctcgggcctgagggtgagaggcaaggggaggggagctgagtgggaagcctgggcggtggggcgaaccagggaggctgggtggcggcttggggacccctgagcacacgagaggtggcaagcaatccgctgctggggtgcagtggcctctggtggtgcccaggtccatgcaaggagcgacgaagatggaggtacaagaccttgtggcgcgcacagggccgccatcccccatcttgaatccatctccctgatcccctgccggtgctctcctccctaattcccccccaaaaaacctctggaaaaagcgaatgataaaactcccattcacctgtggcacttgannnnnnnnnntccccccacccccctaaactctggaaaaagtgaataataaaactcccattcacctgtggcacttgaaggtgaagtttttatccttctggctctcctccacatggtgcacggccaccctgccctccaccgaccctaccaggtaccccgtggcgtccgggaagcaggcgaggcagcgcgtctggaacttgagcggcgagtggatctgcttgtacacctgctgcggcgcctgcaggttgtacacctggatgacgcggtcggcggtgcccaccaccagcagctgccccgtggtgctcagcgcgtagcacttgtccggaagctgctgcgtgtgcaccgggttgggcgtgcgcaggtcccagtacttgagcgtgcggtcccaggaccccgtcaccagcatgctcaggtgcgggacgtaggcgcagtgccgcaccggctcggcgtgcgccgccacctgctgctgctggttggtcgccaggttccacatcttgacgccgttgtcacacccacctgcgcacgcggttgtcgcgtgagtgttttggggtggggggcacggcgcatggggagtgctggggacgggaggtgtccatgcccagcctgggaaggctcctccatgctcctgcgaggacaagcgggcccacacagcgcatgaaacagaccaggaacagtcaaccacagcatcattaccgcaccggcgaagacagcggagccatccgcgttccaagcgctgcacaggacgggcttgtcggactgaatggcggccttggggacggcctgcccggaactctggacctcccagcacagcgtctgcccgctccaggatgtcgccacgaggtggtttgatacggggctgaagttcaagctgctgacgccatcgctggctgtgggggannnnnnnnnnnnnnnnnnnnnnnnnnnnnnnnnnnnnnnnnnnnnnnnnnnnnnnnnnnnnnnnnnnnnnnnntgacttcaggcagccaatcggggtcatcagtcctgcattgggtccgagcagctctcacgtggagatgtgacctcggcgtccttattggggttgtagttccctgcagcgccgaagctcagcgccccgtaggaggccatggctgtctagccccagcacccgggtgcccctcgccccgccaatcacagcgccagcacgatgagggtaatcagatggtttgttccttgacttgcgagatgttaagatgttgtacaggtctgcccatcaccgaagagttgtcgatttctcagacaaattttgttttggggcgctcgaatgggacgacgagatcacacccctccatacaagatcggtggcacgagcaagcaacatgtagcaatttgaatgccaatccaagagacccacagtcgacacaagcaccaaaatcactcttcannnnnnnnnnacgagatgttaagatgttgtacagatctgcccatcaccgaagagttgtcgacttcccagacaaattttgtttggggcgctcgaattgggacgacaagatcacacccctccatacaagatcagtggcacgagcaagcaacatagagcaatttgaatgccattccaagagagccatagtcgacacaagcaccaaaatcactcttcatgggggtgatacccaaagctgaagctctctggcaccgaatcctccttcaagggggaggtgtccgatgcggagtccccattctctgcagaggctgtgccggctggggcaggggctctggcaggcaccctgtcctcgcagccgtctactggtgacagctccagccccttgtgcgcgccttgacgcggcgtgggcggggtgggctgcaggactggggctggcggggagtgcggtgccgggccccgctcccctcccttcgtcccgaatggcgatgcaaagagggcgggcacggcggcgcggggggtggtcaaccccagcccgccccgctcgccgtcggcgctgaccatgcccatgaactccccgtgcagcctgtagaaggccgacagcagggagagcaggatggggccaaagaggcagccctgaatatttaggtgtggagatgggtggattggtgccaggaggaacatggtttgggtgagacccggaccttgaacccatggtcctcggcgcagccaggcgtggcactgctacatcgcctgcttcggcctggatgagtagctgcgtgttatcacagtgtggcactggatgtgccaggcccgcaatcaagccgctagacagcaccacactgcccacctggaaggggttgtcaaaggtccagattccccccaggatgcccagggacaggaggtaggggtgcccccctgggatgtcctccaggatgagcgtgtcgcccaggtagtaggcgccccaatgcaccagcagcagcacgatcgccccggggatgtgcccctgggccgccagcagcccgctgccaggcagcgccacggcgtaggtggggatgaagggcagcagcgcgcacacggcggagaggacggcggcctgcggggcgggagggccggggttctgtgcgatggcggcgcaggtgtgtgccctgggcttggaagaggactgctgcaaagccacacccatggccaggaaggcattgcagacacctggcccatctactcacggtgtaagcgaggggcaccccaaacacccggaaagtgagccaggtgaagaccccgtggaaagccatcagctttgcggacgccagcagcacgcctgtgggtcgggtgggaggccgaggatgggtgggtatgcgcagccctgaatggcctggcatgcgtaccattggggcttgggagtgcaggactgatgggagtcaaagccagagaacaagcgcccgcctggttgtttgcatgcattcccctcccttcccctctcaacctcgccactttcacgccacccacccactcccgcgccgctcccatgggtaccctgcctgtcgctccttcttccacccccatcctcccccacccccaccnnnnnnnnnnactcaacctcgccactttcacgccaccaacccactcccgcgccgctcccaagggtaccctgcctgtcgccccccccttccacccccatcctcccccaccc

SEQ ID NO: 35735 - DNA, 130 bp, Chlorella protothecoides
aggccaggcctgctccaccgaggactaggggtttgtatctggaaggagtaggctggggggtggtggtcacgtccctatcccatctatgttgaaaagtatgtataaagctgcacaccactgaatgggcctc

SEQ ID NO: 35736 - DNA, 1334 bp, Chlorella protothecoides
  modified_base (538)..(547): a, c, t, g, unknown or other
  modified_base (687)..(845): a, c, t, g, unknown or other
  modified_base (1101)..(1110): a, c, t, g, unknown or other
gcatgcggcgctgtcccctgtgtggggccgcatgcggcgcgggctgccgcactctcccctgcaaggcggcgtggaggcaaggaatcggcatgatgggtttgcacccaccttcttccgcgtcgggcgcccgggcagttgtgacttccaggccccttattcagccctgatgggagctgcgcggaagccgcaaccccactcacgcgcacctctccccctcccaaacccaccttcgcaggtgggggccttgatgggcaagggcggcgccaacatcagccaggtgcgctccgtgtcgggggcgcgcgtgcacctgtccccggcgacggagggcgagccgggggccacccgcgcgctggaggtgtcggggtcggtggaggcggtgctggcggcccgcaacatggtcaacgccttcctggcagtgggtggctgcagcgaggcccagcccgtctgactgggtggctgatggcccgccacctcagcgccacatgtgcgggtgaggcaccgccccggcccgcctccttgcgactcgaggggctgggtnnnnnnnnnncgtgcgggtgaggcaccgccccgacccgcctccttgcgactcgaggggctgggtggagcctgatccacacccacaatgacctgctgctgcgattggacccacgaagcggacggcacctccgcaccggccagtggaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccccccaccatgcatgcattgtaaagctcgagcgaccagggtgtcgtgccatgtaccagttggcaaacaggcagaggcttcttcccagtgcggctgcctgtcccctcaatcaatgccatccaatcaatgccatgaaggccggggttctacaccaagggccgcatgcgacgaagcccaaaaaccacccctggacggcacagcgcgcaacaagcatgcgctcattcctctcatgctgcctctatgttgcccctgcnnnnnnnnnngctcccagtgcggctgcctgtcccctctttcgatgtcatccaatcaatgccatgaaggccggggttctacactaaggcctccatgcgacgaggcccaaaatccacccctggacgtcacagcgcgcaacaagcatgcactcatacctctcatgctgcctctatgttgcccctgccaggaaggatgcgtgaaccagaccagatcccgggcgttacgcgccccacgc

SEQ ID NO: 35737 - DNA, 72 bp, Chlorella protothecoides
ctgcttgcagatgtgtggtcgacttgaagtgggtcgtctggtgtgagtcgcgcgcagagttgtgcatgggga

SEQ ID NO: 35738 - DNA, 115 bp, Chlorella protothecoides
gtccaccaggggcacgcccgtcgcctgaggaaggatctcagggagggatgatttgggacatgacaggccggatgacggccgcggggtctcacacctgtcattcaagaaaacgcac

SEQ ID NO: 35739 - DNA, 353 bp, Chlorella protothecoides
  modified_base (86)..(278): a, c, t, g, unknown or other
agcccgccaccgcccgctttgccggaagtaacttccagtggtcctcctccactgagaaggtgacaatcaccatcaccatcgtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgaggggcacagatcagatctggaagttcacggtggtcccccacaggcacagacattaccctcgcaacagatg

SEQ ID NO: 35740 - DNA, 167 bp, Chlorella protothecoides
ctgccaatgctgtgagccgacacgatgcggcgggaggaggccgccagcagcctgcaaagacggtggtgggtgtaaaaggacggccatgttgcctgcaccagacacggcgacccctgtctcctcgcaggcatgaccctcgtctggtgcacaccagcggggacagccac

SEQ ID NO: 35741 - DNA, 61 bp, Chlorella protothecoides
gaggagaagctggtggacgtgtgggacaccgagcggtgcgtcaacaaggcctgcaaggtca

SEQ ID NO: 35742 - DNA, 144 bp, Chlorella protothecoides
ggcattgcacctggggttgaaggggtttgccaggagaatctgcggcaggctcgtgtggttggggagcaggcaccacgcggcctgcgcgcatgcggtgcttgtcgacgctggcctcgccccctccctcgaaacacccccacccac

SEQ ID NO: 35743 - DNA, 175 bp, Chlorella protothecoides
tgggtttggggatcaggaggggttgtgagcttggtcagaatctgagggatgggtggcactggacgcagggtgggtctgagctcagcagccaatgctggaccatggcgccccccacccgccctccctttaaccgctggacctgcaagcacagccggattcaaggcccagcaccctc

SEQ ID NO: 35744 - DNA, 123 bp, Chlorella protothecoides
tgtgttggagggccagatggtgctttcatggtttaagtctgacttcctgtgaaggcctaccgaagtgaacctcattaagatgctggatcttcgtgcatggagcacagcaaattcaattgccag

SEQ ID NO: 35745 - DNA, 72 bp, Chlorella protothecoides
cccatgctcatgcctgccgtgggtgtgggggaggggggtgaagaggctggtttcggtaccagagggggacac

SEQ ID NO: 35746 - DNA, 25694 bp, Chlorella protothecoides
  modified_base (2069)..(2078): a, c, t, g, unknown or other
  modified_base (2823)..(2832): a, c, t, g, unknown or other
  modified_base (3054)..(3063): a, c, t, g, unknown or other
  modified_base (4399)..(4408): a, c, t, g, unknown or other
  modified_base (5665)..(5674): a, c, t, g, unknown or other
  modified_base (6244)..(6253): a, c, t, g, unknown or other
  modified_base (6380)..(6389): a, c, t, g, unknown or other
  modified_base (6482)..(6491): a, c, t, g, unknown or other
  modified_base (6666)..(6675): a, c, t, g, unknown or other
  modified_base (7665)..(7674): a, c, t, g, unknown or other
  modified_base (7969)..(7978): a, c, t, g, unknown or other
  modified_base (8253)..(8262): a, c, t, g, unknown or other
  modified_base (8593)..(8602): a, c, t, g, unknown or other
  modified_base (9032)..(9041): a, c, t, g, unknown or other
  modified_base (9324)..(9333): a, c, t, g, unknown or other
  modified_base (9591)..(9600): a, c, t, g, unknown or other
  modified_base (14702)..(14711): a, c, t, g, unknown or other
  modified_base (15945)..(15954): a, c, t, g, unknown or other
  modified_base (16039)..(16048): a, c, t, g, unknown or other
  modified_base (16484)..(16493): a, c, t, g, unknown or other
  modified_base (16731)..(16740): a, c, t, g, unknown or other
  modified_base (17100)..(17109): a, c, t, g, unknown or other
  modified_base (18044)..(18053): a, c, t, g, unknown or other
cggctgctggctgcagtgccgtcggaggtgtcgtgcgacagcccgctctcgccgctggtcgtgcggtcggggcggggggcagcggggggcggcggcggcgggacgaccacgccgtgggagggggcgttggggccggggccccgccctgccgtcgccgcccctgccgtcggctgttggtggaaggagggggggaacgcctcgccgccgcgcgggtgcgtcggctgcgggacccgagggggcggcgggggcgggggcacatactgctccacgtactcctccgtgcgccggaagtcctgactctccagccgccgctcgcggacgccgccggagcagcgcggcagggcgtcttcgttgaggtggggcggccgcatactgtgagcgtagccctcgccgccgcggtaccagtcccgcccgtggggggcctcccggtagccggggccgtcggggccggggccggggccgtagccgcgccggtagccgcggtggccgccgtcctcgtcgccgggcggggcgacatagccgcgctcgtcaccctcccagcccatggaggagttggggccgtgggggccccgcacatctagacccagggtggggaactgctcgcggctggcctgctccatggccctctgcgcgatggggtggggagtgtgttgaaggcttgagtgctggctccacaggctggcaggcgcagtcaccggccacccatcccacgagaagcgaccggcgaacgcgaacggaggctgcgcaggccagcagatctgaattcttctccagcgccatgatgtaccccatccaaacacacacacacgccacattaatccctcacctttcgctcctcgggcatgcccagcccaccccaggccggggtgggtcctgctggaatgacgcgggagggcgccaccgcagaagggatgccctcgccgtttgcggatcggggctcggacgtcagattcgctgcctgctgctcgctgcaggaggaggcggtgggggactcgggcgcgccagaggcggcgccccacccgccgttggcagacttgcggacgaggtctatggacgggtcgttgccgttgttctccttgcgctgggaggggagattcaccggcttcggggcagagaccttgcccagggacaccatgcgccgaggcctgcgcggcgggggatgccgcgaaactttcagtcttgggagccgtggtgcccatgtccaaggagacaatggcccatgatattcacgtgtccagagcaaagcaactctacagggcgtcacagagagagacagagaccccataccctcttgtgcacccaggtaccctgcaccacagccctccccaccttcctccaggtcccaacatgacgaaatagcaagcgtcacacaatcactgggtccgaaagtcctgctgtggtgccgtagggaggggcaggaaacccgggctcagcgcagtcggagtcgggcgggtccctgatcacagtgccggcggatcccgaggccctcacatgaccacatccccagctcgcaatgcccccaccactgtcagcatggtagcagcatgctcgtaatccgaatgtgggtagccctacccgatcccctcgccacctgcgccggtccacagcaatcccgcggagcgggagtcacgagaagatggtgacgccggtgccactcgctacaatggaatcttaggacctcacgctggactgacgcgctcacagagcagactggaaggcgcacctggttcaaaaggtctgagcgcagtagtggtttccccgtttctcgtttcctcatcactggaccagggcatgaggagaccctctcctcccgtggccgtttattccatgcggcgcatacggtgtcggtgtgaactcctctagggcgaaccacagcttttcgttccgcaatctcgtgtcaggaggcggggctggggaaccagaggacagtgccctgccgagcctgactgtgagaggagctcatgacaggatgccggcctgagtaattcgagccgagctaaatcaatcattatttgatttatgatgacaaattattataaaaagacatcaaatggccttggatggcaggnnnnnnnnnnctcgagccgagctaaatcaatcatcattgatttctgatgacaaactattatacaaaagacatcaaatggccttggatggcagggaaagtgctcaagctctccaatcgtcagcagaggcacgcccagtgatcaagattcgtcagtctgatcgcattcagcagtcctcatccagggaagaaggacgtatattgtattaattacgatagcgtgagagtcattaccgtcttaggatcgtatgagctcctggactgtgatccaagcgctctcgatttcgggtccatgtgccggccgggggtagagggtgggggggcgctccagcttgcacaagagcctgcacactcgagcaacctggcgtttgaaatctgacagaaatctgatcagaatagaatcatggcgagtcgcaatcgcaaggaggggtccgccgaggagccggtgctcagtctgcaattggactcgagcacagcggggctggaaccgagggaggtggatagcgacagcatcggcggctttcaaacaccctgcacactcaagggtctctctgcgggcgcgagcgggggagcgctgggcttcgtgttcggctttggtacgcagcagagtgtcgggcgggggagcctgcctggactcggtgacttgcctcgtctgcctgccggcccgctgcacacacctctttcacctcctccaatgctaggggggtattggtttagccaacgcttaaaaggcaacctacgtggctcgttggcggagnnnnnnnnnntgctgcacacacccctttcacctcctccaatgctagggggctattggtttagccaacgcttgaaaggcaacctacgtggctcgttggcggagggatggggatcggccaaggtacgagtcctgttgtggtgggctcctgttgtggtgggctcctgacccgttggcacacccctctgctcagtatggataggtcctctgctcgatacagctctcgtgcctttcnnnnnnnnnnactcgtaggcacacccctctgctcagtatggataggccctctgctcgatacagctctcgtgccttttcacttgcagacattcgcgatcatggggggcctgtacgctgccgtgggttgcttcatgcagcgcctgcgacaaagagaggacggtgagtgtcatccttcttggaagggtgtccacaaggccctgacctggaatgactcagaggcccttcccagagtgcgctggctcgtccctggactgaaatctgagcttgcttggcttgcagcatcagtttgcttgaaccctctccccgaacctcctgtttcaatccacagcctggaacggtgccgcctccggctgcgccaccggccttgccctgggctgggccaacgggccgctcggcgccctccagtcctgcgccatgctgggggccttttcctacttcatggacggcatggccaaggtcccgcccgccgccgcggcgcagcgcacggccggcgggcggggtcatgacggcgactgggcgcggacgcccgaggagcagcggctggccagcttccttgcagctcccttcctgcaccccggcagggcccgcagcacgctgcaggccgtgctcagccccgccctgcctctagctgtcatccttgcgccctgccaccccgcctttggcggctgcaggcgcgggggccccgccgtgtgaaggctggggctgaggcccctaccctattccctgtactgcactcatccatgattccctgcagcaatcacgcggctgtcgcaacccactgtgagctgcgcgcaacgcccgcctgccttgtttgagcatccgccccggagcccacccctgatatttccctcctcattcacacgctgctttcccacaaaggctagtgcgggaccccaagcaccgtcagccccggggggggaacaggtcgggcatggcgcgaggggtcatgaaggcgtcgaccaccgcgtcgctcaccgccgcccgcgcggcctggtgtcgctgcaccatcgccgccagcacgcccaccaactcggccttgacctgaccggtcagcagccgccccgcgccgtagtcgcgcccgatctcctcgagccgcgtgtcgtcctgcatgaagaaacggagccactggtaggagatgtccacgtccaggttggcccctggcaagaaggaatggacaggggggtaggggtgacagtaggaggaggggatcgaggcccaacgtgcatgtgagaagagcgcatgtggaggcccagccccccccactgtgctgcagaggagcatgggaaggggccatgctccctggagggtgccatgggacctgaacaaccttggcaacccacaccacnnnnnnnnnnacactgtgctgcagaggagcacgggtaggggccatgcgccctggagggtgccatgagacctgaacaaccttggcaacccacaccacagctgcgacaccgcaagcctcaccattcttctcgtgctcctcccgcgtggcgccgccgccgctgaaagcgtacttcttcaccttggtgtcaatctccttggcggtgtcggtcacgaagatggccgaggcggtgtcggaggcgctcatcttgccgctctccccctgggcacgggcatgggggcgaggatgagcgtgtaccaggtggacgggagcgatcggctggccctcatgacccctgcagtcccaggattccccccacaccaagcccgccttgcctgcagggcggggaagaagcaggactcgatgagggccgtcttgtggtgacccaggcggggggccacatccctcgtcatgcggaagtaggggtcctggtcgatggcgcaggggacgaggcacctggggccgaggaggaaggtggggtttgagggacgactgcagggtcagcaggcggggctggtgcatgtcgacatgagtggtccgacgtcggactgctgtgcacatgctgaaagccagagcgccagcacagcgctgtgtgggccgcacactgctgcaccgggacagggccatgggaaactgggcccaggagcccttgctgcttcccaggcgcttgccgtgccaacgggttaagccccagcctgcatatcggcccccgcccataccccacctccctgtccagaccggcacccaccgaatgtccttccgctccccaaacatgtggggaaaggtgtctgggaaggcaggtgcagcctgcagggtgtcggagggtgtgggctcagcctgggcatcagaggatggtgcaccggaggagcagggctgccggcacgctctcatgatgtgtgccaccccccactgacatgcaaggcagctggggcccactgtacagggacgcaccaagcacctggccccacacgccaccgccatgccccacctgtattgcagggaacgcaatctttccgatgtagtcatccgtggtgaagccaaagatgcccttcacctgattcatggtgacacacctgcaatgggtgtgagtggggacagctggcagacgaggaggcacgaatggtgccctccagggtgcgatgcgcagcatcacacaacagtgtcatccactgtgcagtgggttgctcctcgaggagtgcattacaaatgaccattctcacctctggatgcnnnnnnnnnntagggtgctatgcgcagcatcacaaaacagtgtcatccactgtgcggtgggttgctccttgacgagtgcgttacaaatgaccattctcacctctggatgcgtgcgacattgcggtaaaatgcgcctcccaggtactcaaagtcagagaagatgaaggtcttggtgatgtcaaagccacaggcgatgatgtccctggcattctctcgtgccaggcgctgggcctcctcgacagacagacccctgtgtgagatggatgaggaaaggtgggtgttgcaactccgtgttgcaactcaatattgcgacttagagcccaaggagtctagaccaccctttctgccacaccaaggtgaatggtcactctcccatactacgtacttccacaagaatttctcatcgtcggtgagctggatgaccaatggcacctgtatgggtaggggcccaggcggtgatggggcacatttatggactgacagctgatgcgaaaaacatcacaaaggagcacttgcaccctctatctgaactgcaatgaagaaggtctgatgagaagacccggaccccaccttgaaggcnnnnnnnnnnggttgatgaggcacatttatggagtgacagctgatgcgaataacatcacaaaggggcacttgctctctccatctgaactacaatgaagaacgtctaatgagaagacccggaccccaccttgaaggcnnnnnnnnnncgaggtgggtgttgcacctcggtgttgcaactcaatggtgtaactcagagccaaaggagtccagaccaccctttctgccacaccaaggtgaannnnnnnnnngtcttgcagccattttgtgaacatgaaggggatgagatgaccaaggtggagagcctcgctggatggcccctgcatatttgggcacacaattctgagcatgccatactacaaagtctgttcacatgacgcggcttctgcatgaccatcaaacccactgcacccctacttcttcatnnnnnnnnnncatggggacacaattctgagcatgccatattacaaagtctgttcacatgacggggcttctgcatgacgatcaaacccactgcacccctacttcttcatcattgcaagaagatgctgggcccctcattttattgctctcacccggccggtgtacaggtagaagggttccccgcgctcataggcatcaaggatctccgtcagatccctgcaagagatttcaacagacgagcatcgatgctgagagtccagacagcaaacagtcaacttcttccagagggtgttgctgggtgtacattctgcctggcaacagagacaaaaccagcgccttccttccaaccccgccttcgccaccctcagacctgtgcgcaaagaagatgcctctcctcaggaaggggtgggccttcacccccgtcaccctttccaccctagccacaagctcagggtcgatcttctgacacccaaactgctccaccagcttgttgtagttgatcttgccctcgctgtcggcggtcacatcccagggcgtgaccacctgcgcagattgcatacatcgcgttttgggcatggcattcgaatcgctttatcatcacataggaatcatcatgcagatggtgcgggcgcctgacctgctctgatgcctgcgaggtctcgggctccgcgggtgggtgttcggacattgggctctcagaacgtctcaaaacaccaacatgtatggaactgaggcttcttataagattgattgttgttcaatattgctgcaggtctgcggtctcccacacaggcttacagtcgaatcatgttcggctagtggccgattgagcgcgctgagacagagggtggggagaggtctccatgggtccttcacgctgatgtgcacgtacctcccgcatggagatcgctcaacctggcacaaggagcacgcaaacacacatttggacccgattttttccctccaattgctcaataacgtgtatggtcggggataaaagcnnnnnnnnnnaaaatcgctcaacctggcacaaggagcacacaatcacacatttggacccgattatttttatgcaattgttcaataacgtgtatggtcggggataaaagctttacatgcctgcaaaaacacgggtttcttgtcccatcgacagagtgccatgcctgcagccgaactccatgttgtgacgttcgtctccaatctcgatccagtgacaaaccacgcagcctctgattcagctgtacaaggaggcatccaactcggcagcctgcctaggacctgtgtcaccgtcaggccatcccagacnnnnnnnnnnagggtttcttgtcccatccacagagtgccatgcgttcagccgaactccatgttgtgacgctcatctccaatctcaatccagtgacaaaccacgcagcctctaattcagctgtacaaggaggcatccacctcggcagcctgcctacgacctgtgtcaccgtcaggccatcccagaccggagtttccgctgccgcgcatctcgtgccgctaggatgctgtgcacgatagggtgttgcggagggtgctggtgccatcctggagcacactaccagcccnnnnnnnnnncccgctgccgcgcatctcgtgccgccaggatgctgtgcacggtagggtgttgcggaggttgttggtgccatcctggagcacactaccagccccatcaatctgcacgctgcctgtttgctccctggactcggcaggtgtacgcagtacccccagctcagcagcaccctcttaccagagaaagtcgggcagagtgggggccgactcagagaaaatgatggccctctgcgaccgaagcatgggaagccagttcatttctttgctagatgtggcccgtgagcaagactgatccgaggcagcacccccgtcccccacccaaaacactgagcagaannnnnnnnnncgagcaagacttattcgaggcagcactcccgtcccccacccaaaacactgagcagaagcatgtgatccccctttctaatcaccaggcctacaaagttggtcaaccagccccggcccgacctgcaaatgggtgaaatcgttggagaagagggccttgcagggcaccgtcgtgatcctgcgctcctcctctaggttctcctgcagcctctccaccacagagtgcagctgggaggaggaaagggagggatgaaggtcgatggtgtgcatcgaacaggccagccttctcatcggctttcctgctggctcgatcatggcgccccaccgacactgcaccgcgcccatatatagccattcgaaggcacgattcttcccaagcgccccattccgtgcacgcacgttgagtgagagggtaagatccagctggcccagcnnnnnnnnnncatatagccagacgacggcacgatccttcccaagagccccattccgtgcacgcacattcagtgagagggtaagatccagctggcccagcccggagggccggcgctcgcggaggtgcgccacagcgtccagcagccgcttcctctgctccatgacctgcacgccggaggaggagtggggagttggatggagctgggctgggcagggtgcctggtggtaggtcctttctggaccaagatcccttcgggcaagcagctctcccggtcagatcgccctgtcctggcnnnnnnnnnncgaggaggagtggggagttagacggagctgggctggacaggatgcatggtggtaggtccttcctggaccaagatcccttcaggcaagccgctctcccggtcagatcgccctgtcctggcaccaggccggatgcaaaacggtaccttggggtccagtcagggagccaggcacgaccactccttgatgcactccaccctttccaccccacccagcaccacggtttccctccctcacccggtccaggtgcgacagggccannnnnnnnnngggtgccttggggtccagtcagggagccatgcacgcccactccttaatgcactccacccttgccaccccacccagcatcacagttccccaccctcacccggtccaggtgcgacagggccacggtctggaccctgtccaggatggcctcctgctccggggtcaaacgcacggcgtccagcaccgccagccaccgctccggtgcgaaggagttggaggcaggagtgcgcccaccgcgaatgacctcggcgacgcagccggggcgatgcctgcataggtgccacagccgcagacgctggggttgcaggttgggggggggaaaggtggggaggggatgattggttttgcaacatgaccaattacccaaatggtgctataatctgccgcaaacttcatcccccagccagctgcgggagggaggcagggtctcctgccttccctggcactggcagggagtgcagatgctacgtcgcagcaccctgcaggccccgccagtcctgcactccactctccaaacccagaggaactcactcctcgagcaaatacttcttgtatgcgctgcagcagggcctcatcccggacaccagagtcctgcagctgcaccgcccgccgggtgtcctcccgcagacccctgcacgtcctcacccacacgtcccccagctgctcgacgctcgcgctctggaaggctagcagctcgctgggacgggtaggagcggggaggaagagtgtcaatacagtgcaccccattgtgaggggcacagggtacatgtaccctcccatgccacaggcatgcatcgaggaaagaggcgcaggcatgcccggcatacatgacccaagttcctcgcacctgccatgcaggagcagctcatcggccttcctgtccagctcccagccggagctgtacagcagccccagctgcccggccgtcagcccaggctccctgatgttgctgggcatgctcggaattccctgcttggcgagagagggctctgactgtgatggctcgacacaaacgagaactggatgtgatcaaggtggcatgcctagggtgcttgtatgctggtcagggcgcactgaattgctgcatacgccccactaccgcggggaaaggtcagcggcagaacaacgaggtgtccagcccacaccaactccagcatccctggcacattgtttcgggccgtacccaaaacacacgacaaaaaggtttggcagttttaagtgagaacagctggtatttattaacaccctctccccagcaggatccaccccccagtactcacagaggtctcggcagcagcctgaagaatgtcgatgcattgattccgcacatacagggcgcggttgaagatgtcgtccctgacacgcagcatctcatgttcctgcctagcctcctccagctcagaattcagcttccagggcgaagagagggttcagggtctggcacagaaacagcaagtgcgcacagggcaagactgatggggtatggcagcacctttaccagccggtctgcagcctgaagcgtctcatgatgccagcaccacactcccaaatttctacctgtgcaaatgtgttcttgatctggaccttggccatcctccgctttgctctgtaggtggcctgggccctgtgagtgcatgtggagactttgagcaaggagagcctgaagcagaggttacttgccgggtgcaattccgtgtcaacattagaggacgtctcacagctagcagaataggcgctcacaaggggcagcaacttcccgtggctagggtagaccctcggctgacctgcgatttcgggctttggccttctccgacgacgtgaggggccgaggggtcgtctcctcgctagcagcactccccatttcgtgcatgaagaccatacttccagcgtcagcgagtgcactttcgtccaggagggaggccatctacgtcggccttcaacagggatttcgctatgactggagaggaccgagtgcgctggcacgaggctgctgggtcatcacaggctgtttactatcaggacagatggactgggcgaccactgtcggggcaatcctccctgggttcttcaccagagccattcggagatccttacgtaagcggtctcggttcgagagtcaccaggaatcacacgagcagtacaggcatgcaacttcctagacagaacaaaatcaatgaatgggttccccgcctcattgagatctctccgctgccgctgtatacattctgtgacgggtgtgagaggagtgcatgtggccgattctggcagcggaggtgcattcgtaatgacaccatccagcggtaaagacaaacccaacagcatgaccagcactgattccactcccaccttgtagggtccgggagccaaggataacacaatagggtgaacctcgccttctgcagatgagcagaggcaaggagcgcatggacacggcgatcacgcaattgaccagacttaccgtcctgagatgtcgcccagtgcgattcacaaccaggcccttggagcaaatcttgccaagtccctacctgataaggtttgaatatgctcatgtacagggtggtgctggcattgaagagcacagtctcctccctgtccatgccctcctgcaacagcattgcagctcgctgcagctgctccaatggaggttgtgaggttggtgaatggaccgcctgggaaagtgacgggcactcgcgggctgctcccggcgggagagcagacacccaggtcacgaccagtatgacaaggggcctggtctgttcaaccatcctgcgggttctaggccctatcttgaaggccagcactgtcgtagaggatactcctccctcatgctgatgctcacctccaatgcctgttgcgatgcctctatcaagctgttggacgtgttcatgcgcagggacagcatccacgccacgatggctttccgttcctcccggatctggacggcagtcatttgagcatggtcttggtgcaggagtggggtcacagacagggagtccaccctcataccgccctccaccacgtgaccacctcgcctgcttgagcgcggtttccacttctcggtgtgtctgtgctgcgagccggcattgcgcaggagagaactccagctcatcctgtgcatcaggtatgtgcaggggtggagaatgaagagtacctctggcagctttgttgccatgaacctgtgcaaggcctcctgcccaaggggaacatgggatggcagggattgaccggttcacacccaccaggaattttgcatagtcgaggctggaaggggtttgatgcatgtcgtgcaagggtgcaaacatcttgggcaggtcgcgcagcctgtagctgtacatctgccacaacagcttgcgctgcgagtcagggggggaggtcgtgcaggtgcctggttcgcttgtggtggagctgatggatgagcgccacccacacatcgtcattgggctggtgtgcccagcaagcaggtgccactcgcggcctctgccctgagaggaaacgcctggactcgatgcctcacccacattagacgcacacgtgcgacccagattgcaacccgcccagcaggtggtcaccccccctggtcgcctggaccagccagggcacccatctcccacacagaagaacatgcaaaccacgagaatcgccccgcaccagatggatgcagcgcagccacaccgggttctctggtgcctcgatgaagacggggtcggggcccatagcttccagctgtgccgtgatctctgccaccccgtcccggtacatggcgcggaatcggtcaagtggcagggactggaactccgtccgcatgctgcaggcagggattggagggtcagaccagagcgctaccgggcccaggcagcagcaggtgggcacgtgggctggccttgccccctgcagcctgcccctgcgctacacagcacagccccgccctgacacacatcaccatgcatcgtttctaatacacacttgaagctcaaatacccaccctccacaacaaaaacaacttcccacaccgtacacctgccggtgaggacggggggtgggaccagcatgctgagattcacagaggagcatttgaccccaatcgcctggcccaggggcaggcctaggttcacggcgcgagccacgggggtgtccagccaggcgtccgaccgcggggctgccacctccagggcggcgacataccggtccttcacgccaatgacccgctccaggaggacgttgtcacgggccagcaactcgtgctcccgcttggcacgtgccagctcagcactgacctggcgaggaaatggatgggtgggcggtggaggcttgaatgtggggaccatgtagggcgcctcgagaggcatgcaggagccatgcatgatcacaattctttcccaccccatgcgcagatgacccttatcgtgcctgctcgtaacactgccgcacggcctgctcctgactcttcttcttggcccgcgctttggcttgggcgctgggaggtagggggtggggagccaagagggctgtttgaagggccccttccacatccaacactccctcccagacagatggcaaccctgcacactcacatgcggttccattcacgctttcgctgctttgcggcagccttgtcttcctcagaggtcgaaccgggttggtgtgcaggtgttccgatcggtgaggggtcgagatttctgctatggaaggggtcggagtgcacgtcctcccacgaatactcggagccactggacggcctcactgccgcgatctcaggcgcatcacaggcgaggaggtcttgtaaatcatcttgaataagtcgagtgggtccaaagcccgcccatgggtccagagggatcgcatgcatcccgtgacgaccaactgggaactcttgttggtcgggctcgctggaaaccccgtgcgctgctaaatgtggtatcgatgccccgaatctgccatcacggtcgatttcaggaagttgatagggctggcggcaaggctgtagccggcccgcaggaaatatgacggactttcagcctggaaggtctcgtaacatttgatcagcccccgggagggggtgtgggaaggaatgttccttacaaacaacacaggagggtgcagtgctnnnnnnnnnnaaggaagttgatagggctggcggcaaggctttagccggcccgcaggaaatattacggacttccagcctggaaggtctcgtaacaattgatcagccccgggagggggtttgggaaggaatgttcttacaaacaacacaggagggtgcagtgctcacgggacaatcgttggtagagacgggacaagaaaccaatgttgaagggcttgtatggatgcagataggcgatcagtctatgggaggagggtggctagggcgcgggggtgatggctccagggggaagaatgtcagcccgggtttgctcattcatcgagaatatcctgtgggaatggtgtggtaaggccagggatcgggaagaggacaaaggccttaagactgggaggcacaccagcggcaattgtcaagccattgtaaggcagcagggccccgtgtcgagcctttcccatcgcatgggaatcgctcacgccagcatgtcgggcagcatggggtaggacgtcgccagcatgacacatttctgcgaccagcggcaggaggagagggcgcgtgcaggctggggcggggtgggtccagtgccaggtggcgagcctgctccaactacgacgagcgcagcagacaatgccctgcgcgatccaccggcccgcccggcatgtagccccgctgccttgaaccctcaccccctccacacacacacacacccctcgtgctgacctggcgcaaagaaagcgtgtgcgcgatggccgccatgtaggcgtcccggtgcgccactttttcctcgtccaggtttgctgccactgcctgcgtggcccgctgccactgcacagaggggggaatggggaacatgcaagggatggcgacaggctcaacccaggtgggccggggtatggtgctgacgcgcgggcagacctggccccaggccgacctggggagcccccaaaggctcctccacctccatcgcggcccaccctcacagcctcacctcctgtagggccgctgtgtcgagctgggagtcggggctgggcagctcctccaggcgcgccagcagcctgcggcgcttggccaggacctgtggggattcgggaagggtgggaggggggcgatgacccgtgagtgcaggggcaaggtggccagagtgtctggtcccaggccagatcgctcatcaggccctcgagtccggaactctgccgggccacgcggttcactggccccgggggggtcccctgcctcagcgccttctcccnnnnnnnnnngggccgacctggggagcccccaagggctcccccacctccatcgcagcccacctgcacagcctcacctcctgcagggccgctgtgnnnnnnnnnngacgctcatcaggccatcgagtccagaactctgccgggcgacgcggttcactggcccccggggggtcccctgcctcagcgccttctcccctcccccccaaaagccactcacgctgtccatgcgcgtgaggagggcggcccgcgtctccgagatggccgacgactgggccggcgacagcgccatggccgccagcacagcacgccagtgcgccgcctcgtcgggggcggccgcctgcgccgactcgccacgcacgacgcgggtgaggatgccggggcgataccggctgcagcgccagaggatggagcgctgtgcagtaggggtggggagaagattccctctccagggggggaaaggggatatatcgaggccagggcaggagtggcgccgtctaccatgggagtgggcccagtgggcagggtagccgctgtccatcgtnnnnnnnnnngaaggggacatatcgaggccacggcaggagtggcgccatctaccatgggagtggggccagtgggcagggtagccgctgtccatcgtagcacgcagcctcttctactcttgcccactctcacgtcaaaacagcaccaacctcacatctcactccactattttcacttccccctcccccccaaatgaagtcctccacctactgcacccccccaccaggcgcctggcggtgccaatgagcnnnnnnnnnntttttcacttccccctccccccaaaatgaagtcctccacctcctgccccctgcccaccaggcgcctggcggtgccaatgagctgctcgcacgcgctctccgtggcaggcgcgctctgtgcgacgtgcatgacgtccagcacgtgcatcatctctgcccgggtgtcgcggtacagtcggctgaggctgggcaggggggtctcgcggaacaccaccacctcgctgcatgcggagggtgtggaagggggggggggtgtatatggaggaggggtatacatgtgtagtggatatccgcaagtgatggtgcggggacacggcggcagtgggcgtgagagctgccaaaacatggacatgccatgcannnnnnnnnnacatttgtagtggatatccgcaagagatggtgcgggacacggcggcagtgggcgtaagagctgccaaaacatggacatgccatgcataggagtggccctgcgcacgacgcacgtcccagtctgggcggcggaaggggcggcccgagtccacagttccttattgcagggcatgcggagacgggcaccgagatcgccacgcacggtggagggagggcgggcgggtccagcatatccaggtagcggcagaggccgtccaggcaggccgcctgccccggcggcagatccggctccgtccagctgtagtaaagcgggggcgggtcgccctggctgttgccccaggcggggaagggcgtctcacgccgcgagcgcaccaggttcaggtagtcctcgcgggagcacagcacctgctcatacagcaccgagcggcaggtcagcagccggttctcgcgcttggcggccaccagctcctcgttcagctgtggacggggtgaggttccgggggtgagatcgctgaggtggcgcttctgaaggatggattgcatgcatggcatgtcaacaggataagacccaaggggcctggcaggccgtgagtaaagatacggcggcccaggggcccgtcagggtcggccccctttccaattgagaacgatgcgacagcttgccttgtccagggaggccttggcgtgtgccgctgtagccctgcgcttggccctgtaccgagcctgggccctgcaaggggaatggggagcgggagggctgagagagttttgtgaggaccccggggccggccgtcgcaatgcagccgtcgcaggtgtccagcgtcctcctcgccaagccttagtgtctgaccccctgcgtgcatgcacactcacacccaactcgaacatactctctgttcctctcccgggagcggctgggcggtccaggcttggttnnnnnnnnnntgtgcatgcacgcagggggtcagacactctcacacccaactcaaacatactctctgttcctctcgcgggagcggctgggcggtccaggcttggttgtggcatccaccaggctgggggtgggatctaccagcagggagggagctgcacggtcgctggtggttgtcgctactttcatagggatgcttgcttggtggagtgcggccatcgggtccatgatcgccatcatggcattcacggagggccctgacctcatcgcgcctccctccaggaagtccatgtcgctcaaggtgaaggagggacgaggaacgaggtcggcgacggcaaatatgtccaggctcagatccgaagggaccctgccatccggctctggctttgaggctgcctcctcaggtgccatcggcacgacctacatgcgcgcgacaaggcaggcagtgtgtgtacccccctttagggtaagcccaagctcagagctggagccgcgtttcgttcttgctgagataagtatagcacgatacgaattcgcgaatttatacggatgaatagaatggcttctgtgcaaatctcgagacagacgatcttccgaattcatacatgtgctgagggggcccggtggcagtgctaaggatcaggaggcagattcatgagagcgactaccctccaaaacaacatggctgtaacaatctcccacacagctgattcactctccgcaaattatctgagcatccgagattcaagaagaacaggttgaaatgcgctcaattctagccaggcacgaatatcacaggctagggtttggcaaccgtcgcaggctgcctcattcaataggctgcaagacagccgggcaactcactgtgccacagcgtcgagggtacattctaatttcagccagccgctgccatggtattgtgcctcgtcacactgaatggcctgactggcttggaggagtagggccatgccaagatgagaatgccgctggagtctgcagtcagatggtccagcctacacactctaactcaactcctccatgcccattagatgatccatcaacctgcgggaaaatatacacgacactcatgctttcatctccaaggccacatcttgatcccagcattgacattcctgtggctttccctacacacaactcacaggggaaggtctggaagcagcgggtgtgaagcaatgatgacgatggctctctgcaaagggagaggatgcctctgaggctcattcgaaagcgctttatggggcagaaaagccgcctcccatccgtgctccgtcgcacaactgacatcaccccaaccaccaccaacctgccgagtatccatgatgcgaccaaacatggcagggcagtgctcaacataagcattgcgctctgcagaaagactcgcactcagatcctgggtggtcgcacgccactggacgggcagggttgtttggcaacgagttgtaaaacggtggggcctggtccaggccacgaatggggaaccaggcagcatggggtgtggttcctatcaggccccaagtgcaggcgcacgtggcgagagccctgcttcggcatgtccccatagacttccgccctgatgctacaatcccccatggctcgcgccacagcccatactccagcttcaggccatgcagacagcacgtcgggcagaaaccatcttcaactggcagttatgccctcaccgcgagcatctgtctatttgccaggcagctggtgccgggtgtcccacatcccatctcttccatgcatttaagcacatgggctcgctcagcctgtgcctgggaggtcgggggctcggcagggcctggacatgagcatgctaagattgggaacccatggccccctctagagcgtgacatcgcgatgctgatccagcaatggccatccctgccaactcactgagtggatggtcgacctgagggcgtcacgatacttacccagctccactcgctgagctggcgagaggcgcacttgacgctgcagtggtgtgcagaccatagtgctgtcggggcagctgccatttgggggccggcgagcgctcatggccggtccggctgcaagtcaggttcgcgatcctatgatgcgccaccacttttcccccaagtcctgtgcaccattggcagacccactcagcctttcttgtgcgaggaactcaccgcaatttcctgccacacagcatccgcgtctcggtcgatgggcttgctctcagcagccgccgactccatgatgctgtgcacctggcctcgtcgatatgtggctatctgccacagcaaccggcgctgcattgggcggcacagatgattggtgggttcaaggtgttctctggtgtgcaggcggcaaattgctgacctcatccaagccgtcggccgtggctgtgcaacctctcgggctccaacaccccagcgagtgcggctgaaccagatgcagtccactcagggctttggctcacctgtctgccaaggataccctccaaggcctcctcggctgcgtgtggcaggcgcatgcctgccccatgcttcgccaggatctccaccacactctccacattccctctgaactccctgccaacctccagcatcggccgtctcctgaacacctccatgtccctggaaggggcaggggggccgaaggggttgatgaaggagtaaatgcccagccgagagtcccgtaaccccaccacacggcaggtgccatccaatgttgggacccctagaggaggcagctcagccgccatgcagcgtcctcacccctgtgagagggtcgggctgtcctgctggcgagcgacctggcaggctgcctcgagacagaccatctgcccaaagctgagccccggttcctcgaagggtgcagcatgcggacgctcccagccggctccactctgggagaggggtgttgtgcatggtgacactcacaggccgcacgtccaactggcgccggctatcatgatttgtgccgagcaatcgcagcaccaacaccattataaagacggtggacatgcctgctgtgctgcctgaagcatctcgaggagggtcgagcgcaggtccactgaggcttccagcaggacagcactctttgtcagttgtgcatgctctgctctcgctgaagccagtgcaccctttgtctggagggagatagtggaccggaactgtaaggggtgacttaattcagtgtctccctgggcttctcccatgagagagagcagcacactgctccgatctacattagagcacctatgcaccacgacatgcggcttcgtacactgtacgcgccacaccactttacctcggcaaagtcattctccagcgcaccccactcttcacgcttcctggcacgatacatggcctgattcctgcaagcaaatattgatggggcaaggtgctttaccactgtgcccacacttgaagttgctgtggttgcatcatccatgccagcaagcccagttctctgacctgcgactcctctcccggtcgtgctggcttttccggcatgttgaatctgcactctggtcttcacaagactcgtgggcagctgcgctaacgtgtcgcccggtattgacctccatgtggcgtatctgactctcacaaactcgattggaagagggcaccagcacgaagtttggggggaatgcgtccatggcgcagtgagcggtcatgccgctagccaatcgagctggcagcttctgataatcacaatgagcacagcagtcgagtttttaggcagactttggtatcccttggatttcccgtcatcatttcatggagttgaggtaatgtcgaggtcgtgagctttttaggtagtgacggactcagcaagttacgttatggtgaagggagaggcttgcattccgagaccgcgctcggtgcttgcaacgtctgtgagtccgatgttagcaactgcgatgtaatatggtgttaagggactatccatatttgcagcgagtaggaagagcgtcacgccagcgatttgcgcattccacatctctcgagctggttgggtgagccctgtccccccgtgttgtctggagcctgttgagtgggctttccccgacgaatcaaaatgcattgacagatgattgtatacctgtgacaagtttaaggcatcattatgacttcctgacgataatggcatctaagaggcagatgtgggagggtggcacaggaaggtgagcaagaggtgatctggaaagaaggtactcgtctccaagggggagatgcatgaaagaaagctggcattgcctgtaactgccgggaggtgttatctgtaatggtgatgcctggggctgaatcagggcgctttgtgagatggaaatcctataaaagagagaacgggaagagggcctggtacgttcctgacgttaaacttaagaactccaaagatggaaccccaactcaactccttgcacatcaggcagctgctgacatctcggtgactggatggatggatgggtgtgcgccgtgtaattgcacgacatccaggagcctggagtgtggaggcaggtggtgagtgttcgacctttgcagtctaaagactcacaccatctgcgtcactggaactcccagggcccaccatatcatttctctccaccgcccccgggctcacatgaggggatcggggaggaaagggtgcgcagacaccagcagccttgcctgctgcgtgggtcccagcgtgtccaggaggagtgccctgctgacctcgtgatgcaggcgatgctcggcttccacggtggcccgaagcacgctcgtgcctgcctgcacctgcaggtgtcgtggaaggaggcacggatgggcacgccatccttgcactgccgccgaccttgtgagcctaggccagccttgcactgttgaaggagggcatcaggtccagggacgctgccccttcaggagcagtgtggccaggaagaagctccatagagcaatgcctggggtgccctggagccagccaccctggtgaggcaatcaatttcatgcatcctcatcacagaccacaccccagaacaggccccacccagcgctcctgcccacctccagactgatgcgacatgcctcgtgcaccgaccgcgccccggccacgccgatgctgtggcccagctcctccaggatggcacggcgcttcgcatgcagctggatggtatgggagcgaggatgctggtggggagggaggggtgcacgcacatgcagcgacgtaaggcgtcagcactgttcctagcgacgtgcttcctggcgcagcgcagaggactcagaaatggccaggcagacgcggtgcaggtgcaggcttgatgtctgattgggaacacagctgccacgttcttttcgcaacccgtggttctccataccatctccctggctcaccttgcaggtgccctccaccaatcgatcccttgtcaagcgcagttcagcttcctgatgactgttgagtttcaaagccgcctgctcttgcaaatgagggcaggtgggcatctgtccactgcacctgtgtttctcggctcaatcaaacctggcgatgtttgatgtgaggtgccatgcgcacccgtccccagcccacagcaccttgcagcgctttaaactgcgtcctcagtcgattctcaacttaccagcacattctgccagtgcaaagtgctattagtctcgggtgggggggacaggccctctcccatcacgacaggaatcaattctgggcgatagcagctgagccggcccaggaaattgagctgtgcatgggagagtgggctgatgctgtgaagagcagaagtgaagaagcaaagattgtgcggcagcaatggagtcgagctggtcagaaagtgggcttcctgctgccacacggcgggagagctacagtgcaagaaccatgctggacatgagcaggctctgcaatggctccccgcaacaaggtgatccattcacaaaaccacccatctgtccacttcctcctcaccccagcctgtaggatggagtgcagctccttcaaattcgccgcctggcccgctccactgacagctgccgctggggctggctgtaaagcatctgccagtcgtgatcgaagctcaatccaagcgctgaccaaatttccaatggggacatgtttgaaagccaggatttccctgagtacgggaggggacgggtgatggcgagcttgacacgccaagaatttgatcatgctctggcagttgcagttgtggtgctcaggcaagccacagcacaacaatgggcttgtgatcgcagcagcagccccaaactatccgcatcttgcggggtccagatcagtacgccccaccaaactccgctcactcctcgctggctgcatccctgcacgtcagactgcaggctgtgtgcagcatggctgcctgaccggcagagagctgggtggtggagtcaatgcgtcgtcgggacctgatgccgtgtcccgctggctcaggtgaaggctggtgcatggttgcgtggtgatacaaggaggttcaggatagtgcttaagcaagataggaatctgatctaatatgtagatgctagagtaccaacgatatctaaaaagactcccattcccaggccacccccgaagctcaaactgtcactcgtccaggcatcacctcagtcagtgcctccagcacgccgacagcctcctgccgaagagcaatgacgagctcatacaggtcgttggtatgtgtaagcaactggttctcggacctggcggcgtctaggtccaggctcgtctgcttggtgagaatggaggctacttgagctcggtggcgctaagcctcacctgacgagcatgacccaaagctccggccctccagaaatacgcccagcaccacaaactggtcaccttggcatgatcgcggtacgtgatgatgcgctgattccgcagcttggctctgtaccgagcttgggccctgcacaatggaatcggcacataaaccggcgaggtcacacacgacctgcccgggagggagagttctggcccgccctcaattgcagaactactgtgctcatataaagcaagagtaccacttgtctcacttcttgttcttgtcgcgaagccgacccgcgtcctccccagggtcaggttcgttgccgtgggctccatcctcggactgcgttgagctctcggcaagctctctggagccggaaagccgtgtcctgagtgtcataaactcatccactggacccagggttacgaacgcagtggccgtctgtcaaggttgaaggattattgggaaaggggtcactcgccaggatctgctcgattctctgacacaatgggggtggcagggttgggtcgctgatgtcaagcatcagcgagaaggcggtctacgactcagcgcttgcccttgtaatgtgcattaaattcaagtgaagagtgtcgcgatcgccgtaaagggtgggcgcgacgtaagggcctagcagacgcaatccctcccgtactcttaacagacctttcgtttccgacagcctcaagccttggggacgagctagaagcgatgcatctttaccatctgagctactttttatgcaattttacgccgggtaggctgatgtcatttttatcatcctcacgaagcgttgtttgcgagggctgatacgagctctctcagcggctcacgcaatacgtcgacgcgcttccaaatgatgatgcatcccagacca

SEQ ID NO: 35747 - DNA, 92 bp, Chlorella protothecoides
gctcgtcaccctcccagcccatggaggagtgggggccatgggggccccgcacgtctagacctagggtggggaactgctcgcggctggcctgc

SEQ ID NO: 35748 - DNA, 79 bp, Chlorella protothecoides
tgacggggtgacactggacgtaggcatgggagcaagtccacgaacagaaactccatgcatatcgcaggctcacctttat

SEQ ID NO: 35749 - DNA, 153 bp, Chlorella protothecoides
gtaagggaacatgggagagcaggtgtgggtgctgagggcattcttggacttcagaagttatgagatcgttatgccaacacatgtgacgtactatacctgtgcctgcttcatctgcaggtgctagagcatggcagcatgctttcattcgtcgta

SEQ ID NO: 35750 - DNA, 2973 bp, Chlorella protothecoides
  modified_base (106)..(115): a, c, t, g, unknown or other
  modified_base (739)..(748): a, c, t, g, unknown or other
  modified_base (851)..(860): a, c, t, g, unknown or other
gagggtgggggttggagagggtggtctctgcgagcattcccggcccaggcacactcacacaccccagagtgggtgcctaccagttgcagcccacctccgtctgacnnnnnnnnnnccattcccggcccaggcacacacacataccccagagtggggccctaccagttgcagcccacctccgtctgacgcggccgcctcggctgcctcagcggctgcccacatattcatccaggggcagcaatccaactttctgcggaggtccccgcagagggagcgcagaacatgttacagccgggtcacaagggatttaagcaacacccttcgatcacccaatgccatgaactcatgccatgtcctggcagcttgcgtgatagtcgcgggagcggtccgggaagtcgcgcaggaggtccaagaagaccgcaggctgcagtttcttccgctcgggccagcccatctccctcctcacgatgctatggatgacgagggtcaggtccttggtagagaatctggagttggccttcaggagctccgccagcttgtccatcaaccagggagacagacggggccactgcctgctgtcctcgtcatgaccggcgtggggtgtgtggcggtagatgataatggtgtctgtcttcctctgctgcagcatctcgatgacgaactcgtgctggcagcccgtcttgatggacacctcccggacctcatcggtaggccgcagccgctggttgtccgtggaccnnnnnnnnnngagacaaacgtgggcactgcctggtgtcctcgtcatggccggcgtggggtgtgtggcggaagaagatgatgctgtctgtcttcctctgctgcagcatctcgannnnnnnnnnatgccgtcaccagggttgccgaaacatggaaaacttcgatcatgtgagtttccggaaattttcgagctggaaaccccgctgtatcgaaaactttcgggctatattacaccaggcgcttcacgcaagggggggagggagggggcgaggaggcaacatgcttggccaagtgagtgttttactctgcctcagagagcatgccatcgtccaggagatactcatcgtgaaagagctcactcaaggggcaagttttgtctaaagcacgcagaaaacgggagttggcaataccagatccattgcacttccaatgtaaagcctaccctataacgtgctgtgaacgtattggtaccaacttcagttgcattttgcgcacgctgcgctaattcccacactcgctcagcccgcccacaccattctcactgtgccctgggcgggcccagccccataagcaactgccatgtcagctcgaaatttcggtgtcgaatttcgaagatgtgctttttcccgactatttcgcgccgttcaccgcgaaacccgcaatttcggtaaccctgtcgggctgtaacaccacgtgttgatgtgttgcggagtgggtgtggaggcgcggtggctcaaagtctgtgggtcttagctgatggagggcttccagggccgcttgatctgacccttgggagctgggacagaaggggagacatgccactgcaatccaatggacagtcctctgtgaatatttgcgagtctcttgactcacaacgagcccgagaaacggggtgggaaatcaaggcgggtcttcccaccgctgcttcgacaggagctgcgatgatgccggagcggagcatctttcctaactactgtccggaaggcagccagcggcacggggagtatatcacacacgtgacctcggtgcacgttccataagttacttcatcttgtggcattaccgctcccaaggatatataaacgcacatctctggtgattgacataggactcctgctaggagtcgtgcaacgcgatggtgccgcgtgagcggacccctctcctcggcgcggcgctgctgttactgagccttggtgtgcttacaagggtgaggtccaaggaggcgtgcgatgtggacgaatcgtaccgcatgggagtgtgggcagggccatttactcttaagtgcgccgcgcgaaagcctttctttcacacctccagggcgcctgcacctccaaaattttctcgctcccagcagccacgtgagtacttgacgtttctgttggctcattggggtcgcgaccttgctgatgcgagtgtgcgggcctcctttttatgcgcggtagaacctgcgtgtccggactctggtcaccggccgcccacccagaaccccccccaccctctccaataggtatggaccacatatctacatgctggagctcaacagcgcggatacattctgcaggtacgtgttctgctcttttctaaacatgggatggctgctcaggcccggacggatggaagctcttgttgatatatgcatatggtgtcaaggtgcggaaccctcctgatcacaggtcgcaagggtacagcaaggcgggtgctgtcaggaagaccactctccatattttgggtctctcagttggtgccattaggatgagtccatttagtgtcatagaggcacggtccaccgagatcatagtcggcgtcgaatgcctgaaggcgggacagaaggcctgcgtggctgacaaggacggcaacataggaaccgggaaccgaggaaagaacaactttggtgactacaatgtcggctacgacaacataggtgagcaggactgggaggcaacgtcttgacactgcactgaagggcctgcgcgagcgtgaggggcatgagtgatgtgcatagcgggaagctcctttcacccgctcctggtgtcccctctcaatgtgcagggagctttaacgaggggaacaacaactggggggagaggaacaaaggcaccaacctgcggtgcaacaatgcgaagggaacgcggatgattgtcaacacatgcgaccttgagcagctccgcacgtctgtgcgtgtgaactacaatcctccccctcctccatccaagaaaatgatgcctccccctcctccac

SEQ ID NO: 35751 - DNA, 77 bp, Chlorella protothecoides
caagtcgccctctcactcacccagaaccacgctgaccctcccccccatcccttccaccaatcgcgccgactcacgtg

SEQ ID NO: 35752 - DNA, 179 bp, Chlorella protothecoides
tgctctgagaggagcggcgatcaagggaagtgggggtaactggaacttgcacgtggacagcatgtaccgagggccaagtgctgaattgttccatcttggaagctggggtgccgcgcgggcgtgcacgcgctcaaagccacacccagttggccttgcctggtccagagcctcctgtatgt

SEQ ID NO: 35753 - DNA, 134 bp, Chlorella protothecoides
tcgaggcggggttacttgggactgggtcgcacgctcggcgtggaggctgggggccgccctccgatccagcacttcttctacagcagccagttgaaaggcaaaatgctttggcacggcgtgccttgtccaggggt

SEQ ID NO: 35754 - DNA, 154 bp, Chlorella protothecoides
cctcagcatccatggatggtctcggggtcacaccgtgggtggatcccgtcatgtttgggccagtacgcatccctgtgtacgatacgagcccgggtgaacgcccaactcgctgcagggctcttttccgactccagtctggagaacttccagaggc

SEQ ID NO: 35755 - DNA, 61 bp, Chlorella protothecoides
cttggtgagggcgtggccgatggtgagggaatggtgcttggtgagggcgtggccgatggtg

SEQ ID NO: 35756 - DNA, 72 bp, Chlorella protothecoides
tccaaaccccaccctctccaaaacccacccccatcatcattccttcctttggctcacccaaccttgccaacg

SEQ ID NO: 35757 - DNA, 79 bp, Chlorella protothecoides
gccgcatgtaggcgtgctgcagtgtggagggttgattgcaggggggggtctctgcactgacgcagctgcgccagaggag

SEQ ID NO: 35758 - DNA, 108 bp, Chlorella protothecoides
caaggtgcttgggagatgcgtgggtctaactatgcaaagtgccagagcaggcctgtggccaacgcaatgcagagggccgcacagcgtgggacgctgcagccagttgcc

SEQ ID NO: 35759 - DNA, 103 bp, Chlorella protothecoides
caaccggagcctgataaccaaatgaacagcaaacaagccctaatcgtcaagcaatcagtctctgcatcacctcaatattcaaaccacgtcacacatactcaaa

SEQ ID NO: 35760 - DNA, 61 bp, Chlorella protothecoides
agacacacaagaggtgtggcgggagggagggtttgccgctcgtctcagcgtcaccctgtga

SEQ ID NO: 35761 - DNA, 80 bp, Chlorella protothecoides
taatcaagcgcgaatatttgcatcatctccgcgattcgactgctagggcgaacatatgcttcgcacgagtcgaagatatg

SEQ ID NO: 35762 - DNA, 73 bp, Chlorella protothecoides
gcacgggcgaggacggcccccatgtcctgcgcgggacccccctcggcgcacccgccggcctcctgcttcgccg

SEQ ID NO: 35763 - DNA, 3302 bp, Chlorella protothecoides
  modified_base (1405)..(1414): a, c, t, g, unknown or other
  modified_base (2369)..(2378): a, c, t, g, unknown or other
  modified_base (2787)..(2796): a, c, t, g, unknown or other
  modified_base (3018)..(3027): a, c, t, g, unknown or other
cgcccccccacccccgtcaagcccgagcatgcctcgctccggaccatcgacgaggcccacagcctgcccggctcggcggtgccggaggacatcccacccctggtcccgccctcccagcctagccccctgccctccatccccgtgctggccacctccgcccgctcctcctcctcctgcgcccttgcctccaccggctcgctgcccacctcccacaccacccacggcacggccagcaccggcgccaactggcccgccacgacgctgatggcccccggccagggccccccccgctcctccgacgactggcagcgcctgcaggcactgcgcgcgctgggcctggacttttccgtgcccgagccgcgcttcgaggcggtcaccggcctcatccgctccctcttcgacgtggcggtggcctctgtctccctggtcgaagagacgaaggtccacttcttctccgccgccggcgactttgcgtcgtgcgcggagcgcgagggctccttctgtgagtggggcatggagtcccccggcgtgtttgtcgtcgaggacgcgtcccgcgaccgccgcttccgcgaccaccccgccgtcgctggcgagccccacatccgcttctacgccggcgcccccctcctctcccccacctcgggccactgctacggcctgctctgcgccatcgactaccgcgtgcgctccttcgacccctcccagtacgccatgctggcccactttggcggcatcgtggtccgcgagctggagcgcgaccggcagtttgccgcgcaggccgcggcgttgcgcgaggccgcggcggggcgcgggcgcatgctgcgcgcgctggacgtctaccacaccggcatcatgctgctcaacgtgcgccagggccactggccgctgcactacctgaacgaggccggggcggctgagctgggcgccgtgcccggcgatgtcgtgagcacgcacgcgggcttctggcagctcttcgccagcccgccgggtgaggccggcgcggcggctgacggcgtggccgatgccgccgccggccgcaagttcgagctcaccgtcgtccccgcccgcagccggccgggcgccacgccgcggccgctgcgcgtcgccttccggcccgcctcctgcgacgacgcggcgggcctttccctgacgcagggaacgccggtggtgacccgcgacgcctccaccccctcctcctcgggctcctcggccaccggcggccacgggtggggcggcgcgagccagctggaggccgcggccagcgcggcctccatcgcgctcctccccctgacctcccccttcctcgccgatccctccgtcttcctctactttggcgtgttcgagatcgcgccaggcgtcgacgcgggcgctactcctggcggcggcggcgaccccggcgccgcgnnnnnnnnnngtcgcgccaggcgccgacgcgggcgctgcgcctggcggcggcggcgaccccggcgccgcgcagcagatcgaggcggggtctccggagtccggcgaggcggacgccccggctccgctcctggcctcccagacctccttcattgcgcaccgacccaagatcatgcaggaggtcatcctggggccgctgctgggcgtgggctcgcgcggccgcacctaccgcggcctctggcacggctcccgcgtcgccgtgcaggtggtggagtggtggtccagggcgggcgacgccggcggcggggaccgaggccgtgcgtccgtggattccacggcctcagggcggagcgcggcggcgccggaggaccccgtcctcgcggcggcactcagtcgggccctggcacacccccacctggtggggacctacgtctacggcaccacctcggaggagaaggaggaggaagttggtggggcagaggtgaggaagaggggagcttcctcagggtttggtgtatggggaattttcttccctgctatcctgcgagggcagccaggagctggcggggtgcgtgccagttgtgcaaggcgccagagccgcgcagtcgtcgggatggggggtgctgtgcgtgcgggactgctgtcatgtcttgcagcgacaagtgtagggagggcaggcagtctatcctcaagcaccccggaagcacttggttccctcaatcgggccatcacctcgcctcgccgcccgcacttgaaacatcacacacactcgccacctcctctctcgcatcagaacggcgctgcgcgccacccggaccgcgtctaccaccagacctggatcgtcaagtgcttctgcaatcgaggcaacctgaaggacgcgatagagcgtggcatgctgctcaagccggacgacactccggacctgcagggcatcgtggcgaccgcctgcgaggtgctttatcgggggnnnnnnnnnngggcaatgggggtgaactggtgcagcagggtcgtggatgtcgggtgtgggggtttgcggctgagaacatgagggagttaggcacttctgcacaggaggccctcccatgctggcgtcaaattgtcccggcccgagcaggagggtttgagtgcactccgacaggtcgatcttttcccttcctgagttcccgaccttggtagtcaacctgtgggagacggcacacacaggtccgggcacaggcccctctccctccgcagacccccttcccccctctcacacacaatcactccagatcgcgggcgcgctgtcgtacctgcatgcctgcggcgtgctgcatggcgacctcaccggcaccgccgtcctgctgaccagcgtgcctcaggaccagcgccgctgggtggccaagctgnnnnnnnnnntgccgtcctgctgaccagcgtgccccaggaccagcgccgctgggtggccaagctgtccgactttgggctggcggagctggtggcgaggggccagggccgcacccgggccctggcccgtgcctcggtcgcctccgtggctcactgggcgcccgaggtcctggtgggcggcgtgctgtccgaggagggcgacgtctactccctgggcgtgctgctgtgggagannnnnnnnnncgcctcggtcgcctccgtggctcactgggcacccgaggtcctggtgggcggggtgctgtccgaggagggcgacatctactccctgggcgtgctgctgtgggagatgtgcgccgggcgcagcgcctgggagggcctgacggcgccccagatcctgcagacggtgggcagggagggccggaccccggcgctggccctcctgccggagaccatcccccaggacctcaaggtgtggtgggggtggggggcgcgggagattctgtgggggtgtgggggtg

SEQ ID NO: 35764 - DNA, 88 bp, Chlorella protothecoides
cgaggcatcatgcccggcatcgcggcagcactgctttccgacacggtgtcggggaggccaccggctgaccattcccaaagcgaacctg

SEQ ID NO: 35765 - DNA, 77 bp, Chlorella protothecoides
tcatagcagagtgctgggacggcggtgctgccgtcgcacactccttggctgttcacgggcgtgtagccagcagcaca

SEQ ID NO: 35766 - DNA, 181 bp, Chlorella protothecoides
gacatgctgctggggggccggcggggcgcgtccgccgtcgcgcagcagcggccgccacttgccgcgcactgagctcgcgagtgagggcagcggccggctgcctgccctgttcacccacgtacacaattccgtcttctcagcctgtgacgtcgataaatagacaacccagggtctggccacg

SEQ ID NO: 35767 - DNA, 397 bp, Chlorella protothecoides
  modified_base (121)..(322): a, c, t, g, unknown or other
cgcagacgaatagaacaaggcaggggcatccatgtcggtgggcacggacaccggcacctcgcaccaccccttgccttggcggcgtgtgcaatgctgtgggcctcctgctcctggggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctgtcttctcttccaagatcccagcgcggaagatcacaaacaaatgtaagtggccaacaaacactcccaccg

SEQ ID NO: 35768 - DNA, 115 bp, Chlorella protothecoides
cgacaggcctgggaggagcgggtgaggctttgtcgtgcgtgttggcctcggtgggggcgggttccctacccttgcagctccagggatgcacagcaactcgcgggatggtcgactg

SEQ ID NO: 35769 - DNA, 75 bp, Chlorella protothecoides
ccgcctctacaccttcacaatcattcaaagactgccaggaccagccgaggctcgacggcccttcctctcaacatt

SEQ ID NO: 35770 - DNA, 61 bp, Chlorella protothecoides
gctcaccacgaagaggggcgtcagtggctggttccctgtttgctctgctagggcggacaga

SEQ ID NO: 35771 - DNA, 61 bp, Chlorella protothecoides
ctgcccgccccaggaaaaggcacaaaaggacgccggcctggttcctggcacctccgccccc

SEQ ID NO: 35772 - DNA, 102 bp, Chlorella protothecoides
accgtgatggagtgtgtggcattgaaaatgatgctgctgccaagcaaatacttgaagagatacgtgtcgaacgggcggtacctcgaccgccctggctcccaa

SEQ ID NO: 35773 - DNA, 65 bp, Chlorella protothecoides
ctactgctgcctctactttgccaggtgggttgggccctatgtgtgtgtgtggggggggggggggg

SEQ ID NO: 35774 - DNA, 62 bp, Chlorella protothecoides
cgccgggcgcaggacgggggccggcgccgccaccccctgagcactcaattccaccgccaaac

SEQ ID NO: 35775 - DNA, 66 bp, Chlorella protothecoides
ggaggagaaggagctggcgggaggtgaggcgtgattggggggggggcaccacggtttaattttctt

SEQ ID NO: 35776 - DNA, 74 bp, Chlorella protothecoides
tcgaggtcaactgccgcatgggcgggggccccgtgcggaacatgaacctcctggtctggggcgtggacctggtg

SEQ ID NO: 35777 - DNA, 62 bp, Chlorella protothecoides
ggcagtccaaggcacctcgacccagggcgcatcagtccaaggcacctcgacccagggcgcgg

SEQ ID NO: 35778 - DNA, 100 bp, Chlorella protothecoides
cacgtactcattccagcacgatcaagaatcgaaacccccaaaggcatgctcataaactcccaaccacgccgtcccagtagggcgatgaggtcgtagagca

SEQ ID NO: 35779 - DNA, 221 bp, Chlorella protothecoides
tccgaagaggatcggcagctggaggcatatagaggcagtcctgaaggctcagattgaaggcttctatcaatcaagtggtgggggagcaagggagatggcaggccggtcaaacatttgtacaccgagacgcagcaacctctccagccgcattcttctctgaagcccatgcatctgctcggcccctccagccttagtgagccccctgcatgcaggatggaccg

SEQ ID NO: 35780 - DNA, 100 bp, Chlorella protothecoides
acgaggcatggggtaatggggtgggataatgacgccgcgcatgcctggcctgcccaccctgaagctcgtgagcattcaagagccgctcccctgcaggcgt

SEQ ID NO: 35781 - DNA, 141 bp, Chlorella protothecoides
gggcaatcgttttgcgagatctgcggagccaggggggttctggttagagtccagtgacctcgcaccttcggcatgcattccccgggcccgcacccccgcaccagctttgctaggttgcatgatatgtcgctgtgcaggtca

SEQ ID NO: 35782 - DNA, 117 bp, Chlorella protothecoides
tcctgagctaggtctgagcaaaagtcagggcctcaatcaagctcctgacccaggccatgtgagggcctccaagagggagaccttctggttgatcaggtcagcatccctgtgcgcgca

SEQ ID NO: 35783 - DNA, 61 bp, Chlorella protothecoides
gggctgccatcctcgagaccatcgtcctccgagccgcgatcaagggagccggccccctcat

SEQ ID NO: 35784 - DNA, 75 bp, Chlorella protothecoides
ctcgtcgtcggcgtcgtctgagtccgcgccatactctggcaatttagtgtgggttggaatggcttgggcatgaca

SEQ ID NO: 35785 - DNA, 63 bp, Chlorella protothecoides
ctgcagctgggaacgtaggtgggggagggggaaaggctcgggcaggtggtgggagcgcctgat

SEQ ID NO: 35786 - DNA, 63 bp, Chlorella protothecoides
cacaggacaggcacatgtgtagggccgggccgtttgccaaccccccttgacactgtccaccca

SEQ ID NO: 35787 - DNA, 69 bp, Chlorella protothecoides
tggagtgccttgcctcggaagcccttatgtataccttccagttatagtataggaacggtgccgagcagt

SEQ ID NO: 35788 - DNA, 132 bp, Chlorella protothecoides
cgagcaaaggaggttgggagacagatgggcaaaaggacttttgcagaggcgatttgagatggcaggtaaacctgacaaagcggccgagtccgtgacgcagggatctggctgcaccctgaccatggtccagag

SEQ ID NO: 35789 - DNA, 66 bp, Chlorella protothecoides
ggcgtgtgggacccgagctccatgggctgcgagctggtgagtgcctgcgcggcggcgcagcgcctc

SEQ ID NO: 35790 - DNA, 117 bp, Chlorella protothecoides
attgtcactaggacccttgtacaatctactactacacggcggggtagattttccgcgtggatcaatgcgacccgtcccaaacggcaatgcttgttgcatggaagtcaccagctgagg

SEQ ID NO: 35791 - DNA, 61 bp, Chlorella protothecoides
ggacctccaagaacgcacgacctggcgaaaattcctccaagtgagtgtgtgaaatggcaat

SEQ ID NO: 35792 - DNA, 74 bp, Chlorella protothecoides
ctgtcgtggcagacttgacctcagctgcagattttgagattgagggtggggccagatggtgccactttctcagt

SEQ ID NO: 35793 - DNA, 118 bp, Chlorella protothecoides
ccacagcatgcagcatcgtcccactcaacaccaccgtacaagcccagagtctcctcctcgagaccccagtacctgggactccaggggctcgggcccgcccttgaggacctcccaggcg

SEQ ID NO: 35794 - DNA, 108 bp, Chlorella protothecoides
tacaactgcttgctttgagcccagtatgctggatgggttcatgcttttggtaatggaacgcgatatcttccgaaatcttgtgcatggcaagtgcatgctgtccatgct

SEQ ID NO: 35795 - DNA, 79 bp, Chlorella protothecoides
tgacaccgacctgcgcgagcggtggtggggggaagccctcaaatgggcatgcgccgcccactcccgccacctggccagc

SEQ ID NO: 35796 - DNA, 92 bp, Chlorella protothecoides
catgagcgcctcgtcagcgcccgccgcactagcctgcgcatgggggtgggagcagggatcgatggctgagcctctcaccaggctctgcagag

SEQ ID NO: 35797 - DNA, 80 bp, Chlorella protothecoides
gcatcttgaacgtgcagaaccccctggctctcaccttttggatcgtctcattgagggcagcggcattggccatggctgtc

SEQ ID NO: 35798 - DNA, 456 bp, Chlorella protothecoides
gaccccgggcccgccgcgccacccaggcccggccccacgctcgaaccccccgctccccccggccccgcctcccagcgcgccagggtcgcgtccaggcggccccaggccgccgcgtcccgcagctccagcttggcctccagcacgacggcaaaggcgcctgcgtagcgcacgtcgaaggccagctgcggccagagcgcgccggggtgggggcagggcagggaggctgcgcgcgagaccgttggcacgctggacccagggtccacctccagcaggcgcagctcctgcaccacgtcggcggtctgcagccggctgagctggcgctggatgcggcggaagagcgcgtcgcgcgccgcgccgccgcgcagcgcgtcgaagcccgcccgcaccagcagcaggttcagggcgtggtccaggggcagcggcggggtggggccggggccgggcggcgcggcggcc

SEQ ID NO: 35799 - DNA, 78 bp, Chlorella protothecoides
tccctgatagtggcttcaaggaacctctaacatcactcacgcttcgtcccgacccttttccgcctgtcgcagtggcca

SEQ ID NO: 35800 - DNA, 69 bp, Chlorella protothecoides
cctgcgccggccggggaggggttgtgtgtggcgtgaggcatccaggggtgtcaggggccaaagggacac

SEQ ID NO: 35801 - DNA, 70 bp, Chlorella protothecoides
atctggcccacctccccgcacactgtcccccaccgccccgatactgccgtcaagctcccttcgtattaga

SEQ ID NO: 35802 - DNA, 421 bp, Chlorella protothecoides
cgcggcgccgtcgcgtccgaggagtcccaggcgctggaggcgtccagcgacccgccccgcgcgccggtgccggtgccggcgcgcgcacacccggcgccccccgggccccccgcctccgtccaggcctggaagtagcggacgacgtgcgggtgctgcaggcgcgacagcgtggtcacctcgcgcatgatgcgcgcgtgcgcggcgggggcctgcgcgtccagcgcgatgcgcttgatggcgtacacgcgcccatccatgcggttggtggccgccaccaccacgccaaacgcgccgcggcccagcgtgcgcagctccacgaaatcggagcggtagcgcgaggcgacggggccctgccggggcgcggcgccgcccggggcaccgcccctcgtgccgccgcgccgccagaagtcctcgccgcgcc

SEQ ID NO: 35803 - DNA, 162 bp, Chlorella protothecoides
gcgcccaccctgcacactgcccaggggactacctgctgactctggacctgccggggagcgagggcctgcccgaggggccgacactgctggagagcgcgctgggcacgcttggcctgctcgtgcgcacgagctgcgaggcggcccaggcgctggctggggcgg

SEQ ID NO: 35804 - DNA, 107 bp, Chlorella protothecoides
ctttcccatgagggcgccgagcgccaggcaagttcctgcgggcatgcagggcgcgacggagcgtcgtcagctggacacgctcggccttgccggttggtcctgcatgc

SEQ ID NO: 35805 - DNA, 125 bp, Chlorella protothecoides
gggaatgatgtcgttcagggcacacaggtgctgatgaggtgtctggcccctggtatgcaacggcattggaccctccctgtgcatgattgataagagcacgcaggggcacggcaaggctggaccac

SEQ ID NO: 35806 - DNA, 61 bp, Chlorella protothecoides
acattcactcccaggtgggtccgcgccaggtagcacatgcggctttgatgtgtgagggtag

SEQ ID NO: 35807 - DNA, 96 bp, Chlorella protothecoides
tccccatatggcaccacaggtacagtgtttatcatgtcttgagggaccattcgagctccgtgttgaagtacgtgcgggcttggatgtctcgccttc

SEQ ID NO: 35808 - DNA, 61 bp, Chlorella protothecoides
gggtaaatttgagagctgatgatgcttcgctgtatgatctgtccgcctacttcgctcatgc

SEQ ID NO: 35809 - DNA, 74 bp, Chlorella protothecoides
gggcgtggtggcggggctggagggtgtgcgactggaccgcgccacctgcgccatctgcggccaggccagcgggt

SEQ ID NO: 35810 - DNA, 126 bp, Chlorella protothecoides
cggagtgagctatgagggggggctggggagcggggggaggacgactcttaggctcttgatgggtgagggcagcgccgcgtcgtcagggctcacactctggcgtgacgccgcgctccttggcgaggg

SEQ ID NO: 35811 - DNA, 104 bp, Chlorella protothecoides
ggggaggaggggggtcccgggcgggatggtcactgcggcaacagagacgggggctcacgatgcatgctcctgcgtgtgcaggcaatctcctcggtaatccatga

SEQ ID NO: 35812 - DNA, 185 bp, Chlorella protothecoides
gcgcttgaggttcagccaagggtggtgtaggagtgtgtggcgtggatgtcagctcaacagttctgacccatgtgcgtgaggtcgaattgcacgctctgacgtcctgcctctgccacgacaggtgtctggtctcccacctggggccacaacagccctggaaggcaagggtgaagtcggcgaagggc

SEQ ID NO: 35813 - DNA, 5655 bp, Chlorella protothecoides
  modified_base (416)..(492): a, c, t, g, unknown or other
  modified_base (614)..(623): a, c, t, g, unknown or other
  modified_base (704)..(713): a, c, t, g, unknown or other
  modified_base (794)..(897): a, c, t, g, unknown or other
  modified_base (1052)..(1061): a, c, t, g, unknown or other
  modified_base (2857)..(2866): a, c, t, g, unknown or other
  modified_base (3038)..(3047): a, c, t, g, unknown or other
  modified_base (3171)..(3180): a, c, t, g, unknown or other
  modified_base (4423)..(4432): a, c, t, g, unknown or other
  modified_base (4941)..(4950): a, c, t, g, unknown or other
ccccccccactcctgccccaaaacactcacctgcgtcgttgcccaccagggcctcccccacgaagagcaccaggtcgggcgcattgaggctgatcaggttggaaagcgcgcgcatgaggggctcattgtcctgcatgcgccccgccgtgtccaccagcagcacgtcggtgccggcgcgcgccgcggccttggcggcctcggcggccaccttggcggggtccttctcgtacccgcgctcgaacagggggacacccaggcgcgcgcagtgggtcttcagctgctccaccgccccagagcggaaggtgtcgcaggccgcgatcatcacgctggcgccgttctggcgcagccagtacgccaccttggccaggttggtggacttgcccacaccgttgacgcccacgaacacgatggtgtannnnnnnnnnnnnnnnnnnnnnnnnnnnnnnnnnnnnnnnnnnnnnnnnnnnnnnnnnnnnnnnnnnnnnnnnnnnnagtatcattccgtcgcgctgtgggcgatgcacagaatgcacactgcatgcacccagctcagctcgaccaccaccccccctacaaacccgatccccccgccgcctcgccttggcctcgcggannnnnnnnnntgggcggccgcgtgcctgtgggatgtgggcgggatggcggttccagaaacggggaaacagggaatcgatgaagagggacannnnnnnnnnagggcggccgcgtgcctgtggggtgtgggcgggatggcggttccaggagaggggaaacagggaatcgatgaagagggacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagctcgaccaccgccacccctacaaacccgacccccccgccgcctcgccttggcctcgcggacgccgcgcaggacgtcgatgctgcgcttgggggtcaggatgcgggtgagcgccgcctccactgcctcgcgcacgacggttgagacgcgggnnnnnnnnnncgccgccaccgactcgcacaccttttccgcgatctcctccgccacgttgcgctccatgagcttggtcttcagcgccgtgcgcgccgaggcgatgtcctcgcgcgtgaggctggacgtccccgccaccgacacgcccatgctgcgcaccagggaggaaaggaagcccgtggccgcgggcttcttggcggcgccagaggcgccggtcgcctggaggtggaggggtggggatggcaatcggcgtcgacacgatccacagcagttgccctgctggaccgggccgctcctcatgcgcagcgtggccgagacgagtcagaggcacgcgggcgtgggcaccttggaggggcatggagggcgctccggtcacccagcctcacacaccgccgacaacgacccaagccagtgaaacaggccgacgcctcttgcgtgctcttctcacctcttcctccacgtcatcaaacaccacttcctcggccacgtcgatcaagctcagcttgctgaagtccgccaccgtctcgctttccacgtcgctgggcttgtcctcggtgaagtccagggcggcggcatccacacgtggctcgcctggcacaggaaagcaggagcgggacaggtgggcgagggacactttctacgatggaaagaatcccgccctccacaagtgacagctgggccagataggtatccgggcgacaccatggggtgacacgcgtggaggagctaacgcaacgcacgcgatgccagtacatcgcggggtggtggtccgatccgggcacggagtgagccttctccctgcgtcagcccacctgagggatcgttccaggtgcgggcgaccttgggcttggccgccgctttccccttgggcttgggggcgtccctgagctccgcgcgcttggcagcctttgcgccggggccgccccgctttgccagccgcttggagagcagggcagcgtcgaagccgttcgagaggtggccctccgactgcgtgtgggggtcctgcggggcgagaggcctcgcgttgggacacggcggcctggtctgcatgtgcacacacctggtccctgcaccttgtctctccagaacctcccctgcaggtccggaccgctcacctcctcactctgcccggtgaggtctgtggcatctgtctgggaggtggccatgtctgaggccctgatcttggagtctgcctcatcctcgtcgccatccgtcctctccgactgcgatgcggcctgcaggcagggccggaccttgcagcctcacatcgccgtatgaatggcttgcaccgaccgctcaccacatgagtcaccttgatcggaccttccagcggcgccggcgaggcccagaggagaccttgccaacacttcaagctacacaccgagcaccctcgcaactccttcccacgcccccgtgcgcactgcatgcccaggtgtcggatgggaatggtggagtgccccaggggcccccgccccactcctcgccctctgatcggcacgctcctcgctctcccgcagcaggcgcttgaatgtgggctcaaagtccgcatagctgcggcaatggagcaggacagtacaccggtgaggcgtttccttcctgtgatcgctgaaagcaaagccggcctcaaccacttccctgcaatgcttgtcaacatggcgccatgcgccaatctgatcgggctcacccaccctctgctgttaccatccgcatcgagaaaaatatgacattcctcaccagctcctgtatctcccctcgcacctgaacttggcaggctggtaccgtggagagaaggaggcgttcaccttccnnnnnnnnnntccctcgcacctgaacttggcaggctggaaccgtggagagaaggaggcgttcaccttccccagcagctcatcaacatatgcaagcttcagtgccttctggtagacggcgacaaatacaatgcccagggcctggagcgtgagaggatgatgtggggcgaggaatgaggtagtnnnnnnnnnngcctcaagacttgattcctgccaatatgacctcacattgttgagcgcccacttcaggttgtaggcggcccccgaaggggaagtgtaggagaaggtggtgtcccccgtgcgctcctccagcaggnnnnnnnnnntgaaggggaagtgtaggagaacgtggtgtcccccgtgcgctcctccagcaggcattctcgaatgagagcgttcacgggctcgcccttgacggttgtgagggacagggcccacagcaaggctccactcttggtgaagatgcagaagtagtccaacatccggacgccgcgttacaagccacgcctgggttaggtctaggaagacccttgattccccaggaatatgctgtgcaactgcccgatgagatgtcgtgaaagggaccgggtgtgggtctcctcttcccaagtcacctgttctggggtgtcggtgggatagctagagggcgctgcaggcctgtgcttttagctagatggtgtcgatgtatcgcacgcaatacaactcattcactgcaatgagaataggatgtgacggcgatgcagcgtcgtccgggcgggagcttttcgtttcgttgttgttgcgaatcgaggcaggttctttcttcccctggttccgaccctcatgaacgccacgggagagtcctcggggccccgttcagctcgcatgtgggtgcttgcgacgaacccctcgacaccccagcccgttgatgtaggatttcaccatgttggtctcccttccccgctcctgagcatcagtgtgctggagatgtacgcgactttgtgaccgagtccctggcctgtgacccttgacgtgtgggcgttccggcggaagcccttcccagaatggtccacacacgtccttgagggtttcgggctccttagagcgccgtccttggctcgcgcccgctcctccccatagcgcgggatggctcagcgcaaccttgtccacctgcttgtgcagcgtgagagtggccaggcagccgtcccaggtcgcctcccgcagccttgtcagcccctggatgaagagttctcgacatggaaggaggacgacttcgtgaatcactgctcggcccagtattgcgccttcagccctgcaccacgctccaccatcgccgtggcctacaacgcggacggcaccctgctcgcatcctcccagtgagtcgagatagtttgtgttgtatcattgccatgctctcaagggcccgttgtaccctgccacggccccaggcccgtttggcatcctgcggtctggatgggccttttgtaagggtggggggactacagggccaactcccttggctcccgtgagcctcagccccctcaacccccctcctctctccagcggcgaccacacggtgaagatcagctnnnnnnnnnnattgtaagggtggggggactacagggccagctccctcggctcccgtgggtctcagccccctcaaaccccctcctcttcccagcggcgaccacacggtgaagatcagctgctgccgcaccaacctggtgctgcgctcgctggccggccacagccgcaccccctgggtggtgcgcttccacccgcgcctgccgcacctggtggcgtccggctccctcgaccaccaggtccggctctggaatgcgcactctggcgagtgcctggccatgttccagttcggcaagcccatcgcctcgctgtccttccacatatcgtcccctgtcatcgctgtggcctgcggacacagggtacgtgttgatgggttttcggttatgtggggggaagggaggaagggggggggcagtgagggtatagggtacactgcatggtcgtgaggggttgggacgactggcggggtgacgcggaacagggcaatgctgcctggcaatgtcggcctcccctcaaggccctcnnnnnnnnnnagtgttgatgggttttcggttattttttggggggggggggaaggaaggggggggcagtgagggtatggggtacactgcatggtcgtgaggggttggacgactggcggggcgacacggaacagggcaatgctgccttggcaatgtcggcctcccctcaaggccctcccgcctcgggcagccgatttcatgccctttgcgttgggggcaggtcctgtgccctctttcccttgctcagtcccgcctgatcgccggaaccttattcgcgtgggaccatggcagcattctcacaaatgcacggtgtcctgccgtgctccatgcgctgccagcctcccacaactcatgtcccccctctccactcgccgtcgcacacagctgttcctgtgggagtttgggggcctgacctcccccggcgacacgcacgccagcagcctgccgcgcggcaaggggcccgtgtctgtgctgcgcacgcgccgctcgctgcgcgcctgcgccttccacccgcgcagccccaacctgctgctcagcgcggaggtgcaggactcgtcggcgccggaggacctgaccccggcgcacgccgcgctccgaccctttgccgtgcgcggcgtcctgggcgcctcctcctccggccgggggcctcaccctcccgatgcgccgcggcggccgggcggcgtggcgggcaagctggggccggcccccgcgcccggc

SEQ ID NO: 35814 - DNA, 76 bp, Chlorella protothecoides
gagaggtcatgtcatgtttgctccaccgccatgggagtggggtccttgcaggccagcaggtctgtcacaagcgtcc

SEQ ID NO: 35815 - DNA, 61 bp, Chlorella protothecoides
agctcagagtgggtgtgagtgtggctgggggtgaggacgcgtgaggcccctcgcccagcct

SEQ ID NO: 35816 - DNA, 136 bp, Chlorella protothecoides
ggtttgagggctcacgtctgaacatcatgatggagagacagcaccaatcaaaaggccaccaacctcacccatccccggcccccgcccccttctgttcatccctccgccccatgccccggcacccactcctctgctc

SEQ ID NO: 35817 - DNA, 66 bp, Chlorella protothecoides
caggccccaaccccaaggaggcgcaaggcttgacactcgacatccaagtcctggcccgcccaacca

SEQ ID NO: 35818 - DNA, 63 bp, Chlorella protothecoides
tggaacctgaagacgcgtcagcgtctatcgtgtgcggcgaatgagctcctgtcgatttccaac

SEQ ID NO: 35819 - DNA, 367 bp, Chlorella protothecoides
  modified_base (118)..(273): a, c, t, g, unknown or other
tttgtctcactagcccaacatttgctcgtcacctgtaagatggtcggtctcgatggtcaagagcatgggcggggggaccgagtgctggcgtggaaaatgtttgaacatgagtaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcctttgcaccactttgacaagcgatcgggtattgtataccaccgtctggcctctgctccggcgtcctcggtcccagggctggtcgccatgt

SEQ ID NO: 35820 - DNA, 127 bp, Chlorella protothecoides
caggagattcggacgagagtggtgcggcgcggtcggaggtgagccctctaacctctgtggaacctaccgagaagtcatgtaaatcatcccctccccactgatcttttaacacaagtgcatgtctgta

SEQ ID NO: 35821 - DNA, 78 bp, Chlorella protothecoides
gcgtgcgggtgacccaggaggggggatggtggctgagggggttgagccccgcttcctggcccaggggtggggctgcag

SEQ ID NO: 35822 - DNA, 62 bp, Chlorella protothecoides
ccgcgctcccacaacacaactcaccccatattaccacacccctcaacaaaatttgcaggcgg

SEQ ID NO: 35823 - DNA, 69 bp, Chlorella protothecoides
tgactgcggtgccgctgtaatcctgaggtgaggatggaagagggtacttgtacacaatgtccagtcctg

SEQ ID NO: 35824 - DNA, 61 bp, Chlorella protothecoides
tgcggtgtatggagggaaatcacgggacctacccccgccaccaacctgcagcccaggaaga

SEQ ID NO: 35825 - DNA, 61 bp, Chlorella protothecoides
atacatattcaaaaattaatgtagacgagggaggtcgagtattatcagttggtgatggtat

SEQ ID NO: 35826 - DNA, 70 bp, Chlorella protothecoides
acccaacgcctggcagtatgtacattggagcaccccattaaacacaaagaggcagatcacaggtcttgcc

SEQ ID NO: 35827 - DNA, 115 bp, Chlorella protothecoides
ggccacggcgcggtcgggcgtggagatgacacccttggggggcgaggggaagggggatggcggggggaagggggacggcgggggaaaggtcgccgtctcctccagctgggccagg

SEQ ID NO: 35828 - DNA, 95 bp, Chlorella protothecoides
agcaagcatggtgggcccgccaccttgaagtctacacccaaggccatccaccaaacccatcacatctcctcaaaccccaaaccctgccgcccttt

SEQ ID NO: 35829 - DNA, 85 bp, Chlorella protothecoides
gctcgtgatttgggaactcggccattattgcacggcttggacatcccggcagagggtgtggccgatgggctggtgaaacaccgaa

SEQ ID NO: 35830 - DNA, 108 bp, Chlorella protothecoides
cgcttgcttgaggtgccttgggaatgggaaggggaggccccagtgggacacccacatttatttgctgctgatgccccaatgcatgtcccaagggctgacacccagcca

SEQ ID NO: 35831 - DNA, 5727 bp, Chlorella protothecoides
  modified_base (1222)..(1231): a, c, t, g, unknown or other
  modified_base (3814)..(3823): a, c, t, g, unknown or other
  modified_base (4477)..(4486): a, c, t, g, unknown or other
  modified_base (4695)..(4704): a, c, t, g, unknown or other
gcggcgcggcgggcgccgaccgggcgccgccgcccacccccgccccgcgtgcgacggagctcccccccgcgcgcatgctgctgcaccccaacttctggctcctcttctggccctgcttcttcggcatgggcgtgggcctggtgttcgtcaacaacgccgcgcagctggtgcagtcgttgcacggtccgcccaacggccacgcccccctgctctccctcttctccgtcgccaacttcgcgggccgcgtgttcaccggctggcactcggagcgcgcgctgcacgcgcgcggcaccccccgccccatctacctcgtcgccttctccgccgccaccgtgctggtctgcctcggcttcgccgcctccccccgtgccgccctgcccctcctcgcccccctggccggcttcacctttggcggcacctggaccctcatgtccaccctcgtgtcagagctgtttggcatgaagcactttgcctccaactactgcgccttccaactggcccccgccgccggcagctacctgctggccacgcgcctggcgggcgcgctgtacgccgccgccatgcgagccacgggccagcatgggactacgtgcctgggtcggcgctgcttcgccaccacctggctggccctggccgtgctggggctggcctccacgggcatggccgcctggttgttcctgaggacaaaggacgcgtaccgcgccgagtacgaggcagtgcacgcctttgacgagctgaccgacagcgaggacgacgaggagtgaggtgcggctgagtgaaggagcgtggcagacagagcggtgagaaaggtcggcgacgtggaggagctgggttgcgacagcaggcacagagaacgcaatccctcccttgctggggcatggcagcgggattttttgcttacaacctacgctccgcaaagcgctgcgacgagcgcttgataccatgtcctggctgcagaattcttttgtgaagtgcttggtagcatcctctgttccatcgacacaccatgacgaaaggagccagtgagcgcacagcagaggggtatcactgttgtgatccgccaattctcacagcccggcagtccatgcagcaagaggaagcgccaagtttgacatgcggcccccaaacattcctgagcaactcaagtcgagccaatgctggcccctcaggaacactccagacttcctcactggatgggtacccaggacagggtcgccccccnnnnnnnnnntcaaacattcctgagcaactcaagtcgagccgatactgggccctcaggaacactccagacttcctcaccggatgggtacccaggacagggtcgccccccggaggccgttgatgaatgcggcgggggagacgggccgcctgcccggcacctggagctccaggatcgacagtcggccgccgtcgccgcagcgcaccgtcagcgcccccggggcgagctccacctggttgggctcctgggaggtattctggacctcggtgccagggccgctgctctcggccaggcgggtgcggaggaccttgagggtcagcgtgctctcccgccccgccgggtccctgaccaggaaagcgacgtgggaccccggccacccagcgcaggcccgcacccgggcgtgcaccgccgcggcggggagcccgaggtccagcgcggcatccgcgctggacagcttgggcgccgccgtggccgtcgccgcgtcctgggggagcgccagggagggacccatgcctgcccacacgtcgggcaatgcatcgaggagcagccgcgtgcccagctcaaacaggcgctgagtcagctccggagcctggacatcctcggggatctggagtgtgtgggtgtttggtttcgatcaggggaggagactggggagaaggggacaggccggcatacagcgacactgagggacggccgccctccaccaggtccccccgcgccaagtattggcattctgtactgcgctccaacttctaccactaccctgctcccaagcacgcaagccgatcagcgcacctcataggcagcttgtgcaaggacaggcccggcatccatttccctgaccgagtagagaacgctcacgcccgtctgggtgagcccatcctgtgggtttggcggagtgcacgcaaggatgtcaggatgagctaagggcagcggctcgaggcagtcctgccaaagaggcaaacgtggcaggacaaagtgtgccgccccgtaacgcaaagcaagggctcccagcttgaccgccctgctcaccatcaatgcacgctggaccggcgccgcccctcggtaggctggcaagagggaggggtggatgttcagggtgccttgccggggtatgccgagcagcctggtggggagatagtttccataggccgcagtgacgaggaggtccgggtgcaaggatcggagggcgtccaggaaccccgcgtcccccgcccgctcgggggtgaggatgcgatcctgcgggatgccggccctcgccgcagcctgggccacggggctgggaggtggattgcgccgggacccgcgcccagagggcctggcgggctggctcaccacgccggtgacatcgaacgtgctgtctggctgtgaggccgcctggatgagcccatccagcacagggactgccacctggtggaagggggagcacacatgacgctttgagtggggaaatgaccagagcacaatgttaaactccatattttctatgtgagaacatcagtccctgaggacctggggtgtgccgaagaagactacggatttgcgagactgcgatgcagcagaatttagcacagcccctctcccctggtgctgccacttgcgaccatggctcaggtgcctggcggatcggaggctagatcgccaaaatttcaagtgctgccctcctgcccagcgatggcatgctcgcgctgccagcattcacagcgatgcgtgcaccgaccaggtgggtactgtcagggagatattggacccactatcctgcaatccaccacaggaggtgctcgccatgctacatcagcttcatatgcaaacatgtaggttggaaggctctgtacctaaccaatgctcgcacatgcagacgtacagtccccatcaagtggtgtcgtgatctgcgattttcccgccaccccccggggtttcacaaaccataactgctaggtgctggagtccccggcactgtttccctggtcggtcagtgctccccgcctggccatcgttagactcgtaaccgccgatgtcctaggatcagggggctcgaggactcggcaggatggctgcgacagcccaaaaccacatggagcccctccgctcgggcgatgggaagaaggacgaggatcgggatgacgaatgtgagtgcgcacgcgatctcggctccgcctgcttgtgctccgatggctgtgcctgatggatctcgccccccgcgctccccgcagtggagtactcccctttctacgggatcgagaagggggccgtgctccaggaggcccgcgtgttcaacgaggcgcacgcagatccgcgaaggtgtcagcaggttatcaccaagctgctgtacctgctcacgcagggcgagagcctgaccaaggtacgggtgctggggcctgtgccggacaccctggcctggaggggttgggggggcctagatatactcgccctgggtgcaaggagggtggatcaggcgcctgcagcccggccagagcggagcgtggcgttacggagcagggctgcttcacctctggccacgttcgtcctggaccctactccctgctccctgaatctgccgctctcctatcactgtatgtgtgcacacagcctccnnnnnnnnnntcacgtttgtcctggaccccactccctgctgcctgaatctgccgcccacctatcactgtatgtgtgcacacagcctcccactgtctaccccccacccgcaacctccctcccctgccttcctcgccccctccctcccagacggaggcgtcggacgtcttcttcgcagtgaccaagctgttccagcacaaggacgtgcacctgcggcgcatggtgtacctggtgatcaaggaggtcatccccgccagcgacgaggtcatcatcatcacctcctccttgatgaaggacatgaactccagcaacgagctgtatcgcgccaacgccatccgcgtgctgtgccgcatcatcgaccccaccatgctcctccagatcgagcgctacctgaagcaggcggtggtggacaagtcggcggttgtggccacggccgtgctggcgggggccaccctgctgtcccgctccggcgccgacgtcatcaagcgctggaccagcgagatcggggaggccatggcctcgcgccagcccatggtgagtgatgtgtgtggggggggaagtagaagggatgccacctcagggcaacagtcccatttggtcgcttttgttgtcatcaatggctctgccctcaagggtgtttctcgttgtccacctcacaacccgagnnnnnnnnnnagggggagtagaagggataccaccacagggcaacagtcccatttggtcgcctttgttgtcatcaatggctctgccctcagaggatgtttctcgttgtccacctcacaacccgagacgcacccccccgagtacttacttcatccccttctcctccctcaaactcccgccaccatcacatccccccccccccacacacacaaaacacacannnnnnnnnngtggcgctgacgcacgcgctgcgcgccgcagacaggctggcggtgaacaagctggtgacgcagctgacgcgggggggcaacggcgtgtcgcgctcgcccatggcgcagtgcctgctggtgcgttacgtagcgcaggtggtggtggacagctctcccggagcgggcggcgcgccgcgccccttcttcgactacctggagtcgtgcctgcggcacaagtcggaggtggtgatcttcgaggcggcgcgcgccatctgcgcgctgcgggacgtgaccgcgcgcgagctcacccccgcggtcaccgtgctgcagctcttcctgtcctcggccaagccggtgctgcgcttcgcggcggtgcgcacgctgaaccgcgtggccatggcccacccgctggcggtgaccaactgcaacatcgacatggagggcctcatctccgaccccaaccgctcggtggccacgctggccatcaccacgctgctcaagaccagcaacgagtcctccatcgaccgcctgctgaagcagattggcgggttcatgggcgagatcggggacgagttcaaggtggtggtggtggaggccatcaccgcgctctgcctcaagttcccggccaagcaccgcgggctgatggctttcctggccgcagcgctgcgcgaggacggcgggcacgcgttcaagcgcgcggtggcggccgcgctgacgcgcctggtggcggagatcccggaggcgcgcgaggcgggcctggcccagctggccgagttcatcgaggactgcgagttcacctcgctctcggtccagatcctgcacctgctggggcgggaggggcccaccgccccggaccccgcgcgcttcgtccgcgtcatctacaaccgcgtggcgctggagaacgcgacggtgcgcggcgctgcgctggccgcgctgtgcgcctttggcgtcgcgcgccccgagctgcgccgccgcgtcgcggtgctgatgcgccgcgcgctgcacgacgccgacgacgaggtgcgcgaccgcgccacgctctac

SEQ ID NO: 35832 - DNA, 110 bp, Chlorella protothecoides
agtgcaagacgcccagattcaagtgtacagatgcaggcgtaaaggggggtgagtatgggccttctcgctgccttgggtggcccacggggcttgccccagcgcgatcccaa

SEQ ID NO: 35833 - DNA, 8703 bp, Chlorella protothecoides
  modified_base (187)..(196): a, c, t, g, unknown or other
  modified_base (727)..(736): a, c, t, g, unknown or other
  modified_base (963)..(972): a, c, t, g, unknown or other
  modified_base (1613)..(1622): a, c, t, g, unknown or other
  modified_base (1799)..(1808): a, c, t, g, unknown or other
  modified_base (1980)..(1989): a, c, t, g, unknown or other
  modified_base (2805)..(2814): a, c, t, g, unknown or other
  modified_base (3184)..(3193): a, c, t, g, unknown or other
  modified_base (3534)..(3543): a, c, t, g, unknown or other
  modified_base (3793)..(3802): a, c, t, g, unknown or other
  modified_base (4122)..(4131): a, c, t, g, unknown or other
  modified_base (4384)..(4393): a, c, t, g, unknown or other
  modified_base (4994)..(5003): a, c, t, g, unknown or other
tggcagggcaggcacccctgggctggccctccaatgggctggcacagcggtgggccttccccgccatccgcaggggacacccccgcgaccccacagaggcatgctctcaccacccgcccctcctcctttccccctacctgggagagcaggggggtgaccgggtcgtccctcctgtccagcaacagcnnnnnnnnnnctccccttacctgggagagcagcggggtcaccgggtcgtccctcctgtccagcaacagcaggacgggcgcgccgtcgccgccccgcaccccgaagccgaacagctcgcgctcctcgtgctccaccaggtgccgcaggctggcgcccaggcgctccgccacctccgacccggcctggtaccggatggacaggtggcgccgcagcgacagcgccagcgcggccaggccgtccgtcatgcgcgcgatggcctcgctgctggcgccgtactcccactcgcagggctccagcacgacgtggggcctcgccagggggacggcaaagtggtggccggccagcgcgacgaagtcggtgaagtactcctgcaccgacagcaccgcctccttggtgtcgagctcggccaggtcctgcagccgcaggtcctcggcacggttggtgaagactgggagaaagggaggggttcaggggtaagcggtgtctggaatgccgtcgggggggtgcaacgcagggtgttgacgtccccagggtctggcgnnnnnnnnnngacgggtaagcggtttctggaatgccgtctggggggtgcagtgcagggtgttgacgtccccagggtctggcgggaggggggcactgggagggaggccaggcgggggctggacggctggggaggtcgggcagaagggctgtgggctcttgtgccacttgcccacaccggccctcccatccatccaccgtggagaccaagaaaacatgcagactccccccactcacagnnnnnnnnnnggctgggctcttgtgccacttgcccacaccagccctcccatccatccaccgtggagaccgagaaaacatgcagactccccccactcacagaggtggtagcctccgaagcggggatcgcggagctcgcgccgcagccgagcaatgttctcgcgggtggggcgcaggaagcacaccgcctgcgcatgcgtcaacgtgtgcagcagtgaggggtgcgatgatcacatggtcaagcatccctttccggcacccagccaaggcagggtgcagggtagcactctggcaccacttggcccccccccaaaaaacaaacacacacactttgaggtggggcagcttgtccgtcttgttggcctccagcttctccaccaggtacacctcctggttcatgatgtcagtctggctgtacaccccgctgatggactgggtggtctcggcgtccagcagcagggccttcatgccggagacctccgtcaacatcctgtcgacgtagtagcgagcgatcgcgagcaggtccatgaggaggcagggccgtgccagaagtggtggtacaatcaagccgtcgctacaagtgccccattcgccatggggacgtcccaaacgcgggtgcgaaggccctgtccccacccagtgtgggtctcgcnnnnnnnnnnggtcccaaacgcgggtgcgagggccctgtccccacccagggtgggtctcgctcgggtagcaagcaggcagatacaagcacgaccacgccaaaagcccccctgcctttgcttgaagtaaccaagacaagttttgacgcttcaccaattgtccagcctggttgatcaacggcaggatcnnnnnnnnnntgcctttgcttgaagtaagcaagacaaattttgacgcttcaccaagtgtccagcctggttgatcaacggcaggatcgcgggtgtggggtctgtcgtctttgagacagtccgtggtcacagcatggagagcaggggcgtcattcccaacaataatgcgtccacataggtcaannnnnnnnnncgtcgtctttgagacagtcggtggacacagcatggagagcaggggcgtcactcccaacaataatgcgtccacataggtcaagagtgcctccagcgccaccatgaagggctatctgcatgactctgggaagacgaaggaatattcacggcaactgcaggtggcaaaaattccattgaagagaacatcaagcccgcctgggaggaggcggggcatggctgggtatcctgggttgtgccgcagccaccctagcctcttggtcgcctgcggccgtggtggtcactgctgcaactgctccacctgcagacgcggatcgacacaagcaatgccttaccaatacatgctgaacaccatgccgcagatcacagaagatcggtcaaaacaattgcgcttgcttcctctttcagcatatgccatgcaataccacgttctatgatgctgcatgatccactccttgggtaacccaccagccgctgtcaggccgaggagggtcttgacgccccctgcgcccttggccaccgctgcagacttggagcccaatgccagtgcgccagcggccatggccctgtgagcagcgtgagcatgtcagagattgtagtgtggtctgtggttggtagcggcggccccgcattggcctgcacccctcgcgtaccgtaggacgactccgagcttaacttgagccatgaccaggacaactaaaccacgagggagacgtcaatgtttgaatgtaatacagtctatagtattgatctttaactcaggattgcctgagatcgagtaggttgagcatacgcctacacttgaggtgccccatgatcnnnnnnnnnnccaactgaaccacgagggagacgtcaatgtttgaatgcaatacagtcttatagcattgatgtttaactcaggattgcgtgagatcgagtaggttgagtatacgcctacacttgaggtgccccatgatctgcgcgccctgtcgaggggttgggtaggacgagcgcgccccacccctacatcgttgcgagcgcaccgaaactcattttcctaacgtgacgagaccgggtgtttgactaaaggccttaatttcgcagtcggggactttggtaagctagcacgcccttccactacccgcaacccccccaagagatggggaaacacagcaagaatgcgggcgttatgggcgccgagtccctgacataccacgaannnnnnnnnnacatcgaaactcattttccaaacgtgacgagaccgcgtgtttgactaaaggccttgatttcgcagtcgggaactttggtaagctagcacgcccttccattacccgcaccccccccaagagatgggtaaacacagcaagaatgcgggcgtcatgggcgccgagtccctgacataccacgaacgcaaagcgctcggatttgggactgtgtcggagcgtctgggcaaggtgtgagcaggaggccggttctaggcgttggatacacgcccgacctaacactcctcatgtgaccttcagcccattcaaacctccctccaggactccatcggcaattactatgactnnnnnnnnnntccggttctaggcgttggatacactccctacctaacactcctgatgtgaccctcagcccattcaaacctccttccaggactccatcggcaattactatgactgccgcctgactctacgtcccgccgtggtgcgtgccttggcaggtggcgtcaccgggcctggccgataccccttctagtcgtccactgctgcctgctcctgtacgccccttgatctctcctcacaacccctccccgtgcctatctcatnnnnnnnnnncctagtcgtccaccgctgcctgctcctgtacgccccttgacctcccctcacaacccctccccgtgcctatctcatccgccacttcttccaggatccggtgtgcacgccagacgggttccttttcagcagggaggccatcctggagaacctgctggcccagaagaaggcgaacaagcgcaaggtggcggcctggaaggcgcagcaggcggaacgtcagcgcaaggtatggggtgatcgggaggggttagctccctggacacgggagcggctgggcttggattttgatgcccgtagggtgcggtatgggctggggcgcaagnnnnnnnnnntgggaggggttagctttctggacacgagagcggctgggcttaggttttgatgcgcgtagggtgcggtatgggctggggcgcaagcatgcctccaacatcaccctttgcctccgcaggacccaacccagcaagtttgattctcacctggacccacgaccccaaccctcccccgcgagaccacccacctggcctgatcacacactcccactccaaatgcccactccaccttccatacacaggccgaggagaaggnnnnnnnnnnttttttattctcacctggacccacgactccaactatcccccgcaagacccacccacctggcctgatcacacaaccccactccaaatgcccaccccaccttccatacacaggccgaggagaaggcggcgatcgaggcggaggccgcggtcctggcctttgaccgccagaaccacgcgggcgccagcgccggcgccgccgcgcgcctgacggccagcatcgccgcagaggccgacgcgctgctggcggacaagcgcgtggccagcggtgcggtcaacatccgcgcgcacggcgagcgcatggcggagatgcgcgccttctggctgcccagcaagacgcccgaggcggcggccagcctggaggcgcctgacggcgtcacgcgctgcccagcctcgggcaagccgctgcgcctgcgggacctgacgagcgtggcgctgaccccgctgcccgacggcgcggcgcaggagttcatggaccccgtctcgcgcgatcccttcaccaacgccacgcgcctcatggtcatcaagcccacaggtaggtgcaagcgtcgagctgctcacgctgtcgacggagggggccatcgccgtggcacggcgcgggccgnnnnnnnnnntggtgcaagcgtcgagctgctcacgttggcgacggaggggccatcgccgtggcacggcgcgggccgctggggtgcctctgtgaggttgacagtggggcagctgggtgcgcgtttgggtttagaggccgtacaagcactcggtacccctggccgagtcatgctcttcaggattgctggcgaacgaaatgcacatcattcagtgcagccaggggtgcgcctgtgcctgcaccatgtctgtatgcactcgacgggcccgccctcaccatctcctcggagcaaacggttcctcaacccccctgccttcgttccccctcccacacacacacgcgcgtgccctcccccctgtcgccatccaggcgacgtggtgagcgaggagacgtggcgtacctgcatcctgccggaggggtcgtaccgcggcgtaccgctggggcccgaagacgccatcgagctgcagcgcggcggcaccggcttcgcagagcacgacaagcaggcgcaggcgaagaagttcttccacctgggccctgggtcagggctgtcggaccggcggggccagcacggcggacccgtctccaagttcggcctccgcatcgccaattgagcgccacgatgtggcgtcggcctgacgctggtggggagggaatctctgctgcggggttgccggccgcttgtacacacgacggcacagggtcaggcatggccatggggctcagggctggggtctgactgcagggtcacggcaatgcgcggcggccaagcagggggttggcagattggcaaaggaagggaggtttcaggggcatgggtggcgcagttcctcagtattccgctgtccactgggacctgccccgtgccagggcaatggaagtgatcctgcgagaaggcatgtcgcagcgatgctgccagagatggggaatgattacacgaggtgatgcaccaacggagcacgctgcctcgcggggcaccgcctgcggctacctgcgctcatgcggcccgctactggggggattcttgcaatctggaaggactcaggcggcctgccctagcccaggatggcgtcgcagcaccgccccagggccctgcgcagtcccgaggcggccggccggcgcagaggagcgctggccggtgccccgccgacgacgggggcagggtccgcggcggccatggccgccgccttgcgcatctgtcgctgcccggcagacagggaggcacagaacaccgccgcgtcaaaggactcccatcctgacagggtcacgtcgcttcctgaggagggttgtggggtgacaaacaccgtgaggttgtcatgcaggaacacctcctggggcttacaccgtaggattgaggcgctgaccgtctccaccagcattgatgagaacacgctgaacagtggaaataactaaacatgcaaatgcattagaactactggatttatcaatcacagccccggccaccagcacatgcctgccgctccagtgtccactccttggggcagggcgcagccaaaggtgagggagacggtgtcgttctctgagagaccaaaaatctctcggatggtgcgctcgaaggccgcccggccctccagccccggccgcaccaccacctggtgggtctggccatcgtgggccaccgtcatgacggggtcggccttgggaagggtggaccagcaacctctccagtctggcaggtctgcaccgcagaaccggcacatctgtagcggggcgcatactattgggagtgatttggaggggtggaaacgcgctcgggcgctgcccttccccgcaaagccctgacctccgacatgaaggcacaggccccccggaaccaccccatgctgcttgcaggtggcccgccaacctgtcgaccgtatgcgcttaccttttcctcggccttccctgcggactggagctgccagcgggccaggcatgtacggtgggccggcatgcatcggcatggccgggtgaggggtctggtcggcaggtcgggctcgtggcagatccagcatgccgtctcatcctcccctgcgctgctgctcggtgcacttccatcttgagtatccatgacaggcagtattcacgttccttgtgagaggaacatgcctctcaagaaggccagtgccttggccgtctcgaccggtcgacccacgtaggtgtcttggactcgtccaaggctccgtacgacccttggtggcaagtccacgcgcatggtccacggccagggcaaggttccaagggcccgcgtggagagtaatcagtatgttcaaagtatcttgcgctcgtggatgtgtcgagccacccgagtttcagccgccgggaggggatgtgcgccatgcagggatcttcacgcgccatgatgtacctccggtcgcagcggtgactcacaccaaaccattgccagtcccgtctcttctggcgcattctcatattgcgtattgcagcacaacctcaatgatgaataggagtagttagcaggcacatagatagaagagcgcaaagagtatccagtgagcgatgaatgtatgcgggcagtcaggttgggacgatgatcgctgcggtcagtaatggggaggcaagcgcataaattatttgtaccagtcctgcagctgtggagtcgggtggtgtgtgccccccaggaatggtgtggggcagtcttggtcagggtgggagctgggaggcaaaggatccgcagggtggtgatggtacatcttcgctcccgcggcgaggcgcactctacgaaaaattaacgcccaggtcctggggggtgttgaagtcgttcacggtggcagtgatctgcgggacggggcagggagccaggggtgagtgtggtgcatggctgggaccgggggcaccggaccgcacacggcgctgcgcatgcaccgacaggggcaggcggagcccgcacgcgggcctcccttgtcacccggggctcaccgtctgcccggtggtggacgtgatggtgagctggaagggccctgtgggcatgggccccgacctctggaagaactggaactgggacctggtcagggttacgcccccccaggacacggaggcgagggtgtagctgtagttgtccaggtagaaggcctgccagaagccgttggagccctccttggggttgtactggatgccgccggagatgaaggaagagcagtccgcgtactcccaggacaccgtgagccggttggggggcacgccagtgacggcctggtaggctgggtaggagaagtccagcgcgccctccgcgcactcaggacacttgtccacgatctggaccaggacgttaaagttctgggtgacgcaggcagggtcgacgcagcgggccaccacgcactgaccgcaggcggcgcccgagttccactgggcagagttcatggctgcgcattagggagggggggagaggtgcgttggatgagggagtcaggattgggaagcgacctgcaggcctcaggcaggcagctcaggcaggcagcccaggcaggcagccgccactcaccagcaaagtactgggtgaagtaggagttgaggtagcggtaggagcaggcaaaggcgatgccaccgtcggaggcgatggcagcggagtaggctgtgccgtcaccggtgtaggtggcagagccagggatgatgtactggctcgcgccgctcgcagtagtgggtggcggtggagactgggatgtagggggtggcggggactccacgggggagggtgg

SEQ ID NO: 35834 - DNA, 130 bp, Chlorella protothecoides
gcgtgcctcttcacaggaggggccacctgggcgtgccgacatgccctgcgcctggcccatgcagtccgatgcggacgccccccgacttggcacgtgtttatctggggccgcccagatcagccatgcaagc

SEQ ID NO: 35835 - DNA, 124 bp, Chlorella protothecoides
aagcacagatcagcgagacatggccagacaatctgtgacaacctgggtagtcattcctcgcgccacacacgacgcagaagtggagctcgcgccgtggttgcaggaaaaggcggcgcagggttgg

SEQ ID NO: 35836 - DNA, 546 bp, Chlorella protothecoides
  modified_base (215)..(417): a, c, t, g, unknown or other
cggcgcgttttctgtgcagtgtggagggggtgagtttaggctgtgctgcagggagaggattagacctcatctgcagaacgcaggactgaatggagcgcggggaccacccagacgccctcctggctttgagtctggtcccagccacggcacaaaccccccccaactgccgccaaaacactcctcctcagtcataccttttctccggggtcgatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaccgcccaagagctggctgcaatccaccgtgcaggactccgcgcagctgcctcatgccctgcgcaaccggcactcgcaacgcgccctcctctccacccagcccccgcacccaccagcatgccgtcgg

SEQ ID NO: 35837 - DNA, 77 bp, Chlorella protothecoides
cgtcctcgtcgcgcctaccagacctgatgttgttttttgggggggaagggaggggggtgatcaggcaagggcttggg

SEQ ID NO: 35838 - DNA, 68 bp, Chlorella protothecoides
ctcgcgtcggtctgcagctgctctgcaaagggatgagagtgtgagggagggggggggggggggggggg

SEQ ID NO: 35839 - DNA, 69 bp, Chlorella protothecoides
gctgtccccgttgtttgttcaagggtaagcccggggtcgcgacgcagacggtgtaggatcatcgccgag

SEQ ID NO: 35840 - DNA, 6801 bp, Chlorella protothecoides
  modified_base (297)..(306): a, c, t, g, unknown or other
  modified_base (1127)..(1136): a, c, t, g, unknown or other
  modified_base (1331)..(1340): a, c, t, g, unknown or other
  modified_base (1663)..(1672): a, c, t, g, unknown or other
  modified_base (2325)..(2334): a, c, t, g, unknown or other
  modified_base (2697)..(2706): a, c, t, g, unknown or other
  modified_base (3505)..(3585): a, c, t, g, unknown or other
  modified_base (4431)..(4440): a, c, t, g, unknown or other
  modified_base (4660)..(4669): a, c, t, g, unknown or other
  modified_base (5229)..(5238): a, c, t, g, unknown or other
  modified_base (5725)..(5734): a, c, t, g, unknown or other
  modified_base (5833)..(6035): a, c, t, g, unknown or other
ggcggcgggcggggcgcggggccgcgcgccagcttctcgcgtgcaggggcccagcccggaccccaggccctggtcctggagcaagaccccgaccccgtgagccatgatgattacgtttggggtgcagggggaggggaggtggtagagtgggtgtgagagtcaggggcactctcgagcgtgggcgcaagcggccgccccttcatacacggcagaacgcctgggttgcaaggatgccagacgagtctcacttccccgccatgcagctccccacatgcgacgcctctgcccacctttacnnnnnnnnnncctcaacaccccgccatgctgctcccacatgcgacgcctctgcccacctttacttcactccaacctcacacccaggtcgagctggtgccgctggaggagggcctgctggaggaaatcaccttcacctgcggcgggcggcacgcggtgctggccctcagatcacaggttcgtgtgggggggaggaaagggtgaccagcacgggcgtggcatgggatgaggagtggcgcggcggggcaggagggcctggagcccaccggtatcggagacggcgctgaagatgtggctggggcctccaatcacatacccttgccctcacccgcccgtaaacctcctgcaaccgtactcgcagcgtgtgctgtacaacggccaggagatggcgccctcgcgctttgaggtcatgtgtggcaagccggacgcgaagaagtggaagatgtccttctggcgcaccgacgccgacggcgagcccatagaggtgagggggcggctgattaagccatgctccgacggcaaaccggccaaagtacgcatgcttgctctccaggcacaatgtccactgctctcctccttcatcaaccccctcacacagtccatgcacgactggctgtcccgctatggcctggatcgcaaggcgctggatgccctggcccgaaactccgcggcacatgaggcgtacgaatcccatgttgcaggcacaggtgggtgcagtggaggtcgttggtggggttggcaaggtacaggcgggctgccgtcgtgtggagtagaagaggaattgcactgcttgccagcaacgcgaggttgcgcggtgacctgcagccctgggnnnnnnnnnntgggctaccgtcgtgtggagtagaagaggaactgcactgcttgccagcaacacgaggttgcgcggtgacctgcagccctggggatgacagtccccccgctttaacttgaagcctgtctgcttgctcgcgtgcacacacccccctgcgtggctagagacgtatttccccccccccccccccccccgcggggggccnnnnnnnnnncgacaggccccccgctttgacttgaagcctgtctgcttgtttgcgtgcacccccacccctgcgtggctagaaacttatcccccacccacgctgcagtggctcttgtgctggaggacatcctgctgtccttgggagcatccccttacgatcccagtgacgatgatgagggatctggcggcaaggatgaagccagcggcgaggaggctggcgaggaggcggcggtccacgacgagacccagaggcagcagccaagggcaccagggcgggagcttatcagcggcgtggacgagcctgtgcccccattagccgccacccagcagtcnnnnnnnnnngcccagggggagcagccaagggcaccagggcaggagcttatcagcggcgtggacgagcgtgtgcccccattagccgccacccagcagtctgccgcggccggcgagggtgaggagcctggtgtgaatgatgaagcggacgaggatgaggagacggacgaggaggtcgccgaggcaccgctggagccggagcggggtgcgccgtcagaggatcgccccggcgcccatcacatggctgagagcggggatgatgagggccctcagtcgccagcgcgcgaggcatccccggccgcgagtgcgcaggagggcgaggacagcgagggtacgcagccgtgctctcctgtctcgggccccggcacgagcgccggtgccacctccgccggcgcgagggcatgggatgccctcggcgagcgtggggcaggggaggaaagcgcgggcatggacgtgacggtccagggcatcgaggcggatgctttcccgggcgagcccccggccgaggccaagctggaccccggtgcgggagcgagtgggggtgttcagatggtgtggtgccatgagacccaggagatggagtcagctggtgcagtgaggcagcggcaccccgacttacccacctcaccacacggcaacccctttggcacccccttcacacaggnnnnnnnnnnagagtcagctggtgcagtgaggcggccgcaccccgtcttacccacctcaccacacagcaacccctttggcacccccttcacacaggaaccctggtcccacccgcgcccgtcattcttgccggtatgtgggtgcgggtctactggccggatgacagggagtggtacctcggtcaggtggtcggggaggatcctgccaacccagcttctcatcgcgtgctctacaagctggacggagaggtgggtcctgggtgatgagcacacaatgatggagtgtgaggggactgattgcatgagcaaagagtgttcgggcgcacccgtcctgtagctgtcttttggtgcaggtgccgcgggtagtcgagcatnnnnnnnnnnagagcacacaaggatagattgtgagggactgattgcatgagcaaagagtgtccgggcgcaccggtcctgtagctgtctgttggtgcaggtgccgcgggtagtcgagcatttgtgttctgggactcgcaaggcgccgattgctcattcggaagcccgatgccgacatcaaaggaaccccctccctacctcactctcaaaactcacaggaggagagcctggacctgcgtgcggaggccgccgcagatcggctgcaggtcctgccggggtcggaggaagccgcctggcccgcagcccccgcagcccagcccgacgagcggccacaggccggcggcctggcgggccccccccggccccacgccaaccccgccgacgcaccggagtcggtggaggtggtctgccgcggcctgcagggcaccttcttccctcagcgcctggtggtccggctggccaatggcacggaggtctcgcccaccgagttcgagcgcctggcggggcgcggcgcggccaagaagtggaagtccaccatccgcgtcgaccgcggcggcggccagccgggcctgaccgtccaggactggctggtgcgcaacgggctggagtcggcgcggccgccgcggcccagccgcggcacgctggaaaccgtgtcgcggcgccaggccgcgtcagcaggcgcgcggcaggggcccggtgcgccagggtccagcgggggccccgcgcgcgactccagcgtggcggccaagaccgggcaccgcgagggctgtgcctgcgtcatctgcaagcagacgcggcggggggggggggnnnnnnnnnnnnnnnnnnnnnnnnnnnnnnnnnnnnnnnnnnnnnnnnnnnnnnnnnnnnnnnnnnnnnnnnnnnnnnnnnccccggcctcgtccgcgccggcgcgggcgggggccgcccggcgtggcgcgcgaggaagcaggcctacctccgcgcgctgccacacctggtctcctgcggcgggctcagccacaaggttggaggcagactttggatctgtgttggggtgaacatgcaggaggtgggagcttggatgaggaaccatgggtcgaagctgttgcaaggaacggacttttggaggcgcctggtgcctagcctgcgagtgggatgtctgcgcacctggtgcgcccaggaaggtggcctcggccgggttgcacggcggaacaccctcccagggcgcatccgtcccaccatgccaatggaccctcccgtccccgtcccagccagctccagacgtcgtccgcctcgccccctctcacactcattcctctgcagatgcacgaagtgccgctgtcgcggtgctggacgcccgaggactgggccggacaccgcgtgcggcaggcgctgtgggaccgcaaggagggcagggcgccgggcgggggcgcggacgtgttgatcccgggcaccaccacggccgtcgtgagcggcggcggggggggcgtggtcctggacgcaccctcggcccccatctcgctgggctcccttgtggccccggcgcgcgccctgagcctgaaggagcgcctggagatctgcgacaggaccgagggtgcacggctggcgtttggcaaggtggggactctggtgggtgaggcagcgtgatctgggaggggcccctcctgtgggagtgaatgaatggggcatgggtgtcgcgagcgggagggggaagtgtcagagatgggggacgtatggctgccggtgaggggcggnnnnnnnnnncggcagcgtgatctggaaggaggggctcctgtgggagggaatgagtggggcatgggtgttgcgagcgggagggaaagtgtcagaggggggggacgtatggctgccggtgaggggcggcagcggggacgtaagctgcaggtcgcacacccagtctgtccccttcatttggatgcgcgaggctgccttgacctccttctcacccagcctccacccacccaannnnnnnnnnacgcacccagtctgtcccctccatatggaggcgcgagactgctttgaactccttctcacccagcctccacccacccaacaccccttcggccatgattacagtccggcatccatggctggggcatgtttgccaaggttcccatcaagcaggacagcatggtcatcgagtacaggtgagggggtggtggtggaaaggagggagcgggggcgcatgggatgaggccgagcacttgtaactatcgtgcctcacgaccatcgagtgcaaacccatggcgagcatgctcgattctccacattcgcaggggcgacctcgtgcgccagcccctggcagacctgagggaagcgcagtacagggccaacggcaaggactgctacctcttcaacctggacgacgccattgtcatagacgccaccatgtgcggcaactgggcacgcttcacggtgagcggagcggcaaaggggtttggcgggggtggtggtgatcatggatagcggggcggccttggccgagtcacgcgagcgccgtgcgctgcgatcctcgttcccatccctccacccccnnnnnnnnnncaaccccagcacctacaccaagatcctgaacatcgacgaccagccacgcctcgtcttctttgcccgatttgatatccagttggggcaggaggtgacgtacaactacaggtgcacctggtggagcaatgggcgtgggctggcttggagagggggcagcatagaaatctacgaagagagggagggaaagagtgtgatgtcagagggtcactcatgcacccctcaatcatcacaaatcacatccttttgtttgctcaggttcaagaggggggagggcgaggagcagctgccctgctactgcggagcccccaactgcaccggattcctgaactgatcccggctctgctcatgcctgtactgttgtacagacacagcgttgcatcatgggaagacggcgaggcaggggggtggagaagggtttaggggagcaagaaagggtgcgggggaactcggtacggcccttcgagaagcattcttctgcgcaggggtnnnnnnnnnngcctggtggagcaatgggcgtgggctggtttggagaggggccagcacagaaatctacgaagagaggaggggaaagagtgtgatgtcagagggtcactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgaggcaggggggtggagaaggtttaggggaacaaggaagggtgcgggggactcggtacgggccttcgagaagcattcttctgcgcaggggtcaaaacatgtcagcgccggcggcgtgcggccggcgcggccttggtcacccccccgccccgcacgccgcgcattgatgcgcggctggcccccgcccggggtccggcaacgacggagccgacgcgggcgggagaacttcgcgtggcgccggctggggccgccgccgagtccaccttggagctggggcgtgaattcgcacgggtgagagccgcgtccagcgcaggactcgtgccgggctcctccgactccttcgccggtgggggcggggtggcttgggcccccggcggtgcctccccggcgaggacgaccgattccggtgccgcgtcctctccagcgccaggcaccaacgccgccgggctgcttccgggaccctccccgccggctccggggtccgacgcctcacctccgccatccagcccactcgccagcccctggcctgccccctggccccccgcctccgcgccggccctgccgtgcagctcctccagcggcacgtacttgaacttgggcggcaggcggctgttggctgccgcggcctcgcgtggcgtcatcacgcgctcgcggtcgatgcgcagcgccgcggccgcccccgcgttgcccgccgccgcgtcgcccggcgtggcaatggcagccagcgagggcggcacgcccagcggcgcggtctgcgcggcggc

SEQ ID NO: 35841 - DNA, 74 bp, Chlorella protothecoides
tggggcttttgctctctaggtctcgacttgtagacgggcgataagggggggggggggggaaaaggggggggggg

SEQ ID NO: 35842 - DNA, 136 bp, Chlorella protothecoides
gtcatggttgtcacagtgtatccctccttcctcctcaggttcggtttgacttgccaagtggcgacaaactggaacccttgagtgaccttccctgactcgtttcggccgacagtgcgagctgccttcatgcaatgcc

SEQ ID NO: 35843 - DNA, 61 bp, Chlorella protothecoides
gaggcggcagggccatgcgcgggtcctggcttccatccaggaggccatcgcacaggggtat

SEQ ID NO: 35844 - DNA, 139 bp, Chlorella protothecoides
aacagcatgctgtcgagcatgggacagcgatacactggcgcttgccttgtccatgcgataaactgggtgcagctgcaaccgaggctccagatgcatgtccaggagaggaagagtcgctgtccagcaaccgcaaatgcac

SEQ ID NO: 35845 - DNA, 61 bp, Chlorella protothecoides
tctgcagaaggatctgcgtcaaggcgcgagctctgagtttgcgcgccctgagaggagcccg

SEQ ID NO: 35846 - DNA, 61 bp, Chlorella protothecoides
gcattcttggagacgcaggctcgggagggggatgctgtggtcaaggggatcgtgctgctct

SEQ ID NO: 35847 - DNA, 70 bp, Chlorella protothecoides
ttgcgagggtatacaggagaggatcaggctatgtgatccatgcagaaccatgcagaacgactttgaatag

SEQ ID NO: 35848 - DNA, 106 bp, Chlorella protothecoides
cacctccctcaccgggatggttccggccacggccctcaccagccgtgagccggcggccgtgcccagggggacgtctgccacggcacgattcaggggaaagtccatg

SEQ ID NO: 35849 - DNA, 2100 bp, Chlorella protothecoides
  modified_base (104)..(113): a, c, t, g, unknown or other
  modified_base (624)..(633): a, c, t, g, unknown or other
  modified_base (973)..(982): a, c, t, g, unknown or other
  modified_base (1228)..(1307): a, c, t, g, unknown or other
  modified_base (1544)..(1553): a, c, t, g, unknown or other
  modified_base (1941)..(1950): a, c, t, g, unknown or other
  modified_base (2021)..(2030): a, c, t, g, unknown or other
cgctggagaagtgatgcggggctgcatgggagtgcgctccctgcacgcgccatgccactggcagctggcccaaggcggcgctggagcatgtggcgtgcctgggnnnnnnnnnnagacctggccaggcagggcagcaggagcacgctgaacctgagcgtgagcgccagcgactttgtcccgggcgggggcctgccccgcgccgccagctcgcccgcgctggagaagtgatgcggggctgcatgggggtgcgcttcctgcacgcgccatgccacttgcagctggcccagggcggcgctggagcatgtggcgtgcctggggaagagtctcccaccggcaggctgatcggcctgagcgtggaaagggaagaatcgcagagctagggttcaggcctggccggcacttgtggtgcctctccccttgcatgtttgcgagcgtgtgcattcctaacaggtggggcgaccgggccccctccctgctgacttcaacgacgaggaacacgctcagaaactcggttctgtcgggtgggtgacatactttagagtttatagttcgggggcacggggttcagtcaccctccgaccctggagcaggggctaatccggaggaaaggggctccatcggtannnnnnnnnncgcgagcgtgtgcattcctaccaggtggggcgaccgggccccctccctgttgacttcaaagacgaggaacacaaccagaaactcgattctatcgggtgggtgacatactttagagttcatagttcgggggcacggggtacagtcaccctccgaccctggagcagggactaatccggaggaaaggggctccatcggtacagcgttgtccagtggacagctagagacgaaacacacgcaaagatgggcctgatcagcgtttggtacgaagatggcacagagattgcctgaaatcagcgagggacacattaagcgcactcaggtgacacatggcacgctctcnnnnnnnnnngacacacgcaaagatgggcctgatcggcgtttggtacgaagatggcacagagattgtctgaaatcagcgagggacaaaacatgcgcactcaggtgacacatggcacgctctcagcgattccgaggtacagatttgcctacgtggatctccggctattgagccgaccgcccccggttagtggagctggcagcatacggcgcccgtgccgcggcacattcaggagggaatatgtacatcgattacccnnnnnnnnnnnnnnnnnnnnnnnnnnnnnnnnnnnnnnnnnnnnnnnnnnnnnnnnnnnnnnnnnnnnnnnnnnnnnnnnaaccgtcgccactgcctggttgtttggccggcgactgcaagtagtgcgtgcctaggatgttcgggacccggcccttcgccctcatatggacgctcctggtggttgttcatgcaagatctatctcagaggtaggataaagaaggactggtcttcgagcaagtactgcgctggcctgccccggctctctaaggctcaacatcctcccgcctaccccacctttcaaacccctcttcgtannnnnnnnnngttaaaactagattcgactgactggagcggaaaattagccgcacatactagtggaccgtctgcactgcgtggagggcgcctggcattcgtgcctgcctagaatgggtgggccccggcccttcgccctcctgtgggcgctcctggcggttattcatgcaagctctgcttcagaggtgtgctgatgcagggttgagcttcggaccaatactgcgtaactcagctcctgcttcccaaaactcaacgtcttcccaattacccaacgttcacccctccttccccactctgcgcacaggtgacaccggccatcaccatgaacttcatggagtgcgccatcacttccgacgatgattccaccatccacaggagcacatgcacggccagtgtgacnnnnnnnnnncaaactacctcacattcgatacccactccaagctcctaagaatcccaaattctgtcgctcggtttcatcannnnnnnnnntaacctacctctcattcgatacctactccaagctcctaaaaatcccaaattctgtcgctcggtttcatca

SEQ ID NO: 35850 - DNA, 61 bp, Chlorella protothecoides
tgagcctgcccgcgaaaccatagcttttggtagagttctgatgacagggactcgtcatgag

SEQ ID NO: 35851 - DNA, 109 bp, Chlorella protothecoides
ttctttgatgctcacagctctctgccctccgaaacagctccccgcgtaaattcccgatatctataccgccaacccagcatgcaggtccgcccaaccctccagacccacc

SEQ ID NO: 35852 - DNA, 83 bp, Chlorella protothecoides
gacctggtgccgggacacctgctcacgcctcttgcccccccttcccagatcgaaatggcgtcatactggatgcgccgcccctg

SEQ ID NO: 35853 - DNA, 69 bp, Chlorella protothecoides
cgtggtgcggagctgactgttacccttgccgttctcccacctgagcttgcccttcagcgctcccatctc

SEQ ID NO: 35854 - DNA, 77 bp, Chlorella protothecoides
tcatgacctgtcccccaggcagcttgccacccacttgtacacaagtaacacacacacacaccctccctcctccttcc

SEQ ID NO: 35855 - DNA, 111 bp, Chlorella protothecoides
aacttgcccgtcgcccccaaccatgcccagcccccccccctccccgatacacatagcctacgaaaccacgcggccggcgctgcagcacacacctggatggcggcctcggcc

SEQ ID NO: 35856 - DNA, 61 bp, Chlorella protothecoides
gcctgggtggggcgggacacagcgcaggcctgaggggggagatgcatgcaaatacaagctg

SEQ ID NO: 35857 - DNA, 163 bp, Chlorella protothecoides
cggcacaggttcaccatggctgttcgttggagggggagggggggagggaggggcacatgggagggaagggtcgcgatgctgccaatagtacatgcccttgcgcgcaccatacctacaggacacccagccccaaccccccaagagcccaccgatgctgttgtcg

SEQ ID NO: 35858 - DNA, 74 bp, Chlorella protothecoides
gagggagactcctcggggctagggctgggcctgggagactccttcgggctgggggagggagactccttgggaga

SEQ ID NO: 35859 - DNA, 129 bp, Chlorella protothecoides
tggatgcctgcacgtgtattgcggggccagatgcggtgggggctgccgggatcagactggcgagcagggcggtgcgcagcggcacctcaccgcgctccccacctccgatcaggatgcgcgacagctgca

SEQ ID NO: 35860 - DNA, 65 bp, Chlorella protothecoides
gttggtggccagcagagactccacgaggtcaacgacccaccgggacaggcgcagacactggaaag

SEQ ID NO: 35861 - DNA, 10283 bp, Chlorella protothecoides
  modified_base (311)..(320): a, c, t, g, unknown or other
  modified_base (523)..(532): a, c, t, g, unknown or other
  modified_base (858)..(867): a, c, t, g, unknown or other
  modified_base (967)..(976): a, c, t, g, unknown or other
  modified_base (1133)..(1142): a, c, t, g, unknown or other
  modified_base (1527)..(1536): a, c, t, g, unknown or other
  modified_base (1758)..(1767): a, c, t, g, unknown or other
  modified_base (1851)..(1860): a, c, t, g, unknown or other
  modified_base (2440)..(2449): a, c, t, g, unknown or other
  modified_base (4561)..(4570): a, c, t, g, unknown or other
  modified_base (4808)..(4817): a, c, t, g, unknown or other
  modified_base (5487)..(5557): a, c, t, g, unknown or other
  modified_base (5816)..(5825): a, c, t, g, unknown or other
  modified_base (6801)..(6810): a, c, t, g, unknown or other
  modified_base (7101)..(7110): a, c, t, g, unknown or other
  modified_base (7804)..(7813): a, c, t, g, unknown or other
  modified_base (8418)..(8427): a, c, t, g, unknown or other
  modified_base (8958)..(8967): a, c, t, g, unknown or other
gtgggaggaggcatacagcctcctcagcttgttgtgcgccaccctgtctccgtttccccaagctgcacaggctctgcacagcgggattgtgcatcgaattttcggtgagatggtgctgaattgatattgccaggacgcctggagtacctgagatgtccttcagagtgcctagaaaggttttccccaaagctgaggaacctctactgcccattctggcatatcttgagacttgaccgtgcttcctgatggtccgggcaaagtatgcagtgtgccagtcctacatcagcctccacgccactctcctcactcannnnnnnnnntgtgcttcctgatggtctgggcaaagtatgcagtgtgccagttctccatcagcctccacgccactctcctcactcacagcaagtaagctcctgctggaccttcaaaaaatggcactggaagcctgggacgagggcgctgagctagtcttccagcccccagatggtccaagtgggggtggagaggtgagaccctggttgctgannnnnnnnnngctggcaatatcaattcagcaccatctcaccaaaaattcgatgcacaatcccactgtgcagagcctgtgcagcctgggggaacggaggtagcgtggcgcacaataagctgaggaggctgtatgcctcctcccacacgggctcgggcatggcataccctgggcagcttcctggaaggtggagagggaggaaaggtggttcggcgtcctggatcgaggaggcccgcttgacgccctgcgatgtagttcaccctccggccactcaccgcctcgaatgaatgccagcgagaggcggagagcatactgcaccaggaccctgcgcacgaggnnnnnnnnnngaccagccatgcaaacctcctcttgacgcctcgtgcgaggtgcagatgtgtgaacccaacactcatcatcatgcactcttcacccaccctgtaagcaggnnnnnnnnnncaccagccatgcaaacctcttctcgacgcctcgtgcgaggtgcagatgttggaacccaacactcatcaccatgcactcttcacccaccctgtaagcaggtggcgacgctgggagaggagtctggcgagacgccagaccctgcctcggagtctgtttnnnnnnnnnngggatcggccagaccagcgccgaatgtgcacaccggcgtgcccaagcaggcagggggcgtcgggcccacgccggcacccagcggggccgactccacggcgagggtgccgccagctggcgagaagctgctgagcatcaggcaccgccccgagtcatcctcccggtccgcggcatctggggagaacagcgggacctgggcggccggcagcagggccaccgcacgcaccggtggaggaaagggcggcgggcaagagggggccagcagcgcccccaccgcgctcgtgactggcctggcgcacatcaaactcaggtcgggtgagggttgctggagggggaagggcacaatctctgtgtgcacagtgcacccagcccacgcgtcagcgtcnnnnnnnnnncttgccctcaagctggcatccgtcgcggcgtagtgtagcgcatgcagctggggcaggggctccacactgggcaggagactgtctgccagcagcgcaggcctgtccaaagaagatgaagtgggagttgcgaccggttggcaggccctgcggcaggaccgtgagcttgcagagccacagcccgcagcccccgtcctgcactcactctgccacggtcttcccagnnnnnnnnnnatttaaccttcggccactcaccgccccgaatgaatgccagcgagagacggagcgcatactgcaccaggaccctgcgcacgaggnnnnnnnnnntgcagggcctgaggcaggaccgtgagcttgcagagccaccgcccgcagcccccgccctgcactcactctgccacggtcttcccagcctccaagaccatgtgtgccacgcgagcaatcacttcctctgggtcaaagctggcctgcccggccaactctgttccatactccgccatcctcctgcagacggaggatgctgtgatgggtgttggagcgatcctcttccgcttgctaaaccaagctgaacctagatgctgtggaagcctcgtctggtcacagctgaaatcccatgcctccataaacctcacatcctccctgctcttacgcacccctgaacatcacgagctgctgaaatggcatcttgctgcaactctatggtgggagtgcaggcatttgagttgcctgcttcgcctccacagtcatcagcggtagtgctggcatggtgctttgcctgtgacgccttgccagcctgtggcagcgtgacagaggtgaaagagtgaccagcctgatgctgtgtttgaatcattgagatggagccaatccaatcagacgtagcatagtgttgagggacatgtgccatgtnnnnnnnnnnagtagtgctgggatggtgctttgcctgtgaagcctcgccagcctgtggcagcgtgacaggggtgcaagagtgaccagcctgatgctgtgcttgaatcattgagagggagccaatccaatcaggcatagcatagtgttgagggacatgtgccatgtgtggtacctttgtgggactgagggtggtcaaagaatgcccagccggtgttggagcccaacacgctcgtgcatttaggcctgtcaagcacccacccaacaaacaattaagcgttcaaatccccatttcccaccaaactcaccttcagcgcagctgcagccttgttcatttgcgcctgcaagagcgcgatgcggcccttgcatttcctggagggaatggcgggcgcccgggcagtggcctggcgcgcctcacgctgtgcctgctttgcattcctgcgctgccttcgcacctcctgccttatagctgtgaggtctgccatgtcgcctgccagaccgtctgcattgccaatataccgcgggttgggcgagtctgtcagaggatcaccgaggctatgcacagggtgtgctgggtgctccctcattactgaccttcagcaagtccgtcgggagaggagtcaacctccatgccagaagtatgtgtgtgaggattcgtccttccttccagctcagaaggtcttgcggtgcgtcccactcagtgtcctccgtccccagcagcgactcggaaagcagataccacagtttcccccactcttttatcctgagcgagcatgcagctattctgcaagtcgtatgtgcatagttatgatgtatgtctataggagatgcgtctcgggcgacctgccatcttctttcagtagcgcgcgatcatttgtcgacaatgatttcaaaggccgggattcggacccgctgaatttcgtacggggctcgcgcaggctggaccccgaacactggcgacatccccttcgacgccccggcttgcgtagaaaagggcgtttgctgatagaaaatgaaggctataacccaagtgtggggtgttgaagcgaagctgaagattttgaccctgtcttgacgatccagcacacccgtgacagctgtgaacgagatgcaggcctgctagcccattccagtggctgctgcggaccatgtgtgactgcaaaaattcatgtgagtatctgaagaacttctgacccattctgcatcgcattgggcgcagtagggcaacgccttgaccattccacccttgttgttaccgcccggacgtgcgggtattggggatgggcgccccgcgcgcactgggacgggcaaagggccatgcggcacacattctctagccattttttaatttagagtctgatttcgcccactataataaccccggggaagccaatgccacccctccatcctcacctcagagcccgtgggctcccatggcccggaaacctattccgctgggtgcccctcctccgaacccacctcacacgctggacgttggcatcacacggacgcacagcggggcggggagtaccctaccccaggaccgtacggggtccagctccgttcctccaccccagcctcatgcgtccgaggcgattgagcaggccggtccagggccaagcagcctgcccccgtctcccggcaattcgtcagactcccaggaggccgacacctccacccaggtccctgtcctgcccggcgaggcgcctcagaaacgcccccgcaccgtgtaccccccgccgagggccgccctgccagagcccatcccccccagcgagctcctgtttcccgaccgcaccagcggcccggtgcacccccccaactcggcggggcacttccagtatgaggtgggggagaacctgaccgctcgcttcaagatcatgcgcaagttcggggagggcacctttggccaggtgctggagtgctgggaccggcgacgtggtgagtatgtggccctcaaggtcatccgctgtgtccaggtggggagtggaaggtgttcaagatgggaaggcgggatgtgaggggggggtggaggttggtttgctggcctatccgtgtatgtgtgtgttccagtgcatttccttgcatgaccacggaccagcctccatagaaatttcagggtccnnnnnnnnnntggtgttcaagatgagaaggcgggatgggggggggggagaggctggtttgatggcctatccgtgcatgtgtgtgtgttccagtgcatttccttgcaagaccatggaccagcctccatagaaatttcagggtccctttgcgagccagaccttccttgagcttcccgggtcgacagcttcacccccttcctctccctcgactgcctgcacagaagtaccgagacgctgccatggtggagnnnnnnnnnngtccttgagcttcccgggtggacagcgtcatccccttcctctccctcgactgcctgcgcagaagtaccgagacgctgccatggtggagctcagggtcttgcgcaccatcctggagcacgacccgggcgggcggtggcattgcgtgcgcctgctggactggttcgactaccggggccatgtggtcatggtgtttgagcgcctgggtccctccctctacgactacctgcggaagaacgactacgcggccttccccctggatctggtgcgtgacaccgcgcggcagctgctggaggccctggccttcctgcactcgctgggcctggtgcacaccgacctgaagcccgagaacgtgctgcagcgaggcgtggaggtggtgcgcgcctcctggccctccggcagccgcctggcgcggcgcctgcccgccacccacgcgctgtgcctggtggactttgggtcggcggcctgggacgccgacgcacacgcgcacgtggtcagcacgcgtcactaccgcgcgcccgaggtggtgctgggcgcggggtggagctggcccgccgacctctggtctctgggctgcatggtggtggagatgctgacgggggacgcgctgttcgcgacgcacgagaacgcggagcacctggccatgatgcaggccgcgctgggcacgctgccnnnnnnnnnnnnnnnnnnnnnnnnnnnnnnnnnnnnnnnnnnnnnnnnnnnnnnnnnnnnnnnnnnnnnnngagcgggagggagggggggttcaaggatgccccctgggtttccaggggtggacgaaaggttgtatgtcgctgactgagtggtggttcagggttcttgcagggaaactggtgttggaagggactgaaggggcgctgcgcggccgtgcccgggcgccatggggggccacctgcatcctgttaacccggcatggagactcctgaaccggattcctctgtgctgactggcagtgacccgcaccctcggggccccctggtcacnnnnnnnnnngactggtgttggaagggactgcaggggcgctgcgcggccgtgcctgggcgccatggggggccatctgcatcctgtcaccccggcatggagactcctgaatcggattcctctgtgctgactggcattgacccgcaccctcggggccccctggtcaccaccacaccctcgcctccagctccaaccaaccctgcatcccccgtaccccaccgcaccccagctccgtgctcgactggccggcggtggcgagcagcaagaagtccgtcaaggcggtgagccgcacgcggtctctcaggacgctgctggtcagccggggggactcgagcatgcagccccacctggagatcgtccttggtgggtggaggggtgggtgggatgcagctgggattgctggagacgatggttttgccttggggacctggagcccagcctgcgcatgcatccccacttccccagcgtcagcatcagatcaccttcacgcaaacgccctgacctgcgcctgcgcatgcatcccctctcccactccctgaaaatacagatctggtgcagaggatgctggccttccaacccgacgagcgcgggtccgcggcgtccctgctccaacaccccttcttctcgctccgactctgaggcacattgccgctcatcaccctgaccaaggcatggacgccctgcaccgccgacggacacactcctgccctgagagaaggccccttatctcagtccctgcatgatcaggggaggcagaggcggcaccatccccgacaggccaggcaggcagaccgggaggcgcaccaccgacactcgcgtcccctccctgacctccatgcgccccgaccaggagcgatcgacctgaagctcaggccgctgctctgacacagaggcagtgcatgacattgtgtcccaggcccatcaaccgacggaccgacacagactcctggcgccgaaccccaccccaaaccccgattgcgtgctctgnnnnnnnnnnggcatgacattgtgtcccaagcccatcgaccgacggaccgacacagactcctgtcgccgacccccaccccaaaccccgattgcgtgctctgccacctgactgaccgacccattcattgctgctcattgacatgactgcaagcactgtcatgcaagtatcatttgtcatagtccatgctgtattcatgggagaaggttgtaactttgctcggatccagactgagacatgggcaggccactccagcctttttccatcccctgaaccaaccttcgaatactggagcttcacagnnnnnnnnnncgatccagactgaggcacgggcaggccactccagccttttccatcccctaaaccaaccttcgaatactggagcttcacagcgcagcagcaacagcaagtctgagggtgtgtgtttgtggtcaggggcgggcatggcacccactccctctgttcaaatcaatgtaaatggtggtggcagtgaatgggctgccaagttgggtgggacggggtcggagcaatgagcaaggggggaaagggcgtcagggtcagcggccagcgcccagagcacctcattcctcctcaatggggtgccaggggtgtgatgccgaggggcgacagcggggccgggcccaggccagagttggccccggcgggcgggaggccatgtgccaagtccagggaatccagccactgcgagggcgattgagggggggtggcagctcgtaaatccaggccctgagaggttaaaaggttggagaagcagcatgtcccccccacaccatgcgggtccctgccagccagcatccagatttgtcagcagggggcgtcccaccccaagacccagcccctccgcacatgaacggccgcccagaagtcgccgtcgggcgcgcagctcgagctgctgcctggctggcccggcatgccggcgccggagcccgccctggagccgtccttgaggcccaagggggacatcaggctggccgccagcggcgannnnnnnnnntgcgcagctcgagctgctgcccggctggcccggcatgccggcgccggagccccccctggagccgtccttgaggcccaggggggacatcaggctggccgccagcggcgacagccccggtgcaggggggtgcgcggcggcggccgccccctccctgccgtcgtgtgcgggcggcggccgcaccttcacgggcgatagccgaggcctgtcctcctgcatctggccagagacgttgtggtactgctgctggtcgggccggtcgtggtactgctgcacgcccccctgctgctgctgctgctggggctgggcctgggcctctgagggccccgacatctggagccccggctgccccggctcgggcccgggccaggcgcccccgccctcgtgcatctggggggggttccaggcggggtgaccccacatgctcgggtcaaggccgacggccgccgcagccgcagccaggtgtgcggtggcagggtggtcgtgaggcaggccgggcggcgggccctgcatcaccaccaaattccctgctgcgtcgcagcggacgtagggcgcgtacatgccggaggtacccgggtcgaatcccatgggcagcatgggctgcgtgnnnnnnnnnnacggacgtagggcgcgtacaggccggaggtccccggatcgaatcccatgggcagcatgggctgcgtgccgcgtcgggcgcggccgccggaccgggtctggacgccgggcaccgccagggagccgtcggggaggtaggggccggtggacgactgggggacgccgaggtcgtaggagtcgggatcctgcagcacgtcctcgtacattgtcagcttgaagttggtgatggcctaccggagtggaagtggggaggaggaggaaggtggggcggagatgttgcatgggaggggaagagggtgggccaggtacattgaagaacatggtgtataccattggcgaattgggcatgtgagaacaggttctgacaccagggagcacagctcctaccctggtgcagcatgctaatagtgcagccatggacatgggcgatgcaggcagccatgccactcataggatcagttgacatccccaccaacctgcaccagccgctcccacatcccgtaaccccccaggtacctttctgccgcgaaacnnnnnnnnnntcagggagcacagctcctcccatagtgcagcatgctgatagtgcaggcatggccatgggcgatgcaggcagccatgccactcataggatcagtttacatccccaccaacctgcaccagccgatcccacatcccacaaccccccaggtacctttctgccgcgaaacttgacagctgctcggtcgtaggcccgggctgcctcctcggcgctctcaaacgtgcccaggtacaggtacttggagccgtccacccggccaatgcgggcctcccacttgccgtgctggtggtgcttcgtgacgcctcggtactgggatgcacccctgcagaggcgcggcggtgtttgcgcgatgaggcggtggcttgtcatctccacatgacagcactcttggccttggattctgattccattgccgtggacatgcagtcccctctgcataatggtccggccctgactgcaaagcatctgacaagggcatcgaatatcccaaaccatccgcatacacaccggaggaggtctcacccacaactatccatgcaggcagagcgctcacctggcaaacccaaccgagccccttcgcagccgggagaccacctcgtcggaggtgagttcctccatctcggccaggctctccgtatagtcctctactgggaactgttgttcaggaatgggtgcccgggagtcatgtcatcgcgacagggaacggattcaggtggtgtcttctgcactgcatcagatcagcacccatgtattcatcagtcatcgcaagaacaccccccctgcacctcttcgcaacagcgaatcgtacattgatggcagctgcagcccccaggaaggccagggcagccaggtcgtatgctcgcgcggcctcttcctccgacgtgtaccctcccaggtacacctggcgcccacgcgtgcggccgcccttgccctgcggactcggtcggcatggatggggaggtggtatgatgcccatcattggcgggtgacttggtgtgcgtatgcagcggaccctggcctctggatgcgctgtttctctgcagtgttcccatccttccctcgctcccgccctgttccacacccacacccaccgcaccttggtctcccgcttgtgtgaggcatcccagaagtgggcctcgtatcgcccggtgagccggtgcttggtcaccccccggaacagggaggtgaacaccccgttctcccctgtgggcacggccttggtgctcttggtcgggcagtgcggccggcgccgtggccccatggcggccgcggtgagcgccgtcggccgcgccgcgtcgggcacggcgcgcgccggtcccg

SEQ ID NO: 35862 - DNA, 123 bp, Chlorella protothecoides
atggttgggctcagcgtggtatcacactgacgtgaccatcgctgtgcctgggtgaccctggaaccaccctgccagaacaggctcagaaactgaaatccctcccgcgcccctgcacagaacatc

SEQ ID NO: 35863 - DNA, 61 bp, Chlorella protothecoides
ggttcacaccctggggtggtgggagaaggggggaatgagcatgagcaatggtgagacaagt

SEQ ID NO: 35864 - DNA, 78 bp, Chlorella protothecoides
ctgccggctggcccgcacccctcccctccctccctctggaccatgcctttcaccccccagagcccctctgtccacctg

SEQ ID NO: 35865 - DNA, 74 bp, Chlorella protothecoides
gtacacgtgaggatcaaaattgcccagtctaccgagtaaaagtttcctgcctccctcagggcgtcaaggtgaac

SEQ ID NO: 35866 - DNA, 61 bp, Chlorella protothecoides
ctcgaccgttcgctgtcggcacgctgtacagcaaatccagccaggtcggccaccattgacg

SEQ ID NO: 35867 - DNA, 65 bp, Chlorella protothecoides
tcacgcaggcggagaataaaagagggagggggggcctttgcgggagacacttggcgatgggccgg

SEQ ID NO: 35868 - DNA, 123 bp, Chlorella protothecoides
cctgaaggctgcccgtgcccagcggattcacctcgcgctcacgagcctatgtatggaaccgtgttagatctgtacacaacccccccccccccactttcccatctcaggaccaagctacacaca

SEQ ID NO: 35869 - DNA, 80 bp, Chlorella protothecoides
gctgaggatgtcagcccaggcctgctcaggatcgggatgtcagccgcgcatctgatgatgtaccaggcagtcgagcactc

SEQ ID NO: 35870 - DNA, 94 bp, Chlorella protothecoides
aggttgggaaggctgtgcgagtactgctggacctcgacacaaacgcatgcacccattttgcacgaggtctcaccttctcctccatgacttgctt

SEQ ID NO: 35871 - DNA, 12080 bp, Chlorella protothecoides
  modified_base (264)..(273): a, c, t, g, unknown or other
  modified_base (644)..(653): a, c, t, g, unknown or other
  modified_base (2087)..(2096): a, c, t, g, unknown or other
  modified_base (4711)..(4720): a, c, t, g, unknown or other
  modified_base (4997)..(5006): a, c, t, g, unknown or other
  modified_base (5319)..(5328): a, c, t, g, unknown or other
  modified_base (7054)..(7063): a, c, t, g, unknown or other
  modified_base (8706)..(8715): a, c, t, g, unknown or other
  modified_base (9205)..(9214): a, c, t, g, unknown or other
  modified_base (10210)..(10219): a, c, t, g, unknown or other
  modified_base (11310)..(11319): a, c, t, g, unknown or other
aacaagcccgccgtactcactctccatcgctgcggtcaggggttcattgaggagccagtgcatcgcgctctctatgtctgccgggaggggccgcccagcgcatgtataggcgctgacctcgctgacctcgcctgccgacatcaccaccgactgcaggcgtgggttgtgacagggtcgggtcaggtgccgttgatgcagagaaatgaacgctgcatgattcctgcttgacgccgaccccaagggttggagggatccccggagcgnnnnnnnnnnggggtcaggtgccgttgatgcagaagaatgaacgctgcaagattcctgcttgacgccaaccccaagggttggagggatccccggagcgtgcaagacgggtgggaccgcatgcactggagcgtgtccccgcgctgggcctaaccctcattccccacgcttgcaacctgcaaaagattgagcacgcgtcgcatgtcgccctctccgagctggaccagggcttccagcccctcaggcgtcgtgggcaccctgcagcagtggcatgaagggtgcttgctcgtcaatggggcagcttaagtgtcggcacggcgacgcttcgtggtagcaccaacagatcccccttccgacctccagcatccccctcccaggactcnnnnnnnnnnattaagtttcggcacggcgacgcctcgtggtagcaccaacagatcccccttcccgacctccagcatccccctcccaggactcacttttcgagggcgcagatggaggtgaggcgctccgtcacgaagctgggcgggaggggctggaagcggaagcgtgtgcagcgtgactgcagcgctgggatgatcttgctcacaaagttacagatgaggcagaagcgggcatttctcacatacttctccatcactgcgggagggaggagtgggcgtgcagataagaattggtccttcaccagtattgggctgttctaatggatgggcgcgcgccgtgtggtccaagagcattcgcgccaagtggcaggcacccaccctgcatccagtggcattccctcgtggtcaggcctggggctgcaccgcacctctcctcagagccatttgggcgtcccgtgtcattgcgtcacactcatccaggatgatcagcttgaatttattgctgtggatgtgagacacagagtgtgtgtgtgtgtgaggggaattgactagagcaggacggcggcggctcgcatcaaggggttgggccgcatcaccaggaggaacagggggactgtgtgggcgagagccaagcttgtccaaatcccacccgccctaccctgccatggctccattcccatcacttcccatggattccctccctcacagccctcccagctcacttgaagatactccgtgtccctgcaaagtcctggatctcgttccgcacgatgccgatgccacggtcatctgaggcgttcagctccagcaccatgtttgcagcccctgggccgtacatctgccgagccagtgccagtatggtggaggtcttccccgtgcctggcggcccgtacagcagcaggtgcggcagctggttctcattcagaagcttcttgactacattatcgggaggagggtggtggctcagacatgggcttgatgctttgaagggccactccagcaaagtgatctcgtcgccgacgcataaacaaccaggtcccgctgttcgccccggcgacctactcgtgtcaattatatccttgtggaaggccacttcgtccagagtctgtggcctgtacttctcgctccatggcgtctcactcgtgaccaccatgaggaggcctcaccgggtgggtgatcgggcggcttgatgggggaattacaagtcgacgcggttgctagtgatctaatgtacagcgtagaattaccgtgctgatctatcgagcgggcgatgttggaatggggggggattcgcttcgtatcctttcaaatgctggactcggaagccatatgagctggcaagcttgcacatgcatgagcaccagggcatgggccaggagacaacctttcaatccctctccagaacagaagtcattgcttgggctccagcagcgccagagtgtcccnnnnnnnnnngacctttcaatccctctccagaacataagtcatcgcttgggctccagcagcgccagagtgtccctggcaaggccctccagctcccctgcgtaggccgaggcggccagctccctgcgcagcacctccaccgccccgcccgcggtcaggctcagcgccagctggcgctcccccgctgcagcggccagggccatgagcccgcagcgctgcaccccccgccggacgctgccctgcagcccctcaacgctgtccttcccccgcgcggcctccgcctgcgacagcgaggtggccgtgccgccaccgccgccggacggggccaggcccaacttccgggcggccgccgtcgccgcgccggcggcggggccgccgtcacccgccgcgccacgcgacacgacgcaggcgaggagcacggggaccagccgcggctccgccgccaggcgcccggccagcggccccccaaactgcgcgaccttgcgcacggcggcggccgcatagcagcgcgcctgggggtcgctgcaggccagggacgccaccacggctgcaaacccgcccaggtcggcaacggaggtggcctgggaggggcctgcgcggtgtgagatccaggggtcattggccggcggggccatgcgcgggaagtctgcaggctgaccgcggaggccgcacctcctcattcagtcagcctagcctggtgtggctgtgtgcgggtgcagtgacccaggccatgccctgcgctggtcctggcatctccaagctttccctgcatcacaagaatacctccccttctccccgtccctgcccactgccccctccctcttccgctccaccccctcccgcaacacacctgagcagacgatgcgcgcgaccgccccagccccagccctttggagcagaggatcctgggacagcacccaccgcatcaggcccctcagggtctcctcggacaccagcacatcttgaacccccagctctgagcctggagagaggggcaggaagggcactttaatcttgagctgtttgaccaagagtggctctggccatggctgcactcttcttgctaatcagacatgccatgcatgccaaaaagcatgcatgcatgcatgatcccatgccaaatgtgaaggctcctacttcttctggatgcatcccgggtttcactcccacaatatcggtgtgagccacaaggcaggagcacaaccgccgcaccggtgagcccatacagggctgcagccagagcccgctcctcctccacagagttcagcgagttcaggttgcctggcacagctgccagggaggggtaggtgccaccctcctctgcgctctccttggcctgagaatggagaggacggggaggcggctgcggatcacaggccggggccctgacttgccaggctcatagcatgaatgagcgcagcatggcagccccacatgccctcctctcaccacaccacacacgacaccgcgcagtggacgtgccccgcgcatgtgctcacagcggtactcccaccatgcctgcacgcaacgcgccacccaccagctcagcgctgcgtgcgagcagggcatccagtgctcccgctttcttcaccgaagcatggccctcaggctggctgagcaggtgctgcaggacgcgggccgcatgcgccctgcccaccgcgccgtcgcctgggccgctaccccagtcgttccttgcctgcatgcggtgtgcgaggtcaccgccgggtaggccacatgggctgcaatggatcccctgccgggaatgcacagcaggcagggtccatgccaaaacctttcccaacctgcacggcgtgagccccacctgcaggacggccgcaatctcatccagcagtagtgctgtgtcgggcgagggttgtcgggcaggcaggtaggctaggaggtctgccacacagcccagcgcaatcacacggacctgcggagatatagaattgcgagctggggcgtttgacctcagtcgcctctctcgtggttctgcgctcacgacaggcagatatggctatcgggcacatccagggagtgggtgggctgtgcaccacccccctcgccaatcaggacttctatgaggccacccacctggctgtcgatctcccggcttgtaaccacgtgcaccagtgccggaagcgcaccggtagctaggagtgcggcatggccatcgggatcgcgagtgaggcgggacaggagactaacagctgcctcgcgatcggctgtggtcccagacaccagatcgcgggtggcagctgcacgctcctcagacgccgggtcgggggagagggcggctgcagccacgggagtcgccaacagcccagcgactgccaagcccacccaggggatggaggatgatgcttgcgcatggtgtcctacaaattccaaatttgggcaagctggcggctgcagaactgggctcgggaggactagcctagacctccgagccagactggccaagctgcgaatgtgtcgcgtcatcgtgggaccgggtttcgctcaatggaccatgccaaacattagaagaggattgatgccacgttgtagatgcacactagcccttttgtttccagcttgatggtgaagtcgcgtttcggacacgatccgcggtctcggcgcgcgcnnnnnnnnnnaaccgggtttcgttcaaaggaccatgcgaaacattagaagaggattgatgccacggtgtagatgcacactagtcctcttgcttccagcttgatggtgaagtcgcgtgtcggacacgatccgcggtctcggcgcgcgcgatctccccgagtgtgttacggagggggagttgttggcatgtgtccccatcgtgaaagggatgcgacaatacaagcgagatatgttaatatctgaatataccaagcgccggatgcccctggaatttcgtccgccccctgnnnnnnnnnnaacatgttagtatctgaatataccaggcgctggatgcccctggaatttcgtccgccccctgaacttgaccggaatgcctgatcaagtcggcgggatggaggaccagcaagctgaatgtcgctgcattgacgtgcagggctcacccacggtgaccctgacccacaggcacacctttgctctcaagaacaacatgctcagtggtaggtccccgccaggcgatgcagggatctggccaaggttgggcagcgtcctcgcacaggggccctcacccacccaggcactcactcacactcacactcactcacacacacgnnnnnnnnnnccctatcacaggggccgtcacccacccacccactcactcacactcactcacactcactcacacacacgcgcgcacgcgcgcctgcaggtgtcacgctccccgcctggctctccttcctctggcgccacggcggccggctcgactggtggccctacgccccccgcatcggcttcctcacactcttgtcggcagtgaacagcctcctggccgtgccggactgggtgctgatgcggcgcagggtggctgccacccacctccacccggaccccgtctttatcctggggcacccccgcacgggcaccacccacctgcacaacctcctgtcccgcgacgcccgcttcgcctgtgtggacaccctagcggccggattcccgtctgcctttttgaccctggggccggcgctggctcgcctggccgccccgctgctggaccccacccggcccatggacgcgatggccctcagcttccagactcccgccgaggacgagattgcagtctgcgccctgacaggcacgtgtggatgagggtgggtgggtggggttcgaagaggctgaacaccgcaggcctgctgcgggatggtagcaggagccaggcctacatttgggccctgcagaggctgcatgtggatgggctgcagactcttgaacccaaccccggtgtttgcctgctgcctagggatccacgggccccccaactccgttcgaccaggcggcacgtccccatacatgcccctggtgatgatgcgggaccaggccctcttccagccctattaccagctggagtccgcgagcgcagccgacaccgcccgctggctggacgccttcacctggttcctgaaaaaggtcacgctgcgggccggcgggcacaagcccctgctgctcaagtcgcctgtgcacaccgcgcgcgtacccctcctcctcaagctcttcccccgtgccaagttcatctacatccaccgcgacccctacacggtgcgagggccgcgagtgtggggctggctggcagcgccggtgcatggagaaagcgcagtccctcgtcaagggccagccgtcgcgcgcactggcacgcagcggcgtttggacccacccatttcccacggtccaccagtgagcggaacatgtgcacacacacctcaccccaaccaaacgccccaggtcttctcctctgcggcgcacatggcggactcctactacccatacacagccctgcagcggatgacgccgccagacgtcaccaggttcatcctggatcagttcagcttgctgcatgatgcgtaccaggcagccaagccactcatcccccccggtacgactcatgatggacatggcaactcggctggggcacaaccatgaggagggagggggtggtaagcggcccggcgcgcactgcattaccaaccagccccatcccttcctcgctctcacaggaaacctggtcgaggtgagcttcgctgagctggaggctgatgctgtgggcacgctgcgatccatctatgacaggctgggcctcgctggctttgacagggtggagcccgacgtccagcactactgctccacacttgccgactttaagaagaatgacctagagcggtgggagtcatgggtggtgggagtgcctgtggctgtctgcatggccgggcagctcggacaaacaaggtttccgtgaagccacatgcagacacagctcagtgattgatttgagaagttgactgcgtgtgagtgctgcnnnnnnnnnncgccgacttcaagaagaatgacctggagcggtgggagttgtgggtggtgggagtgcctgtggctgtctgcatggccgggcagcttggacaaacaaagttttctgtgaggccacatgcagacgcagcacagtacttgctttgagaagttgactgcgtgtgagtgctgcggtgatgctgcagcatctacacaacgaacctccatgcagcgagactctcccacgaatctcctttccccacaggctggatcctgcattgaaacaacttgttgcgacacggtggcaacccttctttactatgttcaattacagcacctgacgcctgccgactcatgcctaaatgtgtgggaattggacgatactccccgttttgaattgccaaaccctatatgcttccttgtgctcagccaacatctcagatttttgtacagtctatatggttggaaatgagcatggttagcgctcttgcttggatcatcagtgcccgccagggttgcctgatggctggcgacgtacacctctctctttcctctcattaacaaaaaggtggcttggaagacaaatctcaatcatcatgtgcatgggtgtggtatggatggccgtgcgaggatctgtccactcagggtgatcagtgatgatggttgtgtgacaagggccgcgtcccgtggagtggctctgatgccatcgggctcgcggtgatgcattctacattgatgaaggctagcgtacagagaggagggaaaggcccaccaccagtggggcgtcgtggtcatgaggcgttttgtagtgcgaggtccaccagaccggccagaaagtggactctgactcggaagacacccgcgcggatggtttctgcggcgttggatggattttggagaggcggttcagcatttcgaggaatggaaggcttcccggacgacttgcaaccgcaacaatgcccgatgcgttcccagacactcactaccgaaacaggcgccgtgcaggcactgctcttctccgtctccggcatgggccaccaagagtctgtccagaagccactcatcggtattcagtgggttgaggggcacccgaaacaacggatccgcaagaggggattgtacagttcacagtaacaacgagaggacaggcgagcgtttatgagaacagatggcccttctttgacacctcatgataaccagaggcttggctttattgtgttagcctccctccggaaccgggctcgcctagatgagacattctggcagcatcgacagggggagcacccctccggaaacatactcgcgcgcgcgcgcccggttctgcggtacccctttcaaaagttttctgacatcctgcatggttcgttgtgtctcggatcgtgagggacatcgataacatcatcgcattagcatctatcactagtcaggtcccagtcgaggaagctgctggggctgctgccattcatccagagtgaactggcagggtgaacgaatgaccctagccgtgcttgcacctgcattacatgcttcaggtcatgaactggagactatcttccgcaagcttcctgtggaagctggaccggtagtccacagatgtgagaatatacatcgctggctgcctggccatgcaaatttgaatgagcccaggttgttcatcccgactgtgccnnnnnnnnnntatgtgagagtatacatcgctggctgcctggccacgcaaatttgagtgagcccaggttgttcatcccgactgtgccttgcacacccttgagagggaaatggtatgggatgagtcatttgactggctgaaaactctactctgatggtccaatagaggatggacccctttcaaagctgggaaatgcccgctcagtaagcgtgccgatgtctcccaccggcattgcctagatagaaccaatccattgtgccagcgactggtgaacgcaagcccatgcaagatcagatggtaaacttctgtactgaaagcaattatacatttcgattttgaacactgttggatgggaggagggactgaaggaagaagtttgtaatgcaattgggctggaatctgatgggaagtcgtgctttagttgtgctcgcatgggcgacgtggtccttgtatgtccctgccaaacctgtattcgtcccgtatcaatccggatcagaacacnnnnnnnnnncatgcaattggactggaatctgatgggaagtcgtgctttggttgtgctcgcatgggcgacgcggtccttgtttgtccctgccaaacctgtcttcgtcccgtatcaatccggatcagaacactgtcaagtaaatcgtgcgtgatttggagtgttggaggcctgatcatctccgagcgcctcatcataatggggtatgttggctccgtcgagaatgacctcaacctcgggtcggtgccagacgtgctgggcggaggcacccaggacttcacctggtggagattccttgcctgggttctgctccccctgcccgtcgtcctggtcgttctcctgtccgcgccagccccccgcctggtgaggaggggtgtcctccggttcgtggagactctccttgtagcgagggtgcgaggacccattgagatcatccactttgccctgctcatcgcgggtgagtgtggtgctctctcagtgggtgaatctcggctgtccgtgtgcacggagctggccagatgcttggtatcgccaggatgcctgacccagggtggaggtggtgcctgctgacatgggtgcaggctttgaggctatcctcttccccagccagagctcctctgaagtcatagagcccccctgcttcggattctttgcctgccaagcgtccaatgcccaccgcatgccatcgtctatcgccaggtctgtcggtgacgttctgcatcgggcccatgctgtcctctgaggcggaggtggccaagctagagaatcggcgggaccccaacatcctggtcatgctcttggcgcgccagtatcgtaacgagcgcaacttctggctggcgctcttcacgctgtcctcctgggcggtgctgtggatcgtgtaccaggtgcgcttgggactcctttggggggccagcaggttcccatattgtgaatatgtctttcctcggtttcccaatagttgtggtgacggcatggcggggcgacttggtggcatgcagccctgaatgnnnnnnnnnncgttatgagtatgtctttcctcggtttcccagtagttgtggtgacggcatggctgggcgacttggtggcatgcagccctgaatgccctcctgggcctcgcccgagacccacttctacatgtcaattgaccctcacctctttctccactgatgaatattcgcaggtcaaccgcgacaagcatgtgctgagggggaagctgctggctttgcagggcaagggcgctgctgccgcagacgaggtggcgttcctcggcaacgacagcgcaaggaggctcgaacgggcgggggacaacgtcgctgccacgcggccggcagggacctcccgtcccactgtcgacgggattgtgaagaaggacctctgatgggcagcaggtgctcctcgccctgcaaacgccccctggtgtactatgcagccgttgggtggctgtcccgggggcaccccatgcctggcatgcagcctcaatgggtctcagagctccctctgttaacctgttgcctcttgaccgcattgcccagcgccccacctccttccctcaactccctcctgggtcagcccctggcaacaggcagcccatctccatgtgctgcctacatgtggtctggtcatggcaaatagtaatggggaagggtgtatgtcagttgtgtgggtccccgtcgggagtgcattacgccaggcacattgctcgagaaagaagagttgtgcatgaacggggaggggcacagggagcacgttgcagggtcaggtcagggacgtggatgggtcccacccctcgctcctcaaaacatgtcggggaagaggtttgcaaactggctcacgggcggggcccggggcgccgcctgggtcacggggtacatgcccgcaggcccgatgccaaaggcgtcgagcccggggtcgggagccaccaagcgccccgcctgcagctgggcctccgcctgcccggccagccctggcccagggtaggcgtatgcggcggcggcggcggcgcccatcccctccatcatcggcgccccgaggggcgcgtggggcgcctggcgcgggagccccgggggcgattcggcaaaccccggggcggcgacggggcgggcgccgtnnnnnnnnnntccccgggggcgatcctgaggaccccggggcggcgacggggcgggcgccgtccccggccagctcggaggagaccagctcggcgaggcgggcgccacgacgcttgcgcagctggcgcccgctgagcgcgggggacgcgcccagggacgggccgtcctgccccggcgacgcctggccctggctctggccagggccccgcctcgagccgtccgatgccgtggccgaggcgccggccccccggctcgcctcgctccgggccgagatcagcgccgccagctcctcccgcgtcagcaccgtcacgcgcgggccccactcccccggctcctcgtgctcgacgtggggtggggtggtgccgctcgccgcctccccgccgctcgccgctcccccgccgcccgccgtccgcacattgcccacgcctcccaccgcggcggccgccccctggcgcgccagcagcgccaattggtggcggaccgcgatggccacctcgatgggccaggggccatgcaggcccagatcgcggcacaggccctgcgcgaagatctcggggccctggggatcgatgcgcgagacgtcccactggaaccggtcctgcagccggacgttgcccacgatgcagtctagcctggggcgcagtgggaggggtgggtggaggcgatggatgtcaaaattaagagacagagcacgatcgagcttgaacagggaggaggaggacggagggcgaggggcaacacgctgcccctcccaccatcacacgccccccccc

SEQ ID NO: 35872 - DNA, 135 bp, Chlorella protothecoides
ggtaccatgctgctcctgcatcatggcgtgaacaggccattgcaagtatgactttcctcttaatccgatgcatggacgacacctttgcttcgtgtgcagcgctgaagggtacttgtgccagcatccatggccaca

SEQ ID NO: 35873 - DNA, 61 bp, Chlorella protothecoides
gagggagaagagtgatgaggtcgctacctaaagatccttatctttgctaacatcatgcctg

SEQ ID NO: 35874 - DNA, 1212 bp, Chlorella protothecoides
  modified_base (318)..(348): a, c, t, g, unknown or other
  modified_base (619)..(628): a, c, t, g, unknown or other
  modified_base (871)..(880): a, c, t, g, unknown or other
  modified_base (1007)..(1016): a, c, t, g, unknown or other
gcgcggcggcgccggggacggagatggcggggcgctccccgccccccgcttcaagctgaagatcaagctggggcccgcagcgccgcagtcccccggcggcgccgcgccggcgcccgcgccctcgctgacctcctcgctggcgccgcgctccgccaagcgccagcgcagcagcctgctggaaatgtacgcggacgacctggcgctgtcggacggcgccgacggcgccgaagacgccgacttcgagccggaggcggcggaggaccacgcgtcggacggcgagtggagggccggccggcgcggcggggggggggggggggnnnnnnnnnnnnnnnnnnnnnnnnnnnnnnnttggcgacgagtcctccgaccccgaagcgccgtcggcctcgcggcgctcccggtgcgtcgcagtttggatctgttctttggagggaggggttgggaggagaggctgctgctgacgaagggagggtgggtatgaaaggacttcgtgggagtcgagccaaaggctctgcacgtcgcgtgcacggtcccagaagccatccagggcgccgcgcagtcccccgctccaacccaccacccgccgcaccgcagggcctccaagcccagggcggcgccnnnnnnnnnngggaagggagggtgggtatgcaagggactgcgtgggagtcgagccaaaggctctgcacgacgcgtgcacggtctcagaagccatccaggtcgccgcacggtccaccgctccaacccaccacccgcagggcctccaagcccagggcggcgcccggtcctgcaaaacgtgcgcgtcgtgcatccgctgtgcagagcgtggcggccgtggcggcactgacggggccggacgacaagcccagaggtnnnnnnnnnntggaggaagggggggatgggggtggtgtcctgggtctgaggctcactgatgtttgtgtggtctgcgtgacggcaaacactgtgcacactcgctcctctcccgcctggcccttgcaccgccccttccnnnnnnnnnngccgctgtgcagagcgtggcggccgtggcagcgctgacggggccggacgacaagcccagaggtgcttgggaggaagtgggggatgggggggggggtgtcctggatctgaggctcactgaggtttgtgtggtctgcatggcggcaaacactgtgcacactcgctcccctcccgcctggcccttgcaccgccccttcc

SEQ ID NO: 35875 - DNA, 80 bp, Chlorella protothecoides
ccatcaccatcgccgtctgcagcgggggatgcggagggggtgggtgggaggtggaggggagcaggaagtcaggatggatc

SEQ ID NO: 35876 - DNA, 79 bp, Chlorella protothecoides
tcgtcacgccaggcgaccgggcccccactcaaggtaatatcaccccaacgagaaactccccttacctgtgcctgctccc

SEQ ID NO: 35877 - DNA, 74 bp, Chlorella protothecoides
gcagatggaggcgtgtgcattcgctgggtgtctgcagtctgtgaccagcgagaggaagcctgtggagcaggtga

SEQ ID NO: 35878 - DNA, 77 bp, Chlorella protothecoides
ggagtgtggcgtcctccagggccagccacaagcccaccactgagggcgggtcggtgaagaggaaggtgctgtcctgg

SEQ ID NO: 35879 - DNA, 93 bp, Chlorella protothecoides
cttgccttccggacgctgcccttcgtgagcctgactaccagcactcgagctattccgcagcgtatcgcccacaaccaccgatttccccctcgc

SEQ ID NO: 35880 - DNA, 61 bp, Chlorella protothecoides
tgctcgcgacagcgtcgtatcggctgggggggcctgtaccgtcgtcgacgccatgcagtga

SEQ ID NO: 35881 - DNA, 137 bp, Chlorella protothecoides
cctcccatccctccccccccgcccaataccacctacccgccagcttccgcaggaggacggatcgcagcgcctcgacctcctgcgccaggtccgcgtcgggcttggcggaaaccgccacggcgcaggcgcgcccaaac

SEQ ID NO: 35882 - DNA, 121 bp, Chlorella protothecoides
ccctcggtttccatccagaacccccctccacgacgagctccagacccagcggggtctggaaggccgccgcgggacgagcgccggcccctctccctcggtttccatccagaacccccctcca

SEQ ID NO: 35883 - DNA, 64 bp, Chlorella protothecoides
gtgttggggtcggtttttggcgtgtttacctgacgacaaagcggtcgcaagatgcatgcctgcg

SEQ ID NO: 35884 - DNA, 110 bp, Chlorella protothecoides
ctgtggcctgcggtgcgaggaaagagcggcgtacacgtgacgcccaaggattggggtttactcgacaggacatcacaagtgaccaaacacttgaaccatacctacaaaca

SEQ ID NO: 35885 - DNA, 61 bp, Chlorella protothecoides
ccaggcagggaatgtgcatcaaccccaccaccccccctggcacaccatacagacgagggga

SEQ ID NO: 35886 - DNA, 79 bp, Chlorella protothecoides
gccatcaccagccccagagagggacccaggaagccaggtgagccccgcaaggaggacctgccgccctcgcaacactccc

SEQ ID NO: 35887 - DNA, 61 bp, Chlorella protothecoides
tgttcccttcgcatccctacctcccaccctagcctccctcccgctccaccacgcaggcggt

SEQ ID NO: 35888 - DNA, 62 bp, Chlorella protothecoides
gtggtcggctcgccggcggcgcgtttccgcacggtgcccctcgcccgcgtgccgggagcgag

SEQ ID NO: 35889 - DNA, 246 bp, Chlorella protothecoides
gaacctgcgggtgcgacagaggagccacggcgtgtgaatggcaggactccgcacgcgctccttcctcccagctgcatgcatactcatgcttttcagcgcctgaacacccagcagccctcgaacccatcgccatccctggcaccctccaactcactgcgtgctgcctggggtcccactggggccgggcacacccatgcccatcaggtggtgcggggtctggctgggaaatatggatggcagcggctg

SEQ ID NO: 35890 - DNA, 76 bp, Chlorella protothecoides
cgccgagcagcgaggggctcgcctagtggcgcagagggatgccgcagcgcacgcggcgtgccatgcgctgctgaag

SEQ ID NO: 35891 - DNA, 111 bp, Chlorella protothecoides
agctttcttcactgttccgggaggggagaatgggagaatcgtccaacctcacctccccggaccagggtgccacgccggccttcaggttcggctttgcgtagcggtgtggca

SEQ ID NO: 35892 - DNA, 143 bp, Chlorella protothecoides
acatgccagcgatcttctgtatgtgaagtggcctgcctctgccgtatcgtggtggacaaaagagcctgcagggtggtgctggcaaccctaacgtcagacgtaccccactcctccctggtcatgccccccccagcgacaaccgg

SEQ ID NO: 35893 - DNA, 455 bp, Chlorella protothecoides
  modified_base (156)..(359): a, c, t, g, unknown or other
ggtatgtgtgtggtgcacaggagagtggttaacgatgtttgcatgctggtaaagggtcatgcatagggtaccgagggtctccttcccttatctccttggtaggaatgcctcacgtgttgcccctatggcctagggttggtgtgccacaccgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggctgggctctgttgggccttggtgcccgcacctgggtcaacacgcatgactggtacaccgttgcaggcatggccacgtcgagcagccatcat

SEQ ID NO: 35894 - DNA, 95 bp, Chlorella protothecoides
tgccatgtcaaagcatggcagggacgccttgcacgccctttccacttgcagccctcatgtggctgagaacaaggaacaaacccactcccaccccg

SEQ ID NO: 35895 - DNA, 402 bp, Chlorella protothecoides
  modified_base (110)..(318): a, c, t, g, unknown or other
ctccagacgccccgcctgactgtcacggtgagaccggcattacttgggagtaacggcagtgctgagcatggcatgtgccagggtctcaaagtggggccagggcggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgggggttactctggcctcaagatgtcaaccgggcagcttctcagcctgcgcgtgtcaagatgttgcgagccgcaccgcatg

SEQ ID NO: 35896 - DNA, 104 bp, Chlorella protothecoides
cccccgtggcggcgctgatggcggagttggctgcaaactccgccaccggaaggtgtacgtcccagtcggtctcgcaggggtccaccaggccacggaggatctct

SEQ ID NO: 35897 - DNA, 76 bp, Chlorella protothecoides
ctgtgcacccaccttgagcactgtgccaaagttggtgtactctgcggtaaagtacacggtctctgtgtcataaatc

SEQ ID NO: 35898 - DNA, 127 bp, Chlorella protothecoides
agcctcatgaattggacaccataccgccatcctaaccacccctctccccccccctttgccgcgcagtcttgtccctcatgcagcctccacccgtcgagtccgggccgggtcagcagggttacccgcc

SEQ ID NO: 35899 - DNA, 68 bp, Chlorella protothecoides
gcggagcgatgccccaggacaactcggtccgcaggtgggcccgttgtcagcatcgcagtgcacctgag

SEQ ID NO: 35900 - DNA, 61 bp, Chlorella protothecoides
agcccttcctgcccccggtcgaggggcgggggggtgacgaaggcgaggggcaatgagtgtg

SEQ ID NO: 35901 - DNA, 66 bp, Chlorella protothecoides
caccaccaacagataaaagattccatggcctgggttcccacctcacccacccacccaccttgcgac

SEQ ID NO: 35902 - DNA, 61 bp, Chlorella protothecoides
tcggggatgctgcagcacagggagccagggtgggggagagggtcaggcagaggaggtgatt

SEQ ID NO: 35903 - DNA, 84 bp, Chlorella protothecoides
cagccttggagccttccaaacctgcatgggcgaaggggaggggcgcgatgaggtcacgcaatcaatgcatgggcttcttgccgc

SEQ ID NO: 35904 - DNA, 119 bp, Chlorella protothecoides
gttctccacgttcctggaatggggacagggcgtggcgggggtgtggggggggggaacgggcggcatgctgctcccagacggccgccacgggcccctcgcgggctcctccctcacccggc

SEQ ID NO: 35905 - DNA, 156 bp, Chlorella protothecoides
actatgtgctggtgggtgcaagcaggcgctgcgtaaccacacgattgctttgcttttccaagggggtgagaagggcctcgaccgccccagcccatctatatgaggcctggtaggaatgctttcaacccgtcgtgacatcatgcttgaccctccccc

SEQ ID NO: 35906 - DNA, 71 bp, Chlorella protothecoides
ggtgggttgcggcgtgaggaggggcaagggggggcgggggaatgtggagagctggcgagcaggagacctgt

SEQ ID NO: 35907 - DNA, 123 bp, Chlorella protothecoides
gggttgaggtccgggtcgaaaaggcaacccttgttgtgggttgcctgcatcacagcctctggctgccatggacacatggcggtgcgacgaatcagggtcccagcctcggtacccagccagtac

SEQ ID NO: 35908 - DNA, 61 bp, Chlorella protothecoides
accgcctgcgtggtggagcgggagggaggccagggtgggaggtagggatgcgaagggaaca

SEQ ID NO: 35909 - DNA, 176 bp, Chlorella protothecoides
tgaggcctggggtctgagaccaggggagggatggggcggtgggattggggaccgtctgcccgctgggggctgcacaccgctggtgggtgccgtgatgtgtcacgcaccacccacgcgcgcgcacccggtccccctcccctcgcagaccggcgaccacccacgaagccgagctccga

SEQ ID NO: 35910 - DNA, 71 bp, Chlorella protothecoides
catgcccaccatcgcctgtgttgatgggtgggtgcctggacccatcgatgcgaagggttcaagtgggcgtc

SEQ ID NO: 35911 - DNA, 74 bp, Chlorella protothecoides
ggctactctctgggttacttcagcaccgacttggtcatgctctacgcccactacccggatgtgagtttgtggac

SEQ ID NO: 35912 - DNA, 75 bp, Chlorella protothecoides
aggcgctggagcccggcggcgatggtggacgctgcagtggcatcaacctgtgcatgtaggtagaatctggggctg

SEQ ID NO: 35913 - DNA, 62 bp, Chlorella protothecoides
tcgcgtccccgcattggcaatcaggaagtctcgggctcctcgcctggaagccccagcctctc

SEQ ID NO: 35914 - DNA, 61 bp, Chlorella protothecoides
tggcacgtccgacccactgcaaggctgagcctcgccgctcatcggatgagcagtgtttctc

SEQ ID NO: 35915 - DNA, 119 bp, Chlorella protothecoides
gctgagattcttccatttccagcagcatggaccccatatgccggggaccaccccaggcaaacgttggcaggcacactcacccctcccaacccctcacctgggagccctggatctgcagg

SEQ ID NO: 35916 - DNA, 61 bp, Chlorella protothecoides
tgtgtgctccttgatcgcttccgcaacctcaccaattccagtcatgcaacccccccgtcca

SEQ ID NO: 35917 - DNA, 424 bp, Chlorella protothecoides
  modified_base (108)..(313): a, c, t, g, unknown or other
ctgctggggttgtgagtggggtttggggagggcggcggcaggggaacaggagagggggggggaaggaagtaatcatcgcgggcatcaaccagccgggcaggcacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcaaaatgtggtgcatggagtggtggcggtgctctgagcagtgtttcacccgcaggggctcgtccctgttgccacactcgtccaagaagcgcacctcctccctcaagga

SEQ ID NO: 35918 - DNA, 89 bp, Chlorella protothecoides
acgccccgagggagggcgccagatcacgcaggcctgtgaccaagaaagcgcggaagactacggggcgcgtcgtgcgccaggagccggct

SEQ ID NO: 35919 - DNA, 80 bp, Chlorella protothecoides
tcatgttgccatgcccatggtatcagatttccatgactcatctcaaaagtatgaacccccttcccgcagggcgtgcaagg

SEQ ID NO: 35920 - DNA, 61 bp, Chlorella protothecoides
agaagctcagggtgtctttcagtggccacggaggttagatgcagttcagggctccggtccc

SEQ ID NO: 35921 - DNA, 61 bp, Chlorella protothecoides
aggagcagcatgctgtcggctaccgctcggtactcccaccgatcagaatctgtggcctcgt

SEQ ID NO: 35922 - DNA, 61 bp, Chlorella protothecoides
ctcaggcgcgggggcgggtgcggctgccggtgctggggctggattcggcgcaggtgcagga

SEQ ID NO: 35923 - DNA, 71 bp, Chlorella protothecoides
ttggaagaagggcgagtgaagaatgatgtgtgagagtgctatttgtggagtggccccatcagaaatgcgag

SEQ ID NO: 35924 - DNA, 69 bp, Chlorella protothecoides
caccatgttgaagcaatgacgagagggttaaggtgccgaatggctcaatgtgctgcagccgcagcagcc

SEQ ID NO: 35925 - DNA, 69 bp, Chlorella protothecoides
tggtgacggaaggatgatgagaagtgacggttgccaagtgttcaacgatagatcttccagccagtcagg

SEQ ID NO: 35926 - DNA, 729 bp, Chlorella protothecoides
  modified_base (100)..(306): a, c, t, g, unknown or other
  modified_base (410)..(636): a, c, t, g, unknown or other
aggaggtgccacgagaggacccacgtgcaccggtgctgcattgtgcgctcttgcagcgacacgatgcccggtttgaggagctagtgaatgcatggtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaacggcattgaacatgagcatgcaatatatacttctggtgtctcttatgagaggctaagagagcgcctctactgatcgcactatcgagtacggcattgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaaggtcgtcggtgggaccaggtcagtatatccttgaggtgaagctttcctgcccatcaaaattccttactgggtcgggtggcctctctt

SEQ ID NO: 35927 - DNA, 80 bp, Chlorella protothecoides
ggagagtacagaagcatgaggcgtgggcgaccatctctccagcttcaatatctccatgttgcacgatctggcgcctagcc

SEQ ID NO: 35928 - DNA, 77 bp, Chlorella protothecoides
cctgcggcaggcgggcttgcccccagggccacggctgatgggagttgaggccgacagactggagatggattatccag

SEQ ID NO: 35929 - DNA, 111 bp, Chlorella protothecoides
caacatcaaggtgaaccgcgcgcggtatttttctccacggctcgcgggcgccatgcctgcgccgtgcccctggcagggccgtggtcctccctgcgcgagccagcgctgagc

SEQ ID NO: 35930 - DNA, 109 bp, Chlorella protothecoides
gttgcaatggattgtagtacttgactgcagcagggtgcgttgtgagcatgggatgcacagggcctcagccaggtgatactggcaccaattcaattcagagtatgctatc

SEQ ID NO: 35931 - DNA, 74 bp, Chlorella protothecoides
tccttcacccaggcgatcccctcccccccctaaacaatccccttctccaccccggagggctccgcctccaccca

SEQ ID NO: 35932 - DNA, 858 bp, Chlorella protothecoides
  modified_base (177)..(288): a, c, t, g, unknown or other
  modified_base (494)..(503): a, c, t, g, unknown or other
gcgcgcgcgcagcgtcggcgccggcgccggcgacagcccgcgtggctccctgggcgcgcgcggctcgcgctcgggcactgtggtcggcggctctgacgacgacgaggccgcctttgcgctggacttggacgagggcgagggatcggtgcgcctcccgcgcgccgtcgtgggtgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggcggccggtcggtgggcttttcacgtcggtgtccagagcttctagtggtcgctggccgagtgcctgacggcgcctgcagcggcctgcgatcgtgtgcactgcgtttcccggtggatacactccacgccaccctcgaatgcaccgacagctccgacccctggaccccacccacacgcgcagacgaggccagcatcgcggccannnnnnnnnncgaggcggcgggtcggtgggctgttcacgtcggtgtccagagcctccagtcgggtgcctgacggcgcctgtagcggcctgcgaccgtgtgcgctgcgtttcccggtgcacacactccacgccgccctcgcatgcaccgacagctccgacccccggaccccaccctcacgcgcagacgaggccagcatcgcggccaaggcgtccgcgctggcggcggcgccctttgacgccgggcagtacggcttcttcgagggcgacgaggccggcgacctcgccgcctccctgctcaccgagctggagctgggcgacgcgggcgggtcggcgccgaccggcacgcgcgcctcggcggccggcag

SEQ ID NO: 35933 - DNA, 77 bp, Chlorella protothecoides
ggcacaaatgcacacacctgtcgctgtctgcacggagggatgccgcaaaggggaccgcatggcggggtggaggctgg

SEQ ID NO: 35934 - DNA, 61 bp, Chlorella protothecoides
gtccagcgcgcggagacttttgctggtccatgggttcaagacgccgaagcacagcccggcg

SEQ ID NO: 35935 - DNA, 72 bp, Chlorella protothecoides
catcctcttccagcacctgattcctctcccgtaacacctgcatcgcccctcacaccaacccaacccctgcac

SEQ ID NO: 35936 - DNA, 66 bp, Chlorella protothecoides
ccattgcagcgactggcaatcaggcttgctataggttggaccgcacagccaggggcattgcgtggt

SEQ ID NO: 35937 - DNA, 78 bp, Chlorella protothecoides
tgacgcaccgcttggtgtcccacacgtccaacagcttctcctcaccgctgcgcacccgctcatactggtgggcatgca

SEQ ID NO: 35938 - DNA, 66 bp, Chlorella protothecoides
caatctgggtcgggaaacagcgctcggagggtccacctaccccccccccccccccccccccccccc

SEQ ID NO: 35939 - DNA, 150 bp, Chlorella protothecoides
gttcagctcaaccatggtgttaggcagagcgagactggtgatgggggcctcaggtgttgtgggcaggccacagggtggtgccgtccaaagcctcgacgggaggctgtcggcggcagggccgtcggcaggtccacacagtcttggccaaga

SEQ ID NO: 35940 - DNA, 64 bp, Chlorella protothecoides
gccgtcagaggcaaccaactgcgccagcctgatcctcgcggacgtagctgtgcaaccggcgcaa

SEQ ID NO: 35941 - DNA, 61 bp, Chlorella protothecoides
gaactggaggctggctactgccatggctgggcagggacgactgatggtcggctctcgtctc

SEQ ID NO: 35942 - DNA, 66 bp, Chlorella protothecoides
ccagcccccgcccctgctgcctgggcggagtggggtgggtagacgtactcagggaggccagcccgc

SEQ ID NO: 35943 - DNA, 112 bp, Chlorella protothecoides
gcgctgcgtcgccaggtcggcgctccgcacaaagctgcgcgaggatttggccgaccagctgaccgacatcgtgaccgacgcagtgtgcatagtgcgccccgccgacggcgcg

SEQ ID NO: 35944 - DNA, 61 bp, Chlorella protothecoides
cgagggcccctccttcacggtcaaggggtcggccgtggagtggcagaactggagcttccag

SEQ ID NO: 35945 - DNA, 156 bp, Chlorella protothecoides
ggccttccggagctcgcctggtgggagggtcgggtgggtgggaggggatcggacgaaagcaccgaagcgtgcactgtgccgctcgaagggcaggaccaaccgtgggctgtccctctgggtagccaatgtgagatgtgccgtggatcatcccgaagc

SEQ ID NO: 35946 - DNA, 78 bp, Chlorella protothecoides
acggaggcgctgcaggcagggaagccctggcacgcgtcccacggagctggccccaccccctggggctgggaggggccg

SEQ ID NO: 35947 - DNA, 469 bp, Chlorella protothecoides
  modified_base (82)..(331): a, c, t, g, unknown or other
ggggaggaggtgcttgcccagcatgctggggatcacataaccacccctgtcacatagcagggtcaggcccatgactaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaggttcaggagcaagtgagggggcactgactggaaggggtgtgctcgacccgacgagggaggacgcagcgcctgctgttcacccttggcgcttggtggcctctgtgtcaggctgtctgcccgctgcagcagtgca

SEQ ID NO: 35948 - DNA, 89 bp, Chlorella protothecoides
agcacccccccggcatatcctttacctcaacggggacaccctcaatgcagcgctgcaaggatcggaggccctccttgaagtctgccttc

SEQ ID NO: 35949 - DNA, 67 bp, Chlorella protothecoides
cagggaagtgcggatgaactcctggctcttggcgttagtcacgcgcttggaggtcacctgcgacgtc

SEQ ID NO: 35950 - DNA, 115 bp, Chlorella protothecoides
agagcagtcgggaatgcaaatgttgatgcggcgcatgcggcagccgcgtcatgcacccaccaggagggggttgtgcaggaggggtcgcttcgcggcgctctccccgctctccagc

SEQ ID NO: 35951 - DNA, 80 bp, Chlorella protothecoides
ggattcccatcagaacacatgccgaggagcctcacagcgacgcctgaatggctaccatcgggcacccgcccacaggaagc

SEQ ID NO: 35952 - DNA, 61 bp, Chlorella protothecoides
cggcgccgaacaaggacagcgtccccgcgggcgcgccgccaaaggcggtgggaggtggtgc

SEQ ID NO: 35953 - DNA, 61 bp, Chlorella protothecoides
cccatgcctggtgtggattctgcaggcaagtctgtgcaggaaccagtgacgaccaggacgt

SEQ ID NO: 35954 - DNA, 279 bp, Chlorella protothecoides
tcagggaaacaccaggaactcggcagcagtgtttgcgggcgaagtgcgtcgccatgcacatgcgtgacccggccccgttttgcaacatcccaggcgaatgctgccgcctggtgtcttgagacgcggggcgggcatggccgtgcaagcatgcggctgttcagaaggatgcgctgctgcgtcgaaacgggcagggctgggcgccccccccttcccccccactttcactgccaggccacaacacagccactatggcggctgtgccctatagtaacccatttc

SEQ ID NO: 35955 - DNA, 112 bp, Chlorella protothecoides
gctgcgtgtgactgttccctcgcccgccgcacaccaccgccaagcggcagaggggggaggcagcgccggcagtgcagccaagccccctacctgacgccctccagcactcgtt

SEQ ID NO: 35956 - DNA, 76 bp, Chlorella protothecoides
acctcctcccactgcacgcgcctgctcgagctcgctggcgccgccggcgccagcgccctcgccggtgtcctcgctg

SEQ ID NO: 35957 - DNA, 103 bp, Chlorella protothecoides
agtatgccttgcctgatccgcccatgcgcgcggtctggggggctgcggcgtccccgaccccacgacctgcccttcccacacagggaggaggtggcgtggaggg

SEQ ID NO: 35958 - DNA, 69 bp, Chlorella protothecoides
ccccctcccacacacattcagtgtgggttcgatccgagggtgaatggcacgaggacttttcgcccatgc

SEQ ID NO: 35959 - DNA, 103 bp, Chlorella protothecoides
tcgccttgtggtactctgcggtgatgggagtgtggcggcgtgggttggtggtgcggagcgtggcggctgaggggtggcaggtccaaggaaggtgcaagaggtg

SEQ ID NO: 35960 - DNA, 74 bp, Chlorella protothecoides
tctggtggggccccgagcgcgagcgcaggcaggtgccggcgatagcgcggccggcccgagggtcggtgggtggc

SEQ ID NO: 35961 - DNA, 61 bp, Chlorella protothecoides
cgccaggaaatccccgcccccacccgccaaaacgtctcctcctcctccttcaaagaagtct

SEQ ID NO: 35962 - DNA, 75 bp, Chlorella protothecoides
gcgccctcctgcacgcctcgcgccctcagccacccccatagattaccaccatcccagcacgcacctggttgaagt

SEQ ID NO: 35963 - DNA, 61 bp, Chlorella protothecoides
ggggatgtgtgggggtggagagggtttactacaggctgcttgcgcctttaccggccagggg

SEQ ID NO: 35964 - DNA, 69 bp, Chlorella protothecoides
tcgtgaacacacctcatgagtcagcaccaaggacccgaattaatatctgcccatttgccatgctaccga

SEQ ID NO: 35965 - DNA, 61 bp, Chlorella protothecoides
cctcaccagcttgaaggagatgggctggccccgcttgtagctggagtcgaactccgtgccg

SEQ ID NO: 35966 - DNA, 82 bp, Chlorella protothecoides
gggtcggggagggggtgggtggatgggagcaaagagggcggcgaggggctctggggccatgagcgtggcaatcattgaaggg

SEQ ID NO: 35967 - DNA, 412 bp, Chlorella protothecoides
  modified_base (100)..(301): a, c, t, g, unknown or other
acctattccacgtcccttgcggcccacctattcacctcagaacgtgtggaggaccagaacgacgctgccgcagcgctggcgtggaaggaggggctcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagagttcctgttcgtgcatgcacccgggtgcagccgcccctcctcgcccccctgaccactgatcccgaaaccctcccgaccaaggagcctggtcctctttgaggctgc

SEQ ID NO: 35968 - DNA, 67 bp, Chlorella protothecoides
ttgatgcagaagtttggttcacaagcctctagtggtatgcttggcgggaagctgctccggtattcaa

SEQ ID NO: 35969 - DNA, 150 bp, Chlorella protothecoides
cagcatccggagcctggacctgtgaggggccggcccaggcgcagcatgctcagcatgcgtcgcgggcacagtccgcgtccggcggggagtgggatgctgtcgggcatcggatcctggtgaccagccctcggtcacccacgacagcctcat

SEQ ID NO: 35970 - DNA, 61 bp, Chlorella protothecoides
ccaggcgtttgtggaattcgctgagctggactcctccatcgccattgtcacccggtatcaa

SEQ ID NO: 35971 - DNA, 70 bp, Chlorella protothecoides
ccatgtgcagagcagcgccacacaaccgtgatcgaccttgacccacacgagccagacccgggcccagcac

SEQ ID NO: 35972 - DNA, 61 bp, Chlorella protothecoides
catgggcatggattgtcaggccgtggctcccggcgatcgaccgaccttgccatcgtcctcc

SEQ ID NO: 35973 - DNA, 61 bp, Chlorella protothecoides
agccgacgcatgacatcacccagcatcatcttcagcacgccacagaccccagtacggccag

SEQ ID NO: 35974 - DNA, 156 bp, Chlorella protothecoides
aagcgtcttgcccacctgcggcatggagagggcgaaacagagtgattggtctggctcagccccccgtcgctccccttgcccaccaaggccaaccacctccagacctctccctgcgcctcacgagcttgaaatcggcggccacggcgcccaggtgga

SEQ ID NO: 35975 - DNA, 117 bp, Chlorella protothecoides
cccttgagatccccgcccaaggcgtggcctttgggcctgttccagtccagttcccaactcacaacacccatcactcatcctgctgccctgctgctccacgctctctcccttcccttt

SEQ ID NO: 35976 - DNA, 69 bp, Chlorella protothecoides
ggcggtggactcacgacaggggccggggatgggatggcgggtggtgggctaggcatccctgcaggtgat

SEQ ID NO: 35977 - DNA, 73 bp, Chlorella protothecoides
ggggatcaaacgtgtcagtggctgtgcgcacctgtctacatgtgtgtgtagcgcactggggaggctgaagcca

SEQ ID NO: 35978 - DNA, 73 bp, Chlorella protothecoides
ctcaagcggcacgcctcacctggaagaggtgcagggagtactcctctgacactcctaggagctttgaaaacac

SEQ ID NO: 35979 - DNA, 439 bp, Chlorella protothecoides
  modified_base (177)..(186): a, c, t, g, unknown or other
tgaccggcttgcgcccgccgcgcacgcggcagtgccgcgcctggacgcagacgtagccgccgtggtcggggatctggcggctctgcaggaacaggaagccgcgcacgacgtagcgtaccgtgccgttctttcctcgcagcgggccatccaccacctccacgatgtcccccaccgccnnnnnnnnnnctctttcctcgcagcgggccgtccaccacctccacgatgtcccccaccgccacctcgttccgggctgggggcggggaagtgcggagtgggggagcggtgacgaggcggggaggcaacgacaacaactgtgggacaccacccctcggagtgaggggtgctgggtcctgaaccgacggcttagcaccgccgtctcgctccccaggaggcactcagcccagcctacccttcttcgagcaggatgttgagccccccc

SEQ ID NO: 35980 - DNA, 33584 bp, Chlorella protothecoides
  modified_base (444)..(453): a, c, t, g, unknown or other
  modified_base (1111)..(1120): a, c, t, g, unknown or other
  modified_base (1189)..(1198): a, c, t, g, unknown or other
  modified_base (2665)..(2674): a, c, t, g, unknown or other
  modified_base (3654)..(3663): a, c, t, g, unknown or other
  modified_base (4075)..(4084): a, c, t, g, unknown or other
  modified_base (4163)..(4172): a, c, t, g, unknown or other
  modified_base (4248)..(4257): a, c, t, g, unknown or other
  modified_base (4379)..(4388): a, c, t, g, unknown or other
  modified_base (4440)..(4449): a, c, t, g, unknown or other
  modified_base (4501)..(4510): a, c, t, g, unknown or other
  modified_base (4571)..(4580): a, c, t, g, unknown or other
  modified_base (6060)..(6069): a, c, t, g, unknown or other
  modified_base (8082)..(8216): a, c, t, g, unknown or other
  modified_base (8546)..(8555): a, c, t, g, unknown or other
  modified_base (10427)..(10436): a, c, t, g, unknown or other
  modified_base (10789)..(10798): a, c, t, g, unknown or other
  modified_base (11000)..(11009): a, c, t, g, unknown or other
  modified_base (11780)..(11789): a, c, t, g, unknown or other
  modified_base (11958)..(11967): a, c, t, g, unknown or other
  modified_base (12824)..(12833): a, c, t, g, unknown or other
  modified_base (15310)..(15319): a, c, t, g, unknown or other
  modified_base (15674)..(15683): a, c, t, g, unknown or other
  modified_base (17261)..(17270): a, c, t, g, unknown or other
  modified_base (18636)..(18645): a, c, t, g, unknown or other
  modified_base (19648)..(19657): a, c, t, g, unknown or other
  modified_base (20371)..(20380): a, c, t, g, unknown or other
  modified_base (20461)..(20470): a, c, t, g, unknown or other
  modified_base (20584)..(20593): a, c, t, g, unknown or other
  modified_base (21427)..(21436): a, c, t, g, unknown or other
  modified_base (22822)..(22831): a, c, t, g, unknown or other
  modified_base (23436)..(23445): a, c, t, g, unknown or other
  modified_base (24144)..(24153): a, c, t, g, unknown or other
  modified_base (25025)..(25034): a, c, t, g, unknown or other
  modified_base (25934)..(25943): a, c, t, g, unknown or other
  modified_base (26675)..(26684): a, c, t, g, unknown or other
  modified_base (28398)..(28407): a, c, t, g, unknown or other
  modified_base (28592)..(28601): a, c, t, g, unknown or other
  modified_base (28798)..(28837): a, c, t, g, unknown or other
  modified_base (28908)..(28917): a, c, t, g, unknown or other
  modified_base (29421)..(29430): a, c, t, g, unknown or other
  modified_base (29788)..(29797): a, c, t, g, unknown or other
  modified_base (30489)..(30498): a, c, t, g, unknown or other
  modified_base (30754)..(30763): a, c, t, g, unknown or other
  modified_base (32071)..(32080): a, c, t, g, unknown or other
  modified_base (32669)..(32678): a, c, t, g, unknown or other
  modified_base (32976)..(32985): a, c, t, g, unknown or other
  modified_base (33319)..(33328): a, c, t, g, unknown or other
cgcgcctcgaccccgcgcaccaagcccgacaagagcgcggcggtgaggtccacgggcgccaccgcggcgcccaggccgcggcagcgcaactccgcctcgccgccgcggccgggggagaggcggcagcccgcggggccgagccccgcacccacccccagcgcgtcggcctcctcgtgcctgtgcaggcatgtgagccgtcggcatgcttgcatggatgacggcagggcagggcgctcacaccgtgcgactcatgccgactcggcgcacctctggcccaggatgcgcttgaaagagcggaagaccaggacgtctgggtccgaatcggggcctgggcaccccagctccagcttaccagactgtggtggtgggtgtcggaggggctggagccatactggggaaagacagaggtcagcaagcacagcctgtctcctccccagaccgccnnnnnnnnnntggaggggctggagccatactggggaaagactgaggtcaataagcacagcctgtctcctccccagaccgcccaccttggtgcaggtaacaacggatggcacgagcagggaaccatgtatcgggagcagttctggcttcccatcagcgcctatgatggccacactggaggtggtggtgcccagatcgatgcccagggcgcaggcctggctgcttgaactgctgcatgtcgcatgccggctccaccgccggcatggaacccggtgtggcgcccaggaccgcacgggaatcgcatccttggcatcagaaagtcgcaatggaaatggaaaagctgatcggatgctagtgatcgcgtgcatgtggtccggtgtgtgtgcggggatgctgcgagcacccgttcactggggtaaggtgccgagctccggcatttccagaatggaaatcgaggtcagaggatgaagttattggaaggtcccaatcagttcagtgttttgcatatgcaaatggggcaaggaaggcgtgccattgttgttattcgattgaggctgcatcgcccatgcccccccgtggatccgcccatgctcgcgatctgcaatcgctagccaatgcaactcaaacatttttaaactttgcgcgacaggtttcctatcccagacttgannnnnnnnnntaggtcggaggatgaagttcttggaaggtctcgatcaattcagtgttttgcatatgcaaatggggcaannnnnnnnnnacatggatccgcccatgctcgcgatctgcaatctctagccaatgcagcacaagcattttcaaactctgcgcgacaggtttcctatcccagacttgactttggattcgcaagacactggaggggagcatcctctcgagcagactgtttcagcatgtaacaataaaagggcaagcatgagatgctgctgagtggttgtgagtctgcgccagggccacaaggtgtcccagctcaggcacaacgcccgattcaaacagctgtgtgagagggctcgtgataggagcccaggaaggacgctgctgacaaggtgcgaggaaggcgtgcatggcaggggaaagataatcgcgtatcaagtaaaacaagctcacgaagttgggcggcgcttccgtgcaaggtggccatctcctgggcatgatggtggcacgcggacggtggctgacaacccctccacgttccacgctgccagatgcatgggctgaagcggcgccgctgtccaggctgccaggttgcctttgacgcagaaggcataccgctggtggggatcagactgcctgcgccacccacaccgaacgaagggctatgcatctggcgcaactcatgggtcctcgcaggctgcgcgtactccccgcctcgtgcggcggtcaccagggcctgcatgcacgggccaggtcttcaagatcccggcagtgccgcagcagcgatgccagggcgcttgcctgtgctcctggctcctgggtcaaagaccgtgcgcgcagcggcccagacgccatgctatgctcccgcacccccgtccaccatggcggagggtatcctggaacgcacgttgagctcctcccccaccagtcccgtggacgtgccaaagggcacgttggacatgctggcaaaggggctggcctcagagccggaggaggccgcggcgtgcttggcgcgcagggccttgacctgcagcccggcggtggacaggggccccgcggggggctggccccgcccctcccccgcccggcaggaggaggaggaggcatcgctctcggcgtcgctccaggacccgccaccgtcgtcggacagcgcggcggggagggaggtgagggccgccgcctcgccgcgcagctccgccaggaccgtggtgaaggaggggcgctgctccggggtctcggcccagcaggcctcgatcagggcgcggaggacgggggggcaggcgggggggaggggcaggcgctggcccatcacgccaacgcagtagatgatctgcatgggggagggcacgtggctccacggcacgtcccccgtcagcatctcccacagcagcacgccaaaggcaaagacgtcgacctgggtgggtttgagggtggggaggtgtcggatgaggggtcaatctcttcctgggagaccgataattcaaggaacaggttgggtggggtgacattgggacatgcgtggcattccaggaagacagagctggggcgcatggtnnnnnnnnnngtgagggtggggaggtgtgggatgaggggtccatctcttcctgggagaccgatgatttgaggaacaggttgggtggggtggcattggggcatgcgtggcgttccaggaagacagagctggggcgcatggtctcgaggcagttgctgggctggccacgtccacccccagaacacccaggcggaggcctgcatttgcccgggccaggaggacccttgctcacagactgccccccctcccaaaaaacttccatgccaccccctccgtccaccttctcggtgatgcctgcaccatcaaacatctcaggggccatataggccggggtgccggcctgcccgttggccgtgctcacaaaggtccggtccttgaacttggcgatgccaaagtcgcagaccagggctcggccctcggcgtccagcagcacattctgcaagaaagaagggtgtcgggaggtggggaggtggggagggtgcctggacatggtggcacctgggtgaggccaggtgacgctggcaactcaccccatctgagtgggaccgcgtgccacatagtatcccagtcctgtccctccccagcctcctagccccgccaacttacctgcgacttgaggtcccggtgcaccaccttggggtgcaggtagaccatggcatccgcgatgccggccgcgatgcccagcagctcgtggtaggggagcggccgccgcttcctggcccccggcttgccgtgcaggcgggcgtgcaggctgccccccgtcgccagctcctcgatgatgcagatgttggggggcacggtgcacgcagccaggaaggacacaatgtgggggtgcttgagcgtggacaggacctccacctcgcgcctgcgggtggtgtggcagcaaggtggtcggagggtactttcatgggcgacacgtgcgcgagtccagcagagacgaggcaaccgtcggcgagcgagccagcgcccgacgaggcgagtttgtgtgttgnnnnnnnnnncgtggtgtggcagcaaagtggttggagggtactttcatgggcgatacgtgcgcgagtccagcagagttgaggcaaccgtcggcgagcgagtcagcgcccgacgaggcgagtttgtgtgttgaggctgggtgggagtgacgccaggcagccagcatcacaccctgcacaaccctccaaactgcttacttgaagctatctagttcgcgactgctgtgagtccggcacgtcatctgcagtaccttcacggcgacggggtgaccattccactcggctgcatggggtttgagggtgtgggagggcatgagttgactgggtggaaccaggcatgtgagtttctgggcactggcctgcattgtactttgcaagggctggctgggctggcttgcagtttgcgcttgtgagttttcacccnnnnnnnnnnggcatcacaccctgcacgaccctccaagctgcttacttgaagctatccagttcgcgactgctgtgagtccggcacgtcnnnnnnnnnnattgagggtgtgggaggacatgagttgactggttggaaccaagcctgtgagtttctgggcactggcctgcattgtnnnnnnnnnncctctgatgcaccctggcaaagcatttcgatgcgcagtccagggactccatactccacaccatttcttgacagcaacattccatttcccccccacacacaaaaaccaacacaactcaccccnnnnnnnnnntgacagtcgcacatccctgcgggtgtccctcgaaagtcgcacctccagatcnnnnnnnnnnagacaggcgcatgttcctgcaggtgtccctcgaaagtcgcacctccagatcnnnnnnnnnnccccagctccgccaccactgcgccggcgtcgctgggtcccctctccagggcgctgggcacnnnnnnnnnnacacaccatttcttgacagtaatattccatttccccccccaccacacacaaaaaccaacacaactcaccccggtagacgacgccaaaggcgcccgagcccagctggtcatgcagggtgacctgcgtggccaggtcggcagacttgaggcggcccagctccgccaccgccgcgccggcgttgctgggtcccctctccagggcgctgggcacgctgcccgacccgccgctgggctgcaggttgggcagggtcagcgtggcgccgctgttcaccgacagcgcctggctcagcgtcccgtggctggtcagcggcatggctgacccgggcgagtcctgccagccggacccctcgccctgccagggcagagagtcgtgggtgcgggcgaggggtccacggtcgggggcggtgtccttgcgcgcagtgctcgccgcggcggcctcggccgccgccagccgctgcgcccgccgccgcgcgaagaagagccagctgccgccgaccagcgcggacaggcccaggaccacgcccaccaccaggcccaccaccatgccgaggctgacgccgcccttggcgggggccggtgcggcggtgggcggggccggcgcagcctctggaggggcaggggggccattggctgcatagacggtgtctggagcggggggttggtgccagggcaggaatgagggggtgggaggtggccgtggagtgggggcatggggaatgcacccttaatgaggcgcaggccgatgcgctctaattcccggatggcatccagggtcagggtcaccatgcatggattgtgcatgagcctgccctgtgcacggttccctgtcactttggtcactatgtaaactttccccataaaccattcagtgcagacgacgcctcccctccctgtcccctcccccagtccaagcagcacctgtgtctccggtcgactcgatgggcgcggtgggtgtgccggcgatgggcggcgccgcaggcaccgcgccaccattctcggtggcaggcggcagtgcggcgggcgtggacagcacgtagccgcagcagtacaccgcgcggcagccgccctgggccacagtgccgccggaggaaccgtcgtcgtcctgactgcatcccagggtcaagccggggtcgggtaacacccggctgcagtccaagccgtttaggttgacggaattcaccagcaaggagtcgtcggggtagagaccggatggtacaaactggccaacggtgaggaaggcgtaggctccgccacctgggccgggggagggcaggcaatgagttggctcccttccaggacgaggagtgagaatgcaagggagggggagtgatgcagtgcgagggagttccatgatgcacatggcagctttttgtgtgatgcccaaggctgtttgtctaggaatgagcatacacggaccaccttgaaatgccagccccggctgcgacacttggtttgttagtactgaccccaaagcccacctnnnnnnnnnnggttggctcccttccaggacaaggagtgagaatgcaagggaggggaagtgatgcagtgcgagggagttccatgatgtacatggcagcttttgtgtgatgcccaaggctgtttgtccaggaatgagcaaacacggaccaccttggcatgccagccccggctgcgacactatgtttgttagtactgaccccaaagcccacctggagcgatgccgtcggtggtaaaggtatctaccaggcgcacgggcgccccgccgggggagcctgccgtcagggcaatcgccccatcggtggtgctgagcaggacatggctgaaggtgtcatatgtccacaccagctgccagtggctcatggacacctcccggttgttggtgatggataccacggccgagaagttgctgggtgggttgagctccactacattgtagaagatgtcggcctcgcaggtgggcagggttgaggccgaggccaggaggcgacgaggattcggccccgttccccgctcctccaggtaatcgtcctcccagtcggcgttcagacctgcaccagatggatgtaatgtgacatgggtgagcttaacgttcccctcaagcatcttaatgagccaggggttcccccgcgtcagtggcccggcgcgggtgccccccgtacggaggtggttcaggggtggttggggacccctcacctatctcctggctcctgctcgcgactatacagaccgtaagcagagctgcgaagagcagcgagcgccatgacattccgttaactgcgcgaatccgtgggcagcgcggccatgaatccgctaccccttgatgcgcagcggaggatcctcctgtcaccactgctcagtgcattgcaggcaggcgtcgcggtatactgcacatgtaagcaggggagtgcggtgagctggttacggtaggactctgaccttgccgcgatgggtatggtctccgagaaggccgtgggcacatggtgcgactcgccgggaggacacatggtcacgtggggcccaactccattctttctccttgctccacgcaatgcccagcccgatctcaagtccagggatcatgcattgcggggtcgcatggccgtgcatggggtgatgccacaactgggcgcatcaaaaatactccaattaccagatatgtcggccttgtctcggcagatcgtgggctgccctgccgcccaggcctcctcacagctctcgggcctcatatgcccccgtgcgaggttccccaagcccttccagggctccaacaccggccttcagaccaggcggacgggacgaagccatgtgcgtcaacctctgcgcatgcccctggccatgtggaagggcctgggtctgagtttcaccaccgatccggctgagaaagttcgaaagaagtatcaggggtccctggacgccatgaatgccctggagtctggcctgaagtccctcaccgacgagcagctcagggccaagacggaggagttcaagaagcgcctggggcgcggcgagacggtggacgacctgcttgtggaagcctttgcggtgaggactgggggtatggcggtgccgcaagtcatgtgcgggtggtggtgttcccgaattcctgtcagctgaactatgctcagcgtgtgctgattgtgccgatgtgtgtgcgctgtctcggccctcacattacctttcgtggaggtggtgaccactcttccctccccatatccccccttgttcccgccctttcaacccaggtggcaagggaggcgtcgagccgtgtgctgggcctgcgcccctttgacgtccagctgctgggcggcatcctgctgcacaagggcgagatcgccgagatgcggaccggggaggggaagaccctcgtggcggtcctgcccgcctacctcaacgccctagccggtgggatacggggtttgtctatgccagaggagaagatgtatggggaggcaggtatcttgggggtcaaaatcatggctgatgccatgaagttgtgcatggtgtgtgacattcaatcacctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtccacaagttcctgggcctggaggtcggcctggtccaggaggggctggatgtgagtctgaggcgatggcaggagtggtggggtgtgcggattggtgggtcctggggagcagtgggttcctggcagccctggtgtggtgtcgcggtccaatctttgaagccgagagtcgcgggactgtgctgcagcgctgaggtgtctggtcgagctgaaaggggtgccctacagacctccctggcaaggtgccagcctggtttccagaccagctgacattcacccaccctcctcgattccccttccccacggccccgcaggaggcccagcgccgcgcnnnnnnnnnncacagacctccctggcaaggtgcaaggctggtgtccagcccagctgacattcacccaccctcctcgatcccccttcctcacggccccgcaggaggcccagcgccgcgccgcctacctggcggacgtcacctatgtcaccaactctgagctgggcttcgactacctgcgtgacaacctggcgcaggaggccgaatccctggtcctccgtgacttctccttctgcatcatcgatgaggtagactccatcctgatcgacgaggcgcgcacgccgctcatcatctccggccccgcggaccctcccggggacaagtactccaaggcctgccgcctggccgctgcactggtcaagggcgtgcactacaccgtggacgagaagcagcgctctgtcctcctgaccgaggacgggtatgaggcagcggaggacgtgctccaggtgggaggattggaaggaggtgtcaggaggggggagggagtgatcgcgggctggagagacccaggtttcagaaggggagcggtttcctggcgagttgacagtggcgctgtataccagcctggacccaaatttctgcctgctctggtgcataccggctggcatccagccccacaccagacgcccagcgactctttggttcccggcggcctgaccctccactgcctcaagtttatcctcaacaaggacttcccaagcccctgaaacatgcatacaccccacccccccctcccccccacgctcaggtgacagacctctacgacccgcgggagcagtgggcctcctacattatcaacgccatcaaggcaaaggaactcttcttgcgcgacgtctcctacatcgtgcgcggcggcgagatcgtgatcgtggacgagttcacggggcgcactatgccaggccggcgctggtccgacggcctgcaccaggcagtggaggccaaggagggggtggagatccagaaggagagcgtcaccctggcctccatttcttaccaggcaagggcagggaacatgagggggcgggtaggaggagtgtgtgaagtgggttgtttgtgtgtttggctgggaaaggggccgagggctgacggtgtgtttttttggaggtggaggggcgtgcaggggagcagaattccctcgagcaagtgcctccttggcttcaggacagtgccttgcacctgcctcgcatgaccctggcctgacaacagacattttctcaaacacacaccccaacccccccaatgcctgccgcgcagaatttcttccggtcgtacccgaagctggcgggcatgacggggacggccgccacggagggttccgagttcgagtccatctacaagctgcccgtggccgtggtgccgcccaaccgctccgtggcgcgcaccgactactccgacgtcgtcttccgccaggagagcggcaagtggcgggcggtgacgcaggaggtccagcgcatgcacaagaaggggcggcccgtgctggtgggcaccacctcggtggagaagagcgagcacctggcgagtctgctgggcgaacaaggcatcccctaccgcgtgctgaacgccaagccggaaaacgtggagcgcgaggccgagatcgtggcgcagtcggggcgcaggggggcggtgaccatcgccaccaacatggcagggcgtggcactgacatcctgctgggaggcaacgcaggcatgtgccgagggcttgggtttgtagttctcaggggtagggaagatgtaggggtggcatatacatcgcctggcgagccctgctgctgtcggcgggagcaccgctggtgtgtatgcaactgggccggggcaaacggatctcaacagtttggccccctgtttttgccttcctgcaccatcaacctcgtgtcgccaccctgcnnnnnnnnnngctcgagggtggggaagatggaggggtggcatatacattgccgggcgagccctgctgctgtcggcgagagcaccgctggtttgtatgcaactgggctggggcaaacagatcttgacagtttggccccctattttagccttcatgcaccatcaacctcgtgtcgccaccctgcatgcagagttcatggcgcgactgaagctgagggaggtcctgatgccccaggtcgtgagccaggtcgaccttgcaggcacggcacccagcgcccgcagcaaagcaaaggtgaggagttccccgtgctgttcccagagtcctgcctcttggaccccgggagttgggtcatctgtgtcttgctnnnnnnnnnnacccgtgctgttcccagagtcctgtctcttgtcccccgggagttgggtcatctgtgtcttgctgtgtggcatgctggtgactttggagagggtgcatgcttgactccaggtcatctggacccttgcagaccagtgtcatcgggcgcaagccactgacgctctcccttctcgaatctgcctcaaccttccaggtgaagagctnnnnnnnnnnttctggacccttgcagaccagtgtcatagggcgcaagccaccgaccctctcccttctctaatctgcctcaaccttccaggtgaagagctgggcggtgtcgcccgagctctaccccaccaaactgaagccagagaccctggcgctcatcgaaaaggctgtggagtctgctgtggcagcctggggatcccgccaggtcagcaggccgggtcgcaaatccagggtggtgcctgagcgccaggtggcgcctttctgattgtgtgtggccggtgggaagcaggtgcgccattgtggtcctttctccttattcgcagcttgaagcgctggacgcagaggacaggctggcgtatgcctgcgagaaggcacccactgatgaccctgtcctgaatgaggtgtggtgcggagtcctagtgcaggggcagtgcaggtggtggcttgcctagcagtccgtctacccattcccaccccagacgcatgcgctgcgccatccctacccacacccaccccctgccgtgcgtcccgatttgcagctgcgggctgccttcctggcaacagaggcggagttcaaggcggtgacggagctggagaagcaggaagtggtggcccttggggggctgcatgttgtggggactgagcgccatgaatccaggaggatcgacaaccaggtgagcccctgagggcctcgtctgccaggaatctgggcaatccataggttgccattatcccggagcccacttttgccaccgcctcatcacccccccccccccccccccnnnnnnnnnnggcccctgagggcctcgtctgtcgggaatctgggcaatacataggttgccattatcccggagcccactgttgccactgcctcagcacacatcccccccccttctggtgcagcttcgcggtcgcagcgggcggcagggtgaccccggcagcacccgctacttcctgtccnnnnnnnnnngtgcagctgcgcggtcgcagcgggcggcagggcgaccccggcagcacccgctacttcctgtccctggaggacaacctcttccgcatcttcggcggcgacaagtgcgtgatgcactgggttgggtagcggagaggccgaagaatgggtgtggggttgctgcatgcaagctggaagttgtgtgcctgggaggtgaatggttgtatgtaggattgtggagggctgctggagctgcaccagggaggcgctccagcactatcgagccgccccgggctcgcgtgtatgtctgactcgtggtcttcccatcagacagcttgcattacatgaccgaaactcatccaaacgtccgttttctgcgctcgaacaccgcattcttccccaccacgctccaaacatgcacctcagcgcatcatgcaccgtcaggcctccccccaaacctccttatccctcatccctccgtgcaggatccagggcctgatgtcggccttccgcatcgacgacctgcctatcgagtccaagatgctgacgggcgccctggacggcgcccagcgcaaggtggaggcctacttctttgacatccgcaagcagctcttcgagtacgaccaggtgctcaacacacagcgcgaccgggtgtacgcggagcgccgccgcgcgctcctggccaagagcctcacccccgttatgctcgactacgccaggaagaccgtggacgatatcctggaggtgcggatctgtgtgatgaggccgggtgacgctgggtcggggggtttactgctgtggagagggacatggactggacaagggtcaatggagctggcgcctcaccagacatgcatcccaccggccctcaaccccctctnnnnnnnnnngttactgctgtggagagggagatggactggacaagggtcgatggagctggcgcctcaccagtcatgcatcccaccggccctcaaccccctctgctcaaggcaaacgtggatcccagcaccccgcaagatggctggccgctggaggctctggccgccaagatgctgcagtactgccccctcatgaccgatgtcaccgcaggcgagtgttgcttgttgtggtgcacagctcggggaaaggatgcgactcttatcagtatcagctgccgaatgttctgttgggtatatggatggccctatggcgttcgggggctcaaaattatgcaggcaaaccgtcaatttcccggaaacattcctgtcagccgctgctgttggtcctcgctcagcgatggactgctcactgagctgcaaaatcctgtgttcggagcaaacttctcagccggcgccctttcttacctccccttcgacgcacagagacgctgaagcggacggcagaggagggcggcttcgaggggcttcgcaccctgctgcgggccaagggggaggcgacctaccacatcaaggctgagcagatcgaggcacaggagccggggctgatgcagcaggcgcagcgcttcttcctcctcttgcagatcgacaacctgtggaaggagcacctgcaggccatcaaatttctgcagcaggcggtctccctgcgtggctatgcccaggtgtgtgtgtgtttgaatgtgtgttttcgcggaagggggggaggggggggatggggtaattgggttaggttaggttgcaatgcgagcatcagcttgttgcgagggcataccacccatgttcctctgcaccctgcagcgagaccctctggtggagtacaagctggaagcgtatcgcctgtacgtggaactgatggcccagatccggcgaaatgtgatttacaatgtacgtctgttgtggtggagggcaggctgggctggggttgatcgttgccgataggcgtcttgttgctactctgcaatgcatggctcgtcatgttgtgctcgctctgctgctcttcacaatgtaaacctccgcacccggcccacctttaacacccttgtgtcttgcaggtctatatgttcagccccaagaagcaggcgccctctgaagcgaagccagctgcggaggagagcaagcctaagaccctggcaacagctggctcaggaagcggctcggggactcgtgggaagcgcggaaagcgatgagctactctatgggggggattccctttcccacgtctgcacgcccccagcctgccggcttcatgtacatcagtgcagtgtgagggtctgcattgcatcgcaaggatatgggtgtccgcccgctggcagttcaagcgatgggggtttggcagggtacatggcaacaaaaggtcagacatgaagatatatgtcatgatgtagggaaggagcaggaacatagagtcaatgccaccagcagtcgaaagtagagggtgtcaaggtaggtgcaatgtacagttgctgagcgctcctgggggttggggtgggcggcgtccggcctggtgaaattccatggtcagtcgtcgtcgccagaggctccagcgccgctgtacagtacctggtctcgcttctggcgcatcgttcgcctctgggcctgctgcctcccatcgctcctcagaagctggaccaggtcgtcctgaggcagttgggtgttggttgaaaagacatggtgatatacaatggaatgaaaggtgcaacaggtggtcattcacagcagcagagagcgccctgcacaatctgcaattgtgcggcgcaactgtcatggcactttctgagtgcgcaatggctcaaaggtacatcagcgtcacccgtctccctgtacaaaccagcacccaatcaccctcctcacctgggtgatgttgagcagccacgacacgtcctgctcgtagtccgagtggtcaaagttggtgatgccacccttgaccccggtggcatggtgcagctcgcaccacagcatcatcttgtcgtaggcgcgcgccgcctcctcctccgcgtcgaagcagccgagcgaggtgggcttgccgttgcgccggaactgggcctcccatcgcttggtggggaaggtctggtgcaccccccggaacttgctggtgtaggtccgcccgttgctgttccccttggccttgtggtgcttggacgtcttgcccagctgtgtaagtttgggagggaagacagggtgaagaggaagtcggccacgaaggactccagttctggaagtttccattccgtcccgcaggtgggccagtgacacactccatcagccctcggtgagtttgagagggcatgggtggcgagacgagaccttcacataagcttggaccacactcactcccgaaactccaagctatgagtctttaagcctgcaatgcaccctcccccagcatggaacatggcccacgcgctcaccatgccactgacctggcgggggannnnnnnnnncttaagcctgcaaggcaccctcccccagcatggcacatggcccacacgctcaccatgccactgacctggcgggggagggaggtggtgggccgctcgatggcatcattgctgtgcagcgtcgaaggagagtgcaccagcggcagctgggtcgtgggcacaaaggttgagggctgcatggcgctgccgccgtacgcggagaggagctccaactcacgccgccgccgcaggtcctgccacccatataccgcttgcagcgaggcagaagatggcttgacacgactgtagattgccgggagcgcctccgggaactgggccagggctcggacgcgcgcctatggtgaggtgggcgacgggnnnnnnnnnncaccgcttgcagcgaggcagaagatggcttggcacgactgtagattgccgggagctcctccgggaactgggccagggctcgaacgcgcgcctatggtgaggtgggcgacgggctaaacactcccgaccagcacggcacatcccagactgacgcctgtggccgcaatcccacgggacggcaggacacctaccatgagttccgccgtgtcgaaacgggacacgttgtgctccgcatccccgctgggcctgcccctgcaaggaagggtggtaaaggcgtgtcgaggcgggagcgcattgtatggggcagatgaatcatgcggtacgcacgttgggctcgtctcggacttcaggaattgttctatcgctgctgccatgcttgctcccgccgtctccggcaccccgcgcggtctttcactcctcccagcaaggccgggatctcctggttccagggacggaactccccaccgtggggcccccgaagctgccagtctctcttcgaggaatgggtggccttgctcgtgcagtgggtgcccccatcaatgccgctgcgtttgtattctcgggcgctccgcaaagtggcagatgcagacagatccccggggtcacggggagcttgccccgtcgggccaatacctccttacagaaagccaacatcgcggttcagaccacgggtgaaaaggagcacgcagtgcggaatcatgggtgcgggggtgctccagccctgcccagcccaagccgatttcgacttgggcggcagtgggtgcaatgtgccaccccccgcctcagacctgggacctcactccggtggccgctgcgtcgttcttcacgctcctcgcggtgtggccctggccccggaagcaggagtagaccagtttcaggacccagaaggaccagaggaactcgacggcccagagcgccgcgccgatgaagtacatgacgcccacgcccgtgttgtcgctgatgacgttgatggcctcccagaacccggtgtggctgctggagttcaggatgggcggggctgcgggcggagcagggcagtgatacttggaggtcagcggaacatagcaggggtggggggatggcagatgcaaaaatgtcctggtctctggccattcagagttttccagacaccatctggggcacgcccgacaaccgcgcctctgccggtcctcttcacgcccatgccctccccttccctcccctccctgcatcgtaccgacgacgctccagcccacgaagatgaggtgagccatgtacatggcgaagaaaaggccgtactggaaggcgctatccttgatggcggcgctgtacacgcggcggtaccagaggaaccaggccagcggcacgccgcccagcatgtagagcccgccccagaggaaggcggcgatgccgccgccgtccacaccgatcaggtaggcggccgtgcccacaaagttgaagaagaggcacagcaccaggccctgggaggttgggcgagggggtccgggggaggcgtgaagggggtgccaagatccgagtgggagctgggatgatctcccgattttgaatcgcgcaatcagcgaatgccagatgatggtgnnnnnnnnnngttgggggaggtgtaaagggggtgccaagatccgagggtgagctgggatgatctcgcgattttgaaccgcgcaatcagcgaatgccagatgatggtgatgaaggaaggaaatcgtggtttgcaccgagggtgatcaccactctaccagttgcctgactctcaatccagaaccgtgcacccagtgcgccagcctaggcaatggcggcacgccgccggccactcaccaggtatgcccagtaggcagaccggaccatgccctggaggggctgcgggatctcggcccggatgtcgtggtaggtgaaggcgcagtatggcggccagttcttcaggctgccggcgccgccggccctcagctcctgctccaaccgacgcagctccgcctcgcgacggttcaggtcagcttcccgcttgtccaggttcttctcggtcttctgcggcaggaaaggagttgtggatggggtgggaagactggtgaagcaaggagcaggcactttgggctggaagaggataggacttgccaattggcaggtcgccgctgctgccgctcatcgggtcaccgggcagtgccggggcaggaccacattgccctgacgacgtaatgggacaagccagctcctcaccgtgttcttgaccccaggggcagcaggcacggtgtcgttcagcattggagcaggggcagcgaacgcactggtcgtgacatcctcagcccaggctggggtggcagcgggtgccccggtgccccatgccccagcgctgctctctgtcgcccagggacctgtgccaagggcaagggcgcaatcaattgagcattgtgtccgcgtatctctcctaccgccccacaactccctgcgtggcacgatgagccaggcccgcacccaccagcagatgcggcctgcgatccgttggtctgcgggcaccgcgagggagaggggaatgtcgatacttcgaaaccaaatgcacctagaccgtgatatcaatgcgagcaggtacgagttcccccctgcttccgacatacggaatccgcgcacgctcagtgctgcacagactttgtagaaccccagcgtcaacactgtgccgacctggttgcgaccaaaggggttgtcattgaaagggttgtccgtcataatgtttgatgatcacaacacgagctcagtcagggtacaacgcgctgtcctccaagtatggggtggcgagcaacgactcgtcgttggcgagagggtctctccctctgctgctgctcaagggcgagaaccggacacggagggcggatcttcccctggatctcagcacacccaaggagggggcagaggggtccaagaagcgactcttaaacagggcgaagtcagatttggccgaggtgcccttnnnnnnnnnnttagcagcggctcttaaacaaggcgaagtcagatttggccgaggtgcccttcccgccatggcgctttctccatcttgaaattctgcgggtggcagctatttggagtggctgacccccacccctgtaccccgcgccaatccccgatggtgtggcagcattcacctctgcacgctgccccatatccttggtccgttttgcacaccaggcgcgtggaccctggccggtcactccctgcccatcttggcatgttgttttgacttgaatcgagtccgacacctcgcgggggcccatgggccaggcgaaccttgccaaatccccctggatcgagtcctaccgcatcgatctgccgggatgccgggggagccgaacgaccgtgctggactttgtggcctcgccagggacaccccgcgatctccctgcccaggcccaggccgcggaggtccgtgagctggccgccaggaagcaggcacgcagagatgctaccaaggcattatatgctcgggtggatgtgccccgcgcgaccctggcctctgggggcagcattcccctggtgggcctgggcacctggaaggcggagaggggccaggtgcggtccgccgtgcacgccgctctgaaggccgggtaccgccacatcgactgcgcctcagtgtatcagaacgaggaggaggtgggggaggccctgcaggccgcactgggcagcggcgccattcctcgggaggagctgttcatctgctccaagctctggtgagtcgggagggttgggattacaggcactggtgtgagcatgcgaatggagccgagttgcatcctggggcctgcttcgagaagcgagaagaggactgcgcaccagaagaccttcggatggggagtgtcctcaccccgcatgcctccggttttgaggagcaaggcaggcccggcactcccaatgtcatgcacagtagcggccggcagttttacccccctctatgcaatcccaacgcacaggaactcagaccatgccgtnnnnnnnnnnacttcgaggagcgaggcaaggactgcgcaccagaagaccctcgcatggggagtgtcctcaccccgcctgcctgcggttttgaggagcaaggcaggctcggcactcccgatgtcatgcacagtagcggccgacagttttaccccctctatgcaaccccaacgcacaggaactcagaccatgccgtggagcgcgtgagggctgcctgcgtcaagtccctggcggcgctgcgcctgacctacctcgacctctacctcatccactggcccgtcactggcatccccggccccgccctgaccccctccttgcgagacacctgggacgccatggaggggctggtgcgggaggggctagtgcgtgccatcggcatgtccaacttctctgcccggaagatggaggaggtgatgcagcacgccaccatccagccggccgtgtgccaggttggtgaatgatgcggcaggcagttggtcgggaggcggctcggatagggcccgctccagctgttccggcccccatgcatggacagcaagcgcaatctcctcttctctagagtccacagcacccggtcttccagttctgtcacggatgctctactcaggccctgcagctccccctccttcctcccctctataccactcctcacacctcacacacacacacagatcgaggcgcacccctactggcgaaacgacgccctgctgggctggtgtcgggagnnnnnnnnnntagctgttccgggcccaatgcatggacagcaagcgcaatctccccctctttagagtccacagcacccggtcttccagttcnnnnnnnnnntttttttttgggggggggtccagcgtggtgcacgggagctcctccccatggctcagatgcaatcgcgacatcattaaaggcccagcatgggatgccctggcagttcgagctcgnnnnnnnnnncccccccccttcctcccctctataccactcctcgcaccttacaaacacagatcgaggcgcacccctactggcggaacgacgccctgctgggctggtgtcgggagaggggcatccatgtcacggcgttttccccgctgggctcccccgactcggcctccatcttcccccgcaagctcccgctggacctgctgcgggacgagcgggtgctggcagtcgccgcggcgtgcggcaagaacgcgggccaggtgctgatccgctgggcgctgcagcatggcaccagcgtcatccccaagagcacctcacccgcgcgcatcgcaggcaacctacaggtgtgcagttgctggcgtctggatttcagggggggggttccagcgtagtgcacgggagctcctcccgatggctcagatgcaatcgcgacatcattacaggccaagcatgggatgccctggcagttcgagctcgccacacgggcaccatgcggcgtgacggcctttgctcatgcgtctcccacccagcctctcctcccgcaaccatgactgcattgcaggtcttggactgggagctgaccgaggaggacatggccgcgctgagcacgctgcccgtgcagcagcgcatggtcaacggcgccacctggctccaccccaggggtccctacaggtgcgctttgggatttgtcgagtggaggagtttctgggcgtcgcgcacttcgtctctcacgcgagtgttaacagctccgaccttgtcaatgccattatcgggagaacatgcttgatttgctcatcaatcttcaagctgaaccccttctccggcccggcaggacgatggaggagctgnnnnnnnnnnaccctacaggtgcgctttgggggttggcgagtgaaggagtttctgggcgtcgcgcgcttcgtccctcacgcgagtgttaacatctccgaccttgtcaatgccattatcgggaggaaatgcttgatttgctcatcaatcttcaagccgaccccctcctccggcccggcaggacgatggaggagctgtgggacgagccggagggcggcgcggctcccagcggggagcagggtcccagcagagcgcggagcgagggactgcgcagcggcgctgggccagcacaacctccccacgcctcgccggcccccgacgcattggccgggagcccgccgcacgccttcacgggcaccttcccgccgctggcgcgccaggcgtatgccatgctttccagcggcgcgcgcatgccgctgctgggcctgggcacgtggaaggcgccgcccggccaggtggcggcggcggtgcaggcggcggtgcgcctgggctaccgccacctggactgcgcggaggtgtaccgcaacgaggccgaggtgggcgcggcccttgccgcgctgttcgaggccggcgtggtgcggcgcgaggacctgttcatcacgggcaagctgtggaacacgtcgcacgcggccgccgccgtggagcgcgcggcccggcgcacgctgcgtgcgctgcgcctcgactacctcgacctgtacctgatgcactggccggtgacggggacgaaaggcccgcgcctgacgccccccaccgccgagacctggggcgccatggaggggctggtgcacgcgggtctggcgcgctccatcggcgtggccaacttctccgtccggaagctggaggagctggcggcgggcgccaccatcccgccggcggtgtgccaggtggaggcgcacccctacttccgcaacgagcgcctgctggcgcactgccgcgccgcgggcatccatctcaccgcctactccccgctggggtccccggacagcgcggcggagctggggcgcgcccccagcgcgcgcctgctggacgaccccgtgctggcggaggtggcgggcgaggcggggcggacccccgcgcaggtggcgctgcgctgggcgctgcagcgcgggacctccttcctgcccaagagcaccaacgaggaccgcatcaaggtagtgtgatgggggggttgaggatgactttgaaaggaggagagtagtgtttctcggcactgtgatgacaatcataggcagtgccaaaggggccgtgcgcctcggcaggttgacgggaggggaccaggcgaggggttgcctggaagactgtaagtgtagcggcgcatgtgccacaggtctctctgatttgatcactgctcatcatccattttctcacaaccttcccgccttcccttccttgcagcannnnnnnnnnggggggggttgaggatgactttgagaggaggagagtagtgtttcccggcactttgatgacactcataggcagtgccaagggggccgtgcgcctcggcaggttgatggtaggggaccaggcgaggggggttgcctggaagactgtgagtgtagcggcgcatgtgccacaggtctctctgattcgatcactgctcatcagccactttctcgcaaccttcccgccttcccttccttgcagcaaaatgcggacgtctgggactgggagttgtcggaggaagccatggcaaagctgaatggcatcgcccaccagcagcgcatggtggacggctccttctggctgagcgaggagggaccgtacaagaccttgtcggacctctgggacgagccctgaggccggcaggccgacgctccaatgagctgaggggccctggcactctgccgctggggtccctcgtgtcgagtgaatggcccggccccctctgtcccctagctttgctctgctctgcttgctgcttggcacacacgcttgcgcagggaactcagccccctccccctgaatttgcccctgggagggaccttgttgacaggaagacacacagaggttcnnnnnnnnnntacgcttgcgcagggaactcagccccgtccccctgaatttgccctgggaggggccttgttgacaggaagacacacagaggttcacgacgagggtctgccttggttgccaacgggcaggatgtatgacatcatgccagcatgcatgtccatacgaggtgcactgcctctatctcacagcttcagggcaggaaatggcgtttcctatttgctcccaacatggcagcatgtcgctgcaacctcagtgcgaccccatccaactcaagcccctgcagggccggacaaggcccgctagacggccctcgtctcggcctccagcgccgctgcgtctcgccggagccaccacgacaccaggccggaatcgaacacggtctggatgaggtgtgccgccacgcaggcgatggcggcgtaggccgcccctgggcccaggccctcgcccagctggcctatgacagcaatggcgatgggcagcgtcttctggctgctgcacaggatgaccgcgcgccgtatgccgcgatctgcagaggtgacagtggaggaggggggccgcggtgggggttcacttccgcctccgccaccagccatacttggagaaccttgtccacccatgcatgggcagggtggcaccggcactccgagcccagtctcctccaccccaatccctcatgcagcagcacctgccacggcgctgatcgtggagannnnnnnnnngcttggagaacctcgtccacccatgcatgggcagggtggcacctgcactccaagcccagtattctccgccacaattccccatgcaacagcacctgccacggcgctgatcgtggagaagcggatggggctggtgagggcgacgttcgtggccaggaacacgaggtggatgcccaggcccgtggcggcggcgctggccagcgtgccgggtcccagtggcagccgccccgccgccgcgcggctgatctgcatccaggggatgaaggccagcaggcccgcgctgaggtaggacagctggcgccggcgcgcggcgcgccaggcgggcacgccgggcacggccagctgcaccgccacgcccgccagcagcggcgccaccaccgtgcgggccaggcccagacagatggccagcggggagaaggaggccgcgcccgcggcggagcccaggacccagcgcaggaggagtggtacgctgagcacgctgagcaggttgctggacacagtcagcatcagggccacggccgcgttcccgcgcacagcctgtgggtgccgagcggggagagggctgggcgcgcggccgagtgttgagcctcgcaagacgaccttaccgcctgggcaggcagccggcgcctggatggccaggcgcgcacacacacatcagcaggggtgtttgggatggggcatgccagagccggcgcccatgatccatgccaaggagtacgcgccatggcttggacagtactgggggctctctatgactcccatttcccatcctccctctcccactcatccccacctgcgtcaggaccacgcccgtggacagggtggtgggcatgcagcagaagatggcgaagccgatggccagctcgggcggcgcnnnnnnnnnncttcccatcctccctctccaactcatccccacctgcgtcaggaccacacccgtggagagggtggtgggcatgcagcagaagacggcgaagccgatggccagctcgggcggcgccagggggaggcggaggacgaggggcgccagggcggaggtcagccccagcaccgccgtcaggccgtaggccagggccgcgggacagcgcagcgcgtcgcccacctcccccgagttcagtagcaggccggaaaggaaaaacatgcccgcggtggagagcggggccaggttcctacccgccgcggcggcaccataggctgggaagtgccacctgggaggggtaagggtcagaggaggaggggaggggtctgagcgtgagtggaggactggaatgcgtggagcgcgcaaccccctgcagcgcctggatctgcaggatctggaccctgctctaccctgagcgcacccgatcaagagggcagaaatgagggccaggggggtgacgttggagtttatgaaatcaagaccgccctgagccttgggcactgccgcgagggcgggtgcccgccgcctgggagcaacactccttcccaatggggacctagaggcaggcaccagcaccagttttcgccgtccagcgcgcggggcagtggagcttctagaatcatgtacgacagatgatctaatgaagaacttgtggttctgcgatctccatgttccccatgggctgcatggcacgagtggggcactttggctgtgcaccagctgcgcagccatattccctcccgcaccacggcaggggtctgtcagttctcagtcaaaatcttccaaatttacatgttggggtggatgctgtttccagtttttgcatcgtcccagtggatacctttggggatgcaactgtcgtgcttgnnnnnnnnnntttccctcccgcaccacggcaggggtctgtcggttctcggtcaaaatcttccaagtttacatgttggggtggatgctgtttccaatccttgcatcgtcccagtgaatacctttggggatgcaactgtcgtgcttgcgcccaaactccgaatccaggagatctgctcagggacggagcaccaccgataagggggggcccggagtatcccgagaccaagcgcttgaagtcgtaattactcgatattttacctgttacgaggcactcaatcgatacatcagccatcatgtccacactgatggccacaaatgccttcaaggctgccctctccccaaagatgtccacgcgcgggggtcgcagggggatgtcggtccgtgccaacgcccgagtagaccgcttcagcaaatcggatattatggtgagattcgggctcgcatgctcccagtgcatacgcgtgccctgctgctcccctccgctcggtgacgtagggcgggccctggtcggaagccagtatactgagggctccaaggctccgcccgactgctgcaggtggctccctccatcctgagcgcggatttcagtcgcctgggtgaacaggtgcgtcgctcgcaagggttatcatagagtggatcagcagccctgacccatgctccatggagtcgacttgcaggtggtgtgcccaggtcaggtccagcatgctcagaccctctccttcaccgctgcccgccaggtcannnnnnnnnntgtgtgcccaggtcaactccagcatgctcagccccctctccttcaccgctgcccgccaggtcaaggccgtggacgaggcaggcgccgactggatccacgtcgacgtcatggacggccgctttgtgcccaacatcaccattgggcccctggtggtggatgccctgcgcaacatccccgacaagcctctggacacccacctggtgcgtaaggatgggattcggcggaggatttcccgagagggtgtgtgcgtgtggatggcacgcctgcacctggctgctggcagagaggggtatcagatgtgcgagcgccctttccagcccttgacggcatcctgatcgtcccacatgctgagtcagcctcctcatcgtgcccttcccctcccttgcaccatggtgcagatgattgtggagccagagctgcgtgtggctgactttgccaaggccggctccgacatcatctcggtgcatgccgagcagtcctccaccatccacctgcaccgcgccatcaaccaggcaaggtccttgagggagatgggtgatcacgacaggctgtctgatgcatcttgttgcgagggtttctcatcggtctggggctgtgggcagccctgccaggctgggctggcccctcccacctgccctgccagccctcaggttccccctttccattccctgcggcgcgcagatcaaggagctggggtgcaaggcgggcgtggtgctgaaccctgggacgtccctggacaccatcgagtatgtgctggacatcgtcgacttggtgctggtcatgagcgtcaaccctggcttcgggggccagaagttcattgcgtcccaggtgggatgttgttgtcgggcatctgggggggggccccttgttggttggaagactgcaagagcgaggggaggccttggtctcagagcaggggaggagtggtttgaagcatgtgtgggggggtggggcagccagttccggcagcactccccaccttggagctcttcgggccctggtgggagcgtgcagactcgtgctacgcatgcagtacgtccccactcgactgcctcatctgattgctatccttctgcccgtgcacccttgaccacccaggtccggaagatcaaggcgctgaaagccatgtgcgatgagcggggcgtcaacccctggatcgaggtggatggcggcatcgtgccggacaacgcctgggaggtgatcgaggttggggccaacgcactcgtctccggcagcggcgtgttcaaggcccctgactacgccaagggtgagtctcggggactgttcaggagaggggtggcgtgcgtggcagcgtggggccgctgtgttctttgtgcggggttgggagggctgccacgcagtgcatcaggggcgggatgcgtatggcgggtgcttggcaccagatcaatatgagtacagggatgattcgccctcccccaaacaacccacactgcgcagcgattgccgggatcaaggctagcaagagggctggacagaaggagctggcccatgcctgatcccaaactgaatcggctgcatccctttgtcgagcctgcgcagccggcgcctgcgcccgcttgggccggcgcaggtcccctggcgaggctcgccgctgcactgtcgtgtcaggcctcaatttttttcgtcataccatgttatgagatgaatataccccaaatgtgaccggactgtggcctctccatcctacacaacnnnnnnnnnngacggggcagcgacctgcaggcgcgagtattctgccaaggccttctctccgcttgcatggaggtctgatattattcaatacacaaatcacattatattgtagctagaagtgcccaagggagcacagcttcgcctagtccctgcacctgcaccgactgcgacaagcgcggtggtccactccgagtnnnnnnnnnncaggtcgacctgacgcaggggcagtgcatggccgaggtccatcatgggggccggacaggaataggctgggagggcaatacacagtcactcgaatgagagtggaggtgcgacgccacccctcctgctctttttctgggtcagaggtgcccttcccacccaacctgcccctgccagccccttgctgcgtacgtggcctnnnnnnnnnnnnnnnnnnnnnnnnnnnnnnnnnnnnnnnnaccagagcgcgccagcagtgcggttaataacaatgtgccggatgcagtgaatatataggcgctcaatttgnnnnnnnnnncccagagcgcgccagcagtgcggttgacaagaatgtgccagatgcagtgaatatataggcgctcaatttggcatgtcgctcagattcgctgccccagacggcgtcaaggtaggctgcactgtgtctgcatggcgccccctgcgctgcacaccggagccagcaatcgagcgtgaattgctcccgtccaccccacaggtctacacggtagccggtgggaaaaacctacccacatgggtgtcggacaagaagaagcgatccctccgcaaagatgaagactacaaccggaggtgagtcgagttgtgttgtgggcggtgcaatcctcatgtcgagcacctgctgctgttatattgtttcatgcagagtgatcttcaagcgcagcatgtatatctggcatccatggcttgaaggcgagctgtcaggggagccccatgccaatgcaatctgctgaggcctcaagcagctgtcacccatcaagcccgcccacctcacccattgcagggtggnnnnnnnnnnatgatattgtttcgtgcagagtgatgttcaagcgcagcatgtatatctggcatccatggcttaaggcgagctgtcagtggagcccccatgccaatgcaatctgctgaggcctctagcagctgtcacccatcgagcccgcccacctcacccattgcagggtggagctggtgcaagactttgaattcccggccgcctgccagcgcatcaaggtctctgcggaccagcagtacatctttgccagcggctaccacccgccaagggtgggtggatgggcaatcgaagggggagtatggcacctgtgcgatccaaagttggttctgccgcccgttcccatcaccgccttccctccaattccagnnnnnnnnnntgaagggggagtatggctgctgtgcgattcaaagttggttctgccgctcattcccatcaccgccttccctccaattccaggtacgagtgtacgatgtcaaccagctgtccctaaagtttgagcgtcacctgaatgcggagatcgtggacttccagatcctgtccgaggactacagcaaggcggtgtttctgtgcgacgaccgctgcctggacttccacgccaagtttggcagctaccacaagacgcgcgtgccgcgcgccggccgctgcctcacctattcccaccccaccgcggagctgttcgtggcggggtcggcacccgagatctggcgcctcagcctggaggaggggcgcttcatggcgcccatgcccgccgccagccccggggtcaatgcgctgggcctgtcccccgcgcatggcctgctggccgccgcgggggaggagggcctgctggagtgctacgacccacgggtcagggccagcgtgggctcgctggaggcggcgcgcgcggtgggggccgacggacagggcctgacagcgctgcgcttcgacgactcgggcatgcacgtcgccgtgggcaccagcggcggcctggtcgccgtgtttgacctcaggtcacaggtgagggggtgggagacgggaggtgggcggcctgggggggtgagcggggggcccgggagttccaccacctgnnnnnnnnnncgacctcaggtcacaggtgaggggatgggagacggggggtgggcggcctgggggccagagcggggggcccgggagttccaccacctgatgccatgctccaaaacatgccttggcctggccagagaacgggtgatctcaggaccttttccagtgtatctatctgcgcatgctgcccgttgcttcccatcgctgagtggctggtcttgattagtcgaccaacccccgttcaaaccgcgcatcccgatctcatcccccnnnnnnnnnncgcttcccatcgctgagtagctggtcttgattggttgaccaaccccccttcaaaccgcgcatcccgatctcatccccctcatccccctttcttgctcgccccagcggcccatggtagtcaaggaccaccagtatgagtcgcccatcctggacatcaagtggccgaccaccgccgccgggcggtcgcgcgcgctcgtggcctccgccgaccggcacatcatcaagttctgggacgcgggcagcggcgaggggttcaccaacatcgagcccaaggacggggacatcaacgacatctgcctctggcccggctcggggctggtcatggccggctgcgacacgccccgcatccaggcaagcgattttacatttggaggggatgcttaggtgcggagaccccagggtgggtcgccggaggacttggttggggccgggcggccgcccaatgctgccttacttgctgttgcctggcgcaaatcgtgctgcacatcggcgcatgggtcgggttgagaatgtgtcaggcgccacccctggtctggatgacgtgcgttttgtcaactccatccatgcctattggacgacaccgcaggcttacttcatcccggcgctcgggcctgcacccaagtggagctccttcctggagtccatgacggaggagctggaggaaaggacggcgccggcggtgtacgacgactaccgcttcatcactcgtgccgagctggtgggagggggatttcaggggtggatggcaccgttccctgggatgttggacgccctctggcttgcaactggtcgtggggtgggcacatccaccaggagccaggagcagagttgctgcgctcccacgtgtccccctccttggtgctctactgacctctgcccccccggcctaccctcctcaatctgcaggactcgctggggctggccaacctcgtgggcaccaacatgctcaagccctacatgcacggattcttccttgacaacaggtcggactgggagggtgtgaggcgtcgtctgctctgtgccgtccatggttacgcctgcctgtccaggagcagggtggcaagtcgacctgactaaaacccgaagccatgcaggttgtacaacaaggccaagaatgcggtggatcccttcgcctacgaagcctatcgggcgaagcgggtcgcccagaagctggaggaggagcgaaaaagccggatctccatcatcaagaagctgcccaaggtgtgtgtgagggagaatgggggttgaggggtgctcttaactgctgctgcttgaggcacagtggcccaggcagcgctgccccggcggnnnnnnnnnntaagaagctgcccaaggtgtgtgtgagggaggagggggggtgagggatgcccttaactgctgctgtgtgaggaacagtggcccaggcagcgctgccccggcggcctgcaaccacctcatccagtgacgcgccgccgcaccgtcctcgaggtgaaccaccgagcttgagcgtcgttgtgccaaattcccactcccacacccctgacatccctcgcacgcccaggtcaacgccaccaccgctgctcgtctgctgggcgaggagggcgaggatggtcccaagaagcgcaaggccgccctgcccaacctcctggaggacacccgcttcaaggccatgtttgaggacaccgagttcaccatcgacgaggcctcacgagactacaagctgctgcaccccaacgccggtgcgagcctcaatgggctggaggcgctgaggggggttctggcccgtctgtgggacctgagcaggggagtggggacggggggaaagcatcccatccacctcttcagccctctctgccctcgacgtcctcacccttgccctcccgccgccaccccagacccggccaaggagaggcggctggtcagggagnnnnnnnnnncagggggaagcatcccgtcgacctgttcaaccctcgctgcccccgacgtcctcacccttgctctcccgccgccaccccagatccggccaaggagaggcggctggtcagggagcactttgaggcggtggagggtgacggcgatgcccagtcggcatcggacactgagagccaggacgacgaccaggctcgcgaccggaagccggccgcccggcacagggtgggtggtgtattttgaggtggggagaccctcgatgaatgggcttacggccatacattctaccccatgccctgttgcttnnnnnnnnnnagagggccaggacgacgaccagactcgcgcccggaagccggccgcccggcacagggtgagtggtgtattctgaggtggggaggatctcaatgcatgactcatgaccatacattctaccccatgccctgttgcttgtgcttcaatggagcagcagtccgcgtgccctccctgctcttcctctctcctgaccacctcccgacgctcaaacaaacgccgcaggacaagcggcagcaccgcgaagcagagccggcagcgctggcaggcgcgcctcggatgtacgaagcgcgcgacgcggcggcggcggcggcgttccgcgccgggcggtccctggtgnnnnnnnnnngagcggcagcgccgcgaagcggagccggcagcgccggcgggcgcgccgcggctgtacgaggcccgcgacgcggccgcagcagcggcgttccgcgccgggcggtccctggtgcgggagcaggcgcagccgctgggggagaggctggccgcgggggcggggggcacgggcaacgcccgccagcgctcgacggggaacaaggagctggccttccggccgcgcatggcgcccgacggcgtcgactggggcggcggcggag

SEQ ID NO: 35981 - DNA, 136 bp, Chlorella protothecoides
tcaatattgaatcgtgaagcgagcaaacaccacgtgcggatcttgcggccttctatagaacctgattgcgtatgcttgtttcaagtcaaaatcattacagcagagctcgcaacattgcacctagccaggacgtaag

SEQ ID NO: 35982 - DNA, 61 bp, Chlorella protothecoides
acggagcaggaggagcagcgctggacggaggaggagatgtggtggcacgtgccactgccgg

SEQ ID NO: 35983 - DNA, 75 bp, Chlorella protothecoides
cagtaccacattgtgaggaagaaggaggaagaaggggggaggggtgggggggaggtactttggtgcagaaagaat

SEQ ID NO: 35984 - DNA, 12071 bp, Chlorella protothecoides
  modified_base (371)..(380): a, c, t, g, unknown or other
  modified_base (1379)..(1388): a, c, t, g, unknown or other
  modified_base (2090)..(2099): a, c, t, g, unknown or other
  modified_base (2955)..(2964): a, c, t, g, unknown or other
  modified_base (3557)..(3566): a, c, t, g, unknown or other
  modified_base (3992)..(4001): a, c, t, g, unknown or other
  modified_base (4699)..(4708): a, c, t, g, unknown or other
  modified_base (5191)..(5200): a, c, t, g, unknown or other
  modified_base (5768)..(5777): a, c, t, g, unknown or other
  modified_base (9585)..(9594): a, c, t, g, unknown or other
  modified_base (10861)..(10870): a, c, t, g, unknown or other
  modified_base (10924)..(10933): a, c, t, g, unknown or other
  modified_base (11062)..(11071): a, c, t, g, unknown or other
  modified_base (11705)..(11714): a, c, t, g, unknown or other
cgcgccccccctggcgcgccggcgggcggcgccgcgcccgaccggccggccacaggcagcgccacgcagcgccgcggcgcggtgcactggaattgcgagcgcgcggtggacccgcgcacgggccaggcggtggtgggtcccatggcccctggctccttctgcagccagtgcggcgcgctgagcaccccggtctggcgcgcggggccctttggccacaagacgctgtgcaacgcctgcggcgtgcgctggatgaaggtggccaagaaggagtatgccaaggtggtggcgtgacggcggccgcgcatcggcgcccccgctcagcccatttttacgcacacctctccccctgccctgctgcctgcctgccgacnnnnnnnnnncgccaaggtggtggcgtgacggcggccgcgctgcggcgcccccgctcggcccatttttacacacacccctccccctgccctgctgcctgcctgccgacgctctctcccagctgctgcgtgccgccccccttccctgcccctgcctggccaggctgtacagcactccctgacgcgcggttgccagggtttcctcgtccaccacgccgtacgggaccagaacacactttccccgacatcgatgttcggatcattcccgcccccaggcccggatcgcccacacatcgatcaaactcggtgggtaccttgccatgctggcacggcgcagcatcgtggcctgggccggtacggggtcccgggccctcaccctcgccaccacccaggtgcctgccgagcagatcgccgcgctgaagaggcagctgagcctgggcctggagtcgtgctcatacgtcgtggagtcttcggtgagggaggggtaacagagtatcagcatggcggtggcatacgcgagacgtggcgacgtgcgattgcccatgccgaaatgacgctcgcaggaacagctcatgctggagacggatccctcggcacgaaatcccagagcctcctacgtgtcgtggtaccagcgattggcactggatcagctcgtcaggggtttggatctgcaccgctccctccagcaccagtacggcgagggcatggtggaagggatcttgagagaaaagggcctgagagtgctcctggcagactgcctcctggcccgggatagactgaacctgaagctgtcacaacctgacaggcttgatctgtaggatcagcggcgagtggcaatgctttaggtttacataagattgactgatttgtgacatgactgagtatcctgcaactgaacatctgggggaaaactgtgttcccactgtacctgtgattgtaccgagccagagatgttgagcgctctgcacagccagcgcccacctcgggcggcttcagtacagccaggggaannnnnnnnnnaagtggcaatgcttcggggtaacataagattgactgatttgttacatgactgagtatcctgcaactgaacatctatgggaaaatcgtgttcccactgtacctgtaattgtaccgagccagagatgttgagcgctttgcacaaccagcgcccccctcgggcggcttcagtacagccaggggaacagggccttgcgcttgctggggtagctggggaagcgtcgcctgtaccacgcctgcgtcatcccagctgcgaggaccaggttcgctgcctgagtgggatgaggacggggaggatgggaggccacacagtcttgatcgcatgtgtgcgtctccactgcaccccggcatgcggctcatacccatgcatgcaccttcttccccgtccatgactcaccacccaggccagaatgagccaggccagggggcgttgcgccccgatgagcagccccaggccggaatagatgacgatctctgccaggtagtgcgggcaggacaccagctcaaagaggccgcctgggtgatagggggtggcacacggtgtgggacgcacttggagggcggggaggcgccggagtaattgctggtgggccacagcccggtgcaccatgagcagaatccagagattgtcaagtagcaacgtcttgtccacctttctactaccctcccagcaccccccaactcaaaaccttgcgtcagtccctnnnnnnnnnngcatcttgtccacctgtctactaccctcccagcaacccccaactcaaaaccttgcgtcagtccctcccacctcgtgggatgcgatatgctccgctttgggtgccccgagaaagggttgccagcagccggtgcgaatggagctgcaacaagttccccgcaacaaaggcgagcacaccctggagtaggggtggggcacgggcataaggctgcagcagtaagtatctcatgcatgcaaccagcgatggatgcaaggcagcttccctgcagcctccaggcatgctcaacatgaatgcggtccctccacctgcccgcctcaccagccactgcagagcactgagcctcgcaagcgtcgccttaagtgcagacgggagggcgcccatcattgctccccttcctaggaggctctccaaacccccgtctgccaacctttggaggagcgatgggggcacaatggtagctgggacgaccaggtagtagctgcggggtggaatgaagggggtcgtcggagtggtcagtgcattgcggctgtcagagggcccgattctgtattgaggaataacccacgcactgcctgcggacccctcacgcatcagactaccgagcgctgaaccctcatccagcctcacctgatcccatataggtatgctatgccgtgcatgcgggcattgggaggatactgcatgatgagcaccgtctcaaggtatcttcgcacaaggtggacttctagcaggcacaatgccagcagggacacctgtgtttgagatggggaaaaggggggcatggcgtggcaattatccggattgaacagttagctcacgatgtttagagaagtaactacatcctcatggccaaggcnnnnnnnnnnacaaggggggcatggcgtgccaattatccgggttgaagagttagctcccggtatgtggagaagtaactacatcctcatggccaaggccctgcaagctctgccatcacacccaacgcaaccttcagctaggtcacaccatggcaccagagtattcacaccagccttagccacgctccacggtacctgggcctcccatgctgcctgcgatgtgccagtccatagttgttgcatcacagcccagatcacaggcacagaccacactgagcctagcgcataaaaatgtgaaaaccacttctgtggcacagtccagtcctgcgcatgacaagaaagacggcggacttgagggaccgggagcgggcactgatcgaacattgctctgcccacccccgtcctgcccctcccctcaccgacagtggaccaaaggccttgtggggcttcatgtctacaagcttcccacggcacgccgacaagattactgctgccctgtgggaagggaggaggtgctacgaattgtgagcacgatgggaaagctctgcgagcctctctacgtcatgcaactgggcggacagcctcgacattcgtgttgcctccannnnnnnnnntagctctgcgggcctctttacgtcatgcaattggacggacagcctcgacattcgtgttgcctccagggatgcatgatggtcggtgtatcgctggctcacctgaagccagcgaggccgggtaggggcagcagcgccagtactgcagccatggtgcacagcacccagtacaagcgcagcaatgagggcagaatcgagaatgcgagcaagaagacaccgtcggcgatcggcatcgcgcggaatgtgtattgggtcgtgccagatcacttggtgcccagtgccaaatacaggcgacttggggatgataaatactgcttgcggccagattcattactggcctattacacccgattgatagtgccaatctcgagtctggcctttcggtttccaaatgtgcgggggggggcgcaaagtcggtgcacgcacagnnnnnnnnnnccgatgataaatactgcttgcggccagattcgttactggactattacacccgattgatagtaccaatctcgagtctggcccttcggtttccaaatgtgcggggggggcgcaaagtctgtgcacgcacagcgcgccatgagcgtcaaggagccaagagaatgtgtatctgagtccgacagtgcccatcatcaaatccaaaatcatgccatagatacctgcgtgtgagtttttgcgttgtagacaggttgcgtgggccggtcgatagagcacttccctcggctgggcgccccctgcggcatcctcacaaggagcccagcaggcatccatgctgaaggagtcgttggaatccctgcccttgttgggccaagagggcgacgtcagctttcgggggggcagcgtgctgggccacaatgatggatcgccccgatcccgcaagggcgtggtgagtttcgcggacacaggctccttccacggcgggcgagctgggctccgcgtgaccgcccgccaggccaatgccgcaaaccgtgcgcggtgaggactgaggattttcggcccgcgcatggcacggcgcccgggagacgccatgccggattagggcaccgggcaaccatggggaatccggggccgggactgcttggggagggcagcacttgtcgcctggaagctgcccgcttcagatcttaagaactgtgcttggnnnnnnnnnnctgaggagggcagcacttgccgcctggaagcttcccgcttcagatcttaagaactgtgcttggaaccgtgactcatgcctccccccccctggacgctgcctctgggtcctgaccctcctaaatctgggtccagactccccccaaccccccccatttcccctcccatgcaataggcggacgggatgggtgtgcatcgacgccgatggcacgcgctccttgctccacgccgacaagcgcgcggtgatccaggacctgtccctgaacatccccatccgggacatgcgcctgctggacttcaacctcttctccagcggcaagattctggtgcgtgacaatgccatcatcttcaccatcgagcacgtgcgcctgatcatcaccgcctccaaggtcatcatcccgcgagagggctacgaacaccaccctctgagcaacaggttggttgttgtgcttttggggggagggggggaggggggttggcgccannnnnnnnnntatcccacgagagggctacgaacaccaccccctgagcaacaggttgattgttgtgctttaggggggagggggggaggggggttggcgccatgggggtcagaccaggctgtagttgttgaccaggtgccattccccttcagtcatcccccccttttcaacccacccacccactcaccgcctctctgtgacacctcccacactcatatccgaaaacccaggtatgtggacctgctggaggaggccatcctggaatggcaccggtaccagcgcgtgactgaggcgcggctgtgccaggaggaggaggagggcggggcggggggcgcgcgcctgtcagaggacgagggttccggcggctggcgccacgactacgacgtgctgcccttcgagatggtggtgctggaggtggcgctgaaggaggtggtgcaggccaccaccacccaggtgcaggagctggagagtgtggccatgcccgcgctggacgcgttgacgcacaagatcaacccggccactctggagcgcgtgcgcaaggtgaagacgcggcaccagcgcctgctcatcaggtgcgagnnnnnnnnnntgcgctggacgcgctgacgcacaagatcaacccggccaccctggagcgcgtgcgcaaggtgaagacacggcaccagcgcctgctcatcaggtgcgagacgctgcgcgacgagatggagcgcttcctgggcgacgacgacgacatgaccaagatgtgcctgacgcggcggcgcgagctggagcaggcctcgccgcggtacgccggccaggacggcggcagcagcggcgggctggggcgcgccgggtcgcacccgttgcaccactcctccagcctcaaccggcgctcgccctttgcgcgcatggccgcgccggccggcggcgcgtggggtagcccgccggcgcgcagcggcagcggcctggcccagggcgagggcggcttcaacgcggcggcccccacgccgcagacctccctcccgcccccgccccccagcgaggaggacctggtggcggacatggaggtggtggagaacctgctggagtcgtactacatgcagatcgatgggctgtacgataaagtcgtgtccctggatgagtacatcaaggtgaggcgttgggggggaatgttggtatgcgtattggtgtgagtgttgggagaggaaaggggggatgttgagcaggccttggtgtgctgggtaatcggcaaggcccatgggacactgccgcagggttcctgggcctgggcttggtcatgagcccatgcacgcaacattcactgggtcagccaggcaggctcgcccaaatcctgccgggctaccaccattccccctgccccctccccactcccccttcttttgttatccaaaggacacggaggagtacatcaacattgagctggacgcgtcgcggaacaagctgatccggctggacatcatcctcaccgccgccgctttctccatcgcgcccttcaacctgctggccggcatcctgggcgagaacctggtcatccccccccagttgacgcgggacgtgctgcgcttctacgtgctcaacggcgtcgccgccctgctctgctgctccttcttctacgccatcctgcgctacatgcggtaccgacgactcatctgaccagggtgtcgtgccagatgccactggtgcttcttttggcagagcaccggggtgcggccgtgcaaagccaagccccggctgtgaacgaggtcggaggtgttgaggcagggccagacagaccacgctcgccgcgctcggcacggcattgcagaccgaactgccagccgacaccacctttcacatgctagtgaacgacatcctccaggtgaaaagcacctgcctcgggtctcctttcttgttgaagaagtccgtgactgctacaaaatggtcaccgccacgcccgagaggcaggcagggtgggcaagggacacgcgaagaatgaacgactcctagacaaaaccggcaggacacaaagggaactgcacatgaggcaacggatggggggccggcagaccgatgtttcgtggcactatcgccgccgccatgggggtcgtgggtgcaccgttgccctcccccccccttcctcacaccctgacatctagtgtgttgggggcggcgccttgttggccctgcccgcggtcttgaaggcggcgtacccggtctgcccccgcgcggccacgaggacgttgacgtcgtaggtgccctcgtaggtgtagtacgcctccgcgtccacaaaggccttggccaccaggaagtcggcgacgatgccgttgccgcccaggcactcgcggcccagcgccaccacctcgcgcgcacgcgcggtggtccaggccttgaccaggctggcctgctcgtggctcatgcgccccgcgtcgtacagctggctcaggcggtggcacatgaggtacatggcctggatggtggcctgcatgcgcgccagccgctcctggaccagctggaaggaggccagcggcgcgccaaactggcggcgctggctcgtgtagcgcagcaccatgtcgtacacgccggtcaccaggcccactggctgccaggccaccatgcagcgcgacatggccagcatgcccgccgcgtcggcaaaggactccacgcccggcaggcggtcggcgtcggggacaaaggcccccgtcaggtggatgtcggcgttctgcacgcagcgaagcgagatcttgtgctcgatcttggtggcgcggaagccggggttgcccttgcgcacgatgaaggcgttcacctgccccgtctcgctgctgcgcgcccacacaatgaccacatcggcaaaggtggctgtgtgtgggaagggggggcggggaggagaagggggtttgggtaaatgcttgagagggcggcaccagaagggaacagcggaggtgtgagcgtcgaggagcgggtcatcgcagattcccctccctttcctcccgccccccctcaccgttgccgatccaccgcttgcggccgtccaggatccagccgcccgggaccttgcgcgcggtggtggtcagcgccgaggcgtcagacccgttgctcggctcggtcagcgcccaggcggcgaccttggagaagttggagaggcccggcaggagctcggccttctgggcctcgctgcctagcaggcccagcgtcatgacgcccaggtaactgtgcaccaggaagaaggtggacagcgacccgtccacgcggcccagctcgacgatggccgccgcggcgcccatggtggtcagcccctggcagccgtggctcttgatgtgcgcgccgccgatgcccagctcgccgaacttggagcgcagctcgtgcgggaactccgccttctcccagtacttgttgatgatgggggcggcgtgttgctcctgcaggattttgcggtgggggaagggggtgaccgggagggagtctgggatggggcccatgcagacagatgatggtagtcatgcagcgatggaatgacacattggcacaaggacaggagggatcgagttgccggcagtatgtctctacagagagtggtcgactgtattcccttgccaccccagcaccagagtccccgagggacacgtggccggagagtgacgacacatgccccgacgcggctcaccgcaaatgctcgcacgcgagccttgatcgccttctcctcgggagtgaagagctcctccaactccagggcgtcgtgccgagcaggggggaacaccgtcatgttttgcgcttggtcgaactggggggtggttcccacggccagggtgtcttggcgggccaccgtggaatcctgattctctacaaggcgggggtaattattcaatagtcagtgatgagtctgattgtgaccgtctgcgaccctcaacactctgcaaaacccggagcacacctcctgtggtcagatggttggccagcaccctcacgcgagcgaggggccccgcattggattcattccggtccatgtcgctctttatccgtttgcaaaattcagttctcgttcagtgtgctgagggttgcgaacccagtatattgccaaaactatcgaaacgatgctgacgtgttttcggaggcgtcgtggacgccaggccttggtctcatccatctacaagctttcattcttaatcgcaacaaggcaaggtgttactgactgacccagaaccgcatcctagcaattgaggcttctatccaaaagccacattctgggcactgtggacagcggtggcagggtctagccacacgattctacttgcggaaccacagccccaccttgcgccatgcacgaatcccatgcactgtattgttccatcatcttgcatgtgacttgatgaaaatatttcgcccgcactttataacatcttagggttggaggacttgggaannnnnnnnnntccatgcactgtattattccatcatcttgcatgtagcttgatgaaaatacttcgcccgcacttaataacatcttagggttggaggacttgggaaccaaatcccttgaaaccttaggatggactgcagcatcaaccaatgagggctggctcaatacctgacccaggcttactttaaaaatgcatgcctggtgcccaaggtcttctttctgggctgaaagcgtgtaccgagggattctccacataacgtcccacccaaatctttgtactgtcgtggagacagtagatcagcatctttctgcttcaatgatacgccaaattccaattgagtggcaggtcggaggtgctgacctggcagcagggaccggagcgcgaagcgaagaggcctgctctccacccacctacacacagatgaggtctggatgtgcacctggaggccactgcatcgtgagagccatgcattcctagtgtaagtatcttggacattctggcctctgccacccctctggcgctgactcttgtgatcagttgtgccccgccaggcagaaggtcccccaacagtcgcccagaagcgtgtgccattgcccaaagggcaagtttccactcatggaagatgcggaagcttcagcgttagaagatgccgccccgatgcccgcccctcggctcaggcccttccctatcgtggggaccaaccccggcccacggtgcgatgatttccggacggtgcctgtgccgttcgttctacgcaatctcattgcgatgtatcgatcctcccgacatgcatcgatcccctgctcatgtacagctgtgggcacacgctgacgaccatttcggggccggacggcgacctgtctaccgcccgcctcgtcctcttcggtacgcgaaggacgcttgaaagggtctcacgtccgagcttgcgtggttctgcgagtcctgacttttcatttgcatccgcgccatcggctgactgagaggcatgtggcccctctccctgcaggtggagccaccgccttggaaggccagcccaagcctggagaggcacctccttcccccagcccatccagcgcaggtaggtacctggacatcagactgattatgcactgtagctgtgggcacagcatgcagatgcttctcgtatggactctgatggggcacaaggcccatgcaagtttgtcaggtgccgctcgagcgtcacttgttgtcactgccctccttcccccccccaaaacaacaaccacccaggcatacggctggccggagctacaaatgnnnnnnnnnnctctcgtatgtcctctgatgggccacaaggcccatgcaagtttgtcaggtgccnnnnnnnnnntgggcgatgggagaagtgggcgccgcagggagagcccccctccccacgtgccgcccacgcagcagcagccgtcggcaacatggtcgttgtacaggtgagggctttggggaggctggagggcggggcggnnnnnnnnnnggggcgatgggagaagtgggcgccgcagggcgagcccccctccccacgtgccgcccatgcagcagcagccgtcggcaacatggtcgtcgtacaggtgggggctttggggaggctggagggcggggcggggcagagcaggcagcagttttggccgcatctcacgtctggctttgcagggatcacatgccgacaggatggtgcatgtgcacagtaagcgacggcagcccttgtccccgctgttgctctcctgtcgagaccctgttctccctggagggtcccgcacctgtagtctttcgggtggttgcgcatgcaagacccctctcgcgccaccggcacacgtgcatgcagggcggcatcggcccggcgggactggcatccgaggacctgcacgtcctcgactttaccgacaccgagaagccgcgctggcacaggtctgtcggcgtggtgctcgtgatcatggtcgcagcggcctgtgggcaccaagaggccactgcatgcgcagcatgtacccgccgatctcgtcctgcccgagcagaggctgatgcacctcacgtctcgtcccacaccccacccactccccctttccccacccccgacagggtggcggtagccggccccggcccctcggcacggnnnnnnnnnntgtctcatcccacaccccacccactcccccttcccccacccccgacagggttgcggtagccggccccggcccctcggcacggtacgcgcacactctggccctggtggccaaccgcttcctggtggcggccgggggcaacgacggcaaggccacgctgcacgacgcctggtccctggacaccagcgagaagccatacgcctggcgccgcgtggcggacagcggcgacgagccgcccgcgcgcatgtacgcggcggccgccgcccgctctgacggcctgctcctgctctgcggcgggcgcgacgtggacggcgtccccctggacgacgcctacggcctggcccggcaccgcgacgggcg

SEQ ID NO: 35985 - DNA, 131 bp, Chlorella protothecoides
ggccaacttcaacaagtgcgcagggcttggggggggtcccgtctttggtgccaggggggtgcagagtttggccggcgcgtgcacgcctcggcgaccccctccctccccttcccaaaacttcaaacctccag

SEQ ID NO: 35986 - DNA, 2505 bp, Chlorella protothecoides
  modified_base (241)..(250): a, c, t, g, unknown or other
  modified_base (1288)..(1405): a, c, t, g, unknown or other
  modified_base (2324)..(2333): a, c, t, g, unknown or other
cggccgccgcgggcgggggcgtgggtgtgccctcccgctcctcgccctgcaggcagggcatggcgaggaccttggccgcggtgggccggtccgccgggttggggctcatcagcgccctgggtggggagggtgggaggagaaggaggggtgggaggatgatgcatcggacggagaagggggggaggatgccgggagcgcggggatggctcacgcccctggcacagccgggcgtccaacttgnnnnnnnnnnggggaggagaaggagggtgggaggacgacgcatcggacggagaaggggggggatatgccgggagcgcggggatggctcccgcccctggcacagccgggcgtccaacttggtacctttctggatcaccagcaggcgcaacggggggaaactcacccgtacaaaccctctcacatccccccctccctgctccggggacaagcactccaccacatgtccacaaggaagctgacgagacacccccacccacttgatgaggcgcgccaggccgacgggcaaggccggcagcaggggcagcttcccggcgcgcagcgcggcgtaggccgcccccccccgcggcaggtcctccccgctggccagctgcagcgcggtggcccccagcgcaaacatgtcggcggcggggaggtcgcggtggtcggcgttcatcagctcgggggccatgtaacgcccgtcgccctcggtcacggcggcgggcccggcgccgtccagccgcgcggcctgcccaaagtcgcccagcttgtactcgggcggggggggggcgggccctcccgccccgtgcccctcccccccttccagcaggtacacgttgtcgggcttcaggtccaggtgcgccacgccgtgcgcgtgcaggtgggccagcgcgccggccagcgcgcggacgaggcgcgccagttcggccggggcggggcgctcgccggagagggccaggtgcgtgcccaggctcacgtcgcagcgctccagcagcaggtaggtgtgcaggccggcgggggacaccggctccacccacgcgccgtggtagcgcaccaggccggggtggggcggcgtgtgcgccagcacctgcacctcctgcaggtactgcgcgaagtcgggggagtcggggcgcgtctcgcgggcgctgcgcttcagcgcgtattcgcgcccgtccaggcggtggcgcacgcggaacaccttgctgtagttgccctggcccagcaggcccagctccttgaagtccaggctgtatcagtgtggggggaggggtgggcggtgttgggtgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgcttgattgacacggttctgtccagcaaagtgcccggctgctgccccgccgcgccgcaccgcatgcgggaggtggggaaggaggccgcgtccctcttggagctccaggcagacatgccctcctcagcgtccgcgtcgcggaagatgcagcggtagcagggcggcgagcgcacccgcaccaggcgctgacccgcgcccggcccaggctgccggggtggggtccctgcgcggtgtgtgaggtgaagattggggtactgaggaggccgggtcgggagggcagcacgggcagcacgaagcaggccccgccctcagctcgcacccgtgccggctcttcgagcacgtttcattctattcggagacagctgggccggcgatcgggccaagcgggcccccggcgcggcatccgcttccgtgccgaactgatccacgggagtgatgtagtcctgggtgccgagggcctctgcctgggagcacgtcgccatgccttcgtttccgtcgtaatcgggaggggagacgcggttcccgggcctggaccgcagcacatcctgcgaggcctggctatcgaggctcatggcgctgaaagggtttgcgagctggcccgagggcatgttctcctggctcgcaaacagcaacatgataatggaagtatttgagataagcgtgaagcagggctggcctggccataagtgcggtaaaaggcgcctgccatgtcccacacgggcagatttggacaggcctggaatttcagacaagggattctagaaagcaagacccgcgggatgccttgtaccacagccatttgtatcattgggcaggatctaccttcaattcaaccattcatgaccattgcggtcgagtattcttggcgctgagaagaagcggaacttccaaaaaggtggtgttgaataacaccagnnnnnnnnnntacgggattttagaaagcaagacccgcggggtgccttgtaccacagccatttgtatcattgggcaggatctacctttaattcaaccattcatgatccttgcggtcgaggattcttggcgctgacaagaagcggaacttccagaaaggtggtgttgaataacaccagtggggt

SEQ ID NO: 35987 - DNA, 67 bp, Chlorella protothecoides
ccacctggtcggagtccatccacaccacctcctccacagcctccctctggctgggccccctggcatg

SEQ ID NO: 35988 - DNA, 61 bp, Chlorella protothecoides
aggctcagggggcggtgcgtctccgcccccaccgccatcacgtgcgcggcatgcgtctcgt

SEQ ID NO: 35989 - DNA, 61 bp, Chlorella protothecoides
acctacgtgagagtgaaagtcaggaggctcagcttggaaggtggagcagagggtgcgttga

SEQ ID NO: 35990 - DNA, 67 bp, Chlorella protothecoides
cagcttccaggacatcatctttgtggggcagcgcaccaactacaagagcatcctctacaagacctac

SEQ ID NO: 35991 - DNA, 61 bp, Chlorella protothecoides
cataatcaatggcgccaaagtcgttttccttcgtcgccgtcctcagcccaaagccccgcgt

SEQ ID NO: 35992 - DNA, 447 bp, Chlorella protothecoides
  modified_base (179)..(315): a, c, t, g, unknown or other
ccccgccgctcccaccccccgccccgcccccgctggcgtgcaccaggcccgccagcgtgccgcgcgcgcacagctccatgaccaggtacaccgacccggcgtgcacgcaccagccgcgcagcgcgaccacgttgtcgtgccccggcgtggtggcgtggatgtgggcgtccagctcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggacccctcgcccagcaggcgcccgaagcgcaggtcctcgtaccgcaccaggttggccgggtccgcgcccagcgaccgccgcggcgacagcgaggcgcccgaggcgcggcggcccagcgcgccgggctg

SEQ ID NO: 35993 - DNA, 64 bp, Chlorella protothecoides
gacggtcatgcgcccattcgtccacgtggtggatcactggcgtcgacaggttgtgccactcccg

SEQ ID NO: 35994 - DNA, 66 bp, Chlorella protothecoides
aggccaagcatcccttccttcacggcagggacagatggcacaccacaaacatggtttgcacaccta

SEQ ID NO: 35995 - DNA, 61 bp, Chlorella protothecoides
catgaaaggtcagcgccttgtcagccccccacctggtcagctctcccagccacgatctctg

SEQ ID NO: 35996 - DNA, 149 bp, Chlorella protothecoides
gggtggcgacgagggcgccgaggacgagggtcgagcgaggctggaggcgctgtggtgccttttcactggccccacacgtgatgatgcgccgagggacggcggtgaggcggcaacggcgagggatggagccctggaagaagatgagcgtg

SEQ ID NO: 35997 - DNA, 63 bp, Chlorella protothecoides
ccctcacaacctcccacaagcacgcaccgttgggcggcggccgcccctgcctcccctgcctcc

SEQ ID NO: 35998 - DNA, 10757 bp, Chlorella protothecoides
  modified_base (601)..(610): a, c, t, g, unknown or other
  modified_base (1289)..(1298): a, c, t, g, unknown or other
  modified_base (1860)..(1869): a, c, t, g, unknown or other
  modified_base (2571)..(2580): a, c, t, g, unknown or other
  modified_base (3082)..(3091): a, c, t, g, unknown or other
  modified_base (3225)..(3234): a, c, t, g, unknown or other
  modified_base (6788)..(6830): a, c, t, g, unknown or other
  modified_base (7460)..(7629): a, c, t, g, unknown or other
  modified_base (7776)..(7956): a, c, t, g, unknown or other
  modified_base (8030)..(8039): a, c, t, g, unknown or other
  modified_base (8952)..(9112): a, c, t, g, unknown or other
  modified_base (9469)..(9478): a, c, t, g, unknown or other
  modified_base (10056)..(10065): a, c, t, g, unknown or other
ggggggggtatgagtcaacggggtcgagggtggtgggatgatggggcacggggtccactccaggggtctgatgcccctcatggactcggggtctgtgcatgtgcggcgaatcaatcgatgggcactccctcgaaagtccgcctggtgtgcccccgcccgccaccctttcttcaaaaccccacacccccccttcaaattgcatgatccatgctgacctgggcctcctgcagcgcggcccccaggaaggtcaggatgctgtccagcgacatgcagcggcacagcgcggggatgacccagctccccaggttttcggcggcttccaggtccgccagcgccgccggcgcaccgtgcaacccgctggcgcgctgcgccctgaccaggccgctccgcctgtagctcagcttctgcagcgcagggtccggcttgaactcgaagcactgcgaacagttttttgggggggagaggtcgaagggaaaagtgagaaggtgatgccgggcatgactgccagccatcacgggcttgagcaaggaagccatgtgagcatgcaaagccgggttgaatgctgccatgaggcgggtctacagctcatctgaggacaggnnnnnnnnnngatcacaggcttgagcaaggacgccatgtgagcatggaaagccgggttgaatgctgccataaggcgggtctacagctcatctgaggacaggcaggctgtggcctcgcccgccacaactgcctacctgtcccaaggctggtacggggctcgcccagtacgcctggaggaggtcggcaggggtcaaaggcttccccgggtcagcggctctcccctccaccgtgaggatgggcagtgtagctcctgcggccaggaaggggtagggagagctcaggggggcatggtgcagagagagtgttctgatggatgggaagagctttcttcagcatagggatctcgcaaagcaatgcgcccccgccttcatcacgtggatcgagtcccagagcaccgaaaatcaacgctcacacagtatcacatattccaatcgcgcagtcattccagaaagcaccgcatcacctgcggcgctctctgagtccaccgagtatggcacggggcctcgcggctggggcgagaagacgtccccccgagccagggtctgagacggcgtgccctcttgttgcggggtggatgccgacggctcaggggcttgaccactggccttgtccggcgagggggtgcccaccgtgtcgtccccagcactcctggcaggtcgctcctcgggcagcgcaggtgtagccgcggnnnnnnnnnnagctcaggggcttgaccactggccttgtctggcgagggggtgcccaacgtgtcgtccccagctttcctggcaggctcctcgggcagcgcaggtgtagccgcggccgcgcaggccctgctgaccggcgtcgctgctggcgccagactggaggctgccgaggcgaagctctcgctctctgacgcgccgtcctcgttgctctgccgcctcgactgcgacctggactggccaggcgtctgcgtcctggaggacgcagccctcgagaggcggggttgccgggcaggggcactgcttggttcctggccagctggtgtcgccgctgcaaccaggacctgctgccctgctgccaccgtcaccgaaacacacgcgtcgccgacaggggtttctgcgcccccctttccttccttatcgtcccccgcgtcaccttttcctggctcggggctatcctcgcgcacgctgctggcgctggtgctgggcatctccagggcatgggaggacagccgctccgccgacccggcgggctcctgccccggagcgcgcgcaaagggcgacggggggttggcgnnnnnnnnnngtgggaggacagccgctccgccgagcctgcgggctcctgccccggggcgcgcgcaaagggcgacggggggttggcggcgacgccgggcagggctgtggacgccctggctcctctgtctagcccaggctcagccgcagaccccctccttcctcccaccaaagggctcggcccattcccgccctccttggccagggcgaggtccagcgcccgccgcactgaggccatgcgctccgcccccgcggccgccgtgccggcgatgtcacgtgaggagcggggctcctggcgtggccgcgcctccggcgcggcggtgaagtaaggggtgggcccgctcaggttctccgacaggctggtcaggctgctgcgcgctgagctggccaggctgaggtccgaccccggcccggccgcggtgcggggcgtgccggggacggagggggtcaggaaggccagctcggcgtcgcctgccagctcagcggccaggaccgtcatgcggtcgagtcgctccagccccagcaccgtctgcagcacctgacagcaggcaggggttggggggagagggggcctgggtggagtgagagcccaggcaatgcgttggggtgcaagatggcgcggcagtgcgtcgggcaaaaggggacacgacacggaggcgggcgctctcttcgcctcgtggaatgcaccttggattacagggcgccccttcccccnnnnnnnnnntgggcaaaaggggacaagacccggaggcgggcgctctcttcgcctcatcgaattcaccttggattacagggcgccccttcccccctcccccgctcctgatccctcgcagacccatgtcacccactcggaagtgcagggagaagaaggggaagtgggagagcaggcagtagcagcggggggcggccacgaggtagcgcggcagtggcggctgggccggggctggggcccctcctcgcaggatggccggcgggcggtgcaccagctcccgcatgtagcagcacactccccacagcgtctgggggtgctcggccggcgcatgcctcgcagacacctggcggtttgaggaggtgggaaccatggtggcgttgggattggtgattggtacatcgagcgcttggctcgacggtcgcatgcatggcggcaccatcccggcagcagcagcaagctcacgctcctgggcgccacacatggttacggttgtgtagcatcgactcgctttccnnnnnnnnnntgctcctgggcgccacagacaattacggttgtgtagcatcgactcgctttccgaacctggccttttgctctttgccccccaaccccgggaaaccaaggaaaatctagcgcgccttcaaggtgaagacaaaggtnnnnnnnnnncgctctttgccccccgaccccgggaaatcaaggaaaacctagcgcgccttcaaggtgaagacaaaggtggcctcgtccgaggagtggtgggcctgtccgcacaccacctcggtcagctccgacatggagggcgtcctttccagcagctccggccggatgccctgggggaagcagaggcccggcagcgcagccgtcagggccgggtccaggccggagggcgtggcgtggagcacagcagggtccaggtgcggcccccgatggccgtggtgggccaggccccgagcctcccgcggcgcgtcgggcgtcacccgcatgccgggctgctgggaggcactgcgcaggcgctggaaggtgcgggcgttggaggtgacggcgcggacgtccaggtcgggggggaggcccttttttgttggggtgggtgggtgggttgaggcgatgacatcaggtgttcagtgtgacgagggtatgaacgagggacaaggcacaagttggcatgggtgcggcagtgggagggagccaggtgggtccagccgatgccacatggggaatgcagcgcgcatcctgtgcagtgctggcagctcacaggcatgtgggaactctgtgcagcactactgggaatcatcccctcatcttacccactcaccaccacgacaaagtgctcaaagaggtggtcagaggcggtggtgtgctgcaggcgtgagcgccggccccaggccctctgcacgcatcgcaagagggagggcgaggggggtgtcaaacaggaggcaaagcgaccatggatgccctggcagatgccagctcggcgactccacgtggggcaggatcaacccccccctccccccgcctggcctggggcctcacaccttttcgtcgatgatctgggctgggtcatggttgcgcggcatgggcgcctgcaggcaggtggggtggaatcctggtgttgatgcatgttgaatccaggatacatacaacagtacagggagcaaagcgatcaggccccctccagggctgctgtacctctgagccgttctggaacagcctcttggccatcttggtggccagcttggcggggtccgtgatggtcgccgcgatcacaggcttgagaatccccttgttcgcgttgccctccattgcatccagcctcagggatcaggcatagggtggtttgctggccgcggcgcccccgaggaggatttggggtggcaacgctggagagtggttgcgggtcacctgccaccccgccgatctactcctcaaaccctcccagtacggaataagctggctcaagttgatatgattttgaatgtactgcaaccttgcgggcgtcacaggccaagatgcatgaagcgagaattttatcgtccgggacgcgctaagtaggatccatgcagaagcacgaaccccagcaagaccagccgagtggccaaagccgtcagaccttccgacgcccaaccgtgcgtaccggcggatcatagtggcattgactactccagcaaggagctaggatcaatggtacatttcacaacacagcctgcctgcaggtgccagcaacatttctcacaacaccaaccccatgcaacacaccctctgatgtactctcggaattactttctccttaaatcgccgtcttattgtagaaaaaggctcccgaggttgtagaaggacaacactcagtcagcggggaggaaatggaaactgatcggtgcaggttgacactgggaggatcctgacacccaaaatcaagcggagcaggagaatcaaagagtttgtatgggaacaagtaaggtagcggcccctgttgagggatgcatcacaggggagaaaggtgggtcatagacactgagtgcatcatacagtctagggggccccagtggatgtgcaggagcatgttaccagcaggcatggggttctgggaggttgtttggttcacaagagttgcgcttgctcccaggtagctgtaggaggtctccagagcgctttctgcgggccggcaggggtaggatcggagtcagatgaagtctctcgaaacacttcctgtagagccctcccaaaaacttttgaacccgacagacctgacaacatgctccaccgtactcaggggccgaacgactttagacaggcgacagatgacatgagcaccatcgtagtacaccccttggtcgcagttggcgtcgcaaacatgctgcattccgctcgtctggcagacgtaaaggttcccgaaggcgtgctcaaacgtgcagtagcgcgtgcacttatggggtaaaagctgaagagcagggttcggcatcctctttaactccaacgactggtgcatttctcccgaaaatgtctgcagcggggttgggcagagagtctggcgggcagggccccacctagcgacactgtgacacaggagcgaaactcacggacatgggtctcacggaaacatgttactagctaataaacaccgcacgagcgagtgtaggcgcgtgggtgccctgaagagctcgcctctcccctggttgccgctgctcggctctgcgccaagcaccattcctcgtttctatttctctgcgcaggcctgagttcccagacgggggtgctgcctacagcgcgcagggagcctgggggactgcccaacgcgaaatatcttttgccgcgatccggtgccgatcacgcacatccgaccacgattggaccacattaagcgagggacaagtgatcgggagcttctgggaggtcggtgctgtggccaagtgatcctcgcagacctgccaggtggcccggatcccgcgacgtgcctcggcagtctctgacagtacaaatcaggaggcatggcgaagcccggggcttccgaccccgagaaggatgagaagccgatcaagacactgtcggaggaggacgtcaggatcatgcagacgtatggggccgggccatactcccatcgcatcaagaagctggagatcgagctcagggagattgcaaaacgcgtgaatgaggtgtctggcatcaaggagtcggacacgggcctggcgcacccctctcgctgggaccttgtcagtgataagcaggcgctgcaggaggagcagcccctccaagtaggacggagagctccttcccgcctgatgctctccctcaacttcattgggaacatggtcatggagcactgacagctgtgctggctggtgagacactcaggatccaaacccaccacatgtcccccctcgccctctgcaggtggctcgctgcaccaagatcatcaatcccaacacagacaacgccaagtacatgatcaacatcaagcagattgccaaatttgtcgtgggcctgggcgaccgtgtcgcgcccaccgacatagaggagggcatgcgtgttgggtgagcctgtggcagttgaggctgggagggatcagctgcagatggccagcaagagctggaggttcatgagcatgtcagatggggcatgcagtagctgcgcatggtcttaagacagcagtggcaaactttgcttggaccttgcagcggtctcgctggcaaggaggagagaccccccccccccccccccccccccccccnnnnnnnnnnnnnnnnnnnnnnnnnnnnnnnnnnnnnnnnnnncccactcccagggtggaccgtcaaaagtaccagatccagatcccactgccccccaagatcgatcccagcgtgacgatgatgactgtggaggagaagcccgatgtcacatacaggtgcggaaagggcgggcttggtggcatgaatttgcagcattgcagaatcgcatgctgcgtcccccgtggggtggccatgcaggagctgcagtcattgggatggaagcttgtcctgtcccagtgcatatcgcaccttgcaccttggcgtcccccccgcccccccccaagaccatacccgcaccccccctctgcagcgacatcggcggctgcaaggagcagatcgaccgcatgcgggaggtggtggagatccccatgctccaccccgagaagtttgtggcactcgggatcgacccgcccaagggcgtgctctgctatgggccccctggcacaggtgccgaggcgggattgttccttgtatctagagggagggcgaatactcaatctaggagacgggaggaaggtgctgcaagaggcttgcagttttaggcaatgtggcttggagcgccactcaaccaataagcaccactccagatcgtatcccctcctgagcatcactcattcccaaggcccatcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggagagcgccctggcagaagcacatggtgtgggtttcaccagccgactcttgcaggcatccgcacacaggggtgctcacaccaggcgcttacttcctgcagtgctttccctttggggcaccctgactcccgtgctgccctggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgcgcgctttgaggacggcgccggcggcgacaacgaggtgcagcggaccatgctggagatcgtcaaccagnnnnnnnnnngttaggaaatgtggcttggagcgccactcgaccaataagcaccactccagatcgtatgcccctcccgagcatcactcattcccaaggcccatcctccttttgcctcgcaggcaagacgctgctggctcgggcggtggccaaccgcaccgacgcctgcttcatccgagtcatcgggtccgagctggtacagaagtacgtcggcgagggcgcccgcatggtgagtcgaacagaatgggggttgggagagcgccctggcagaagctcatggtgttggtttcaccggccgactcttgcaggcatctgcacacaggggtgctcacaacaggcgcttacttcctgcagtgcattccctttgggcaccctgactcccgtgctgccctggctggttggagctttggcgcccatccccatccctcaccaaaaccctcccccacacctgcctcgaaacacgatcaggtgcgcgagctgttccagatggcgcgcagcaagaaggcgtgcatcatcttcttcgacgaggtggacgccatcggcggcgcgcgctttgaggacggcgcaggcggcgacaacgaggtccagcggaccatgctggagatcgtcaaccagctggacggctttgacgcgcgggggaacatcaaggtgctcatggccaccaacaggcccgacaccctggacccggccctgctgcgacctgggcgcctggaccgcaaggtggagtttggcctgccggacctggagtcccgcagccagatcttccgcatccacacccgtgccatgagcgtcgagcgcgacatccggtgggtttggagtcatgtggtcgtggcgttggggagcgcagggggcggggaatgtctggagggaaccggagggtccttatggagggaacggagggtctttctggagggagcggagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcaaggggcagccctctcatccagaccgccctgttgaacctctcctcgctccccactcgacatcgacaggtgggagctgctggcgcggctgtgccccaactccacgggcgccgacattcgctccgtctgcacagaggcggggatgtatgccatccgctcgcggcgcaagacggtgacggagaaggacttcctggacgccgtgaacaaggtcatcaagggctaccagaagttctcggccacgccctcctacatggtctacaactgagcggggtggtttgtttgggaggaggggtggcggggagcggttccgggaggcctcgggctctgcccggccggcgccggagcatgcactccnnnnnnnnnncgggaggaggggtggcggggagcgggtccgggaggcctcggacgctgcccggccggcgccggagcatgcactcccgctggcattgggcttgtgtgtgcggcgctgcccctttccctcctcacccctggtcctcagcgatttgtaacatgggtcgcatggcacattggcaagggacagcagcagcagcaggggggagggggactagaccccgggaaggtacgctgacttcccccatcttccctcacgagaaccaaagtcgagagcaggagctcgctccccctgcgcatcagatgaacacgtccatctcggcgcgggcgtaggtgttgatgccctcgtcctccatgcgcgggtagaaggcggtgagggcgtcctgggacccgatgtacaggttgttgtagtgccgccagtacacctcccgcaccttgcgcgccgggtggaacaggccctgtcggggtggtcggttttgggtgtgtttgcctgggatctggattgtgtcactgtgatcgttctccgacacatcaacctgcagcggctctgcagccagccagcaggcctgcgacatccccggctcggtccannnnnnnnnncgggtgtgtttgcctgggatctggatcgcgtcactgtgatcattctccgacacatccaccggcagtggctctgcagccagccggcaggcctgcgacatccccggctcggtccaccccggcaccccgccccacccacacctggaggaggaagttgaggatggtggcgggccccagggcgcagcggcagccgtcgatggccccggtcacggcctggacgatgtgtggcgaggtctcaaacacgttgggccagaccaggttgaggaggtggagcagcgcgtcttcgcaccccagccccgtcacccccaggctcatgtgctggatgacaaaggccgcggtctggcggtgcaccaggtcgcggtcggtcagcgcgtcctccagcaggggcgtcacggcgtagatgtagtccttgcccatctccccgatgtactcgaacaggaagctcaggctcttcagcaccccgttctgcacgttcagctccggcacgcggtactcgttcatcagcgcgggcagcacggtgaagggcgcgcaggtctccgccacgatagcgatggccacggtggtgcagacgcgggactgccgctcctgcaccttgaggttgttcagcagcgtgaccagcacgtcctggggcccaatggccttggcgatgtagccaaacgtgttgaccgccgcgcggcggatggccttcttgaacg

SEQ ID NO: 35999 - DNA, 73 bp, Chlorella protothecoides
gattaaatatatatgtaagcagcccctgccaagacacggcggactcccaatgctcccgcaagtgttgctcgtc

SEQ ID NO: 36000 - DNA, 61 bp, Chlorella protothecoides
gactgggtttgaaaccagatcctacgcaccgtgtgggaatgagtgggtacatgacgaggag

SEQ ID NO: 36001 - DNA, 106 bp, Chlorella protothecoides
gccgcccacctccttccggcgcagggcggcgaggagctccccctgccgcgcacccaggctcgtcagcagaccctgaatggactgcaccgtctccagcaccgcctcg

SEQ ID NO: 36002 - DNA, 94 bp, Chlorella protothecoides
acgtcgtattcgcgggtcagtctggcgatgtacacacgatcttacacagctgaatgtacttaggttgctagcatgactcgatgtcggccgctgc

SEQ ID NO: 36003 - DNA, 61 bp, Chlorella protothecoides
cacggagatggtggtgtatggcggcggtggggcaaggggcgtggggggtgggctggggact

SEQ ID NO: 36004 - DNA, 61 bp, Chlorella protothecoides
gccgccaacatgctagtccgcgccgcccctagggcgcctggtggctggcagctcgtgctgc

SEQ ID NO: 36005 - DNA, 64 bp, Chlorella protothecoides
accgtcagcgtcaggtgtgtggggggggggtggggcgaggggggtgtagaaggtgcagccttgg

SEQ ID NO: 36006 - DNA, 79 bp, Chlorella protothecoides
cagccgttaccaaggttttcacgaaccccaacaggctcagaagccttacatggcaggtggaaagagcttggaggcaact

SEQ ID NO: 36007 - DNA, 61 bp, Chlorella protothecoides
ccaaggttaggggctgccggaactggttgcatgggagggatggtcgctgactccacatgcg

SEQ ID NO: 36008 - DNA, 65 bp, Chlorella protothecoides
gtagctgacaatgagagcttgtcacctggtgattcaggaggtttttcttcgggaggacggggggg

SEQ ID NO: 36009 - DNA, 117 bp, Chlorella protothecoides
cacaggtctggtacgcctgtgcttgtggcgtgtgtcgtgggttgggaggggctccaggggggggcgtgacctcgataccccagtgctggaggaacctgcaccgcgggtgctgtgccc

SEQ ID NO: 36010 - DNA, 61 bp, Chlorella protothecoides
cgcccacccccagacgattctgagcaacgctgaactcttcaacggtgccgacagcccgatt

SEQ ID NO: 36011 - DNA, 61 bp, Chlorella protothecoides
agactggatctctttggttacagtgtcgggtagagacctccaagcagaggaagcatcagct

SEQ ID NO: 36012 - DNA, 75 bp, Chlorella protothecoides
ccgtcctgcttggtgtggaggaaagggatgctggtctcgataatgcagccacagcagagctgccaaagagcatgg

SEQ ID NO: 36013 - DNA, 64 bp, Chlorella protothecoides
ctggcgggcgacacccaggccggcgacgagacgcgcggcggcggcggcatgccctccctcgccc

SEQ ID NO: 36014 - DNA, 73 bp, Chlorella protothecoides
caatcagcaatatcaaagccacatgtcgcccctacccttccgccaaagttcagtgagggcgaggagtggcggg

SEQ ID NO: 36015 - DNA, 95 bp, Chlorella protothecoides
aatgcaccctgctttggatgggcacctccatgccacatgcaaccccggccccgggcctgcacccgtgtcgcgcgggcatggtggcagcagctgcc

SEQ ID NO: 36016 - DNA, 95 bp, Chlorella protothecoides
ctgggaagctcatggaactgcactggaatccctctcgtcccgcaggcagtcattcctccctcccaccctctatcgtgtggaaatgtccacaagca

SEQ ID NO: 36017 - DNA, 74 bp, Chlorella protothecoides
gcaggtccaggtgacgcagcgctctgcagtgcgggggggaggacggggggagtgagcgctgtcggaaggccacc

SEQ ID NO: 36018 - DNA, 61 bp, Chlorella protothecoides
cccgcagtgttccccagccggaagggaggggccgacgccggcaggcccagggtcgtgccgc

SEQ ID NO: 36019 - DNA, 72 bp, Chlorella protothecoides
ggggttgggtgggggtgaggggaagatctgtgcatcgtgctcacaaggagcggcgggcaggcccctgtgctg

SEQ ID NO: 36020 - DNA, 80 bp, Chlorella protothecoides
gagggctgaggccaggcacgcgccggcaacgaggtacagggtgtgtggcttgaccctggagcgcaaatggggtatcaggg

SEQ ID NO: 36021 - DNA, 68 bp, Chlorella protothecoides
cactgcgtgctcattgccgggtgctgctgcatgaacacccccccccctcaaaccacacatccgaccac

SEQ ID NO: 36022 - DNA, 207 bp, Chlorella protothecoides
caggcctgcagtcgcacagggctgcccacggtgaggcagcagagtaatcaggatgggacgggggcagggcatctcgcggcgcgccgcagacgccaaggcgcctgcctgcgacggcatgccaccggctctggcctcgtgggtgtggactcgattcatgcaccccatgcctgcaggcaacgcccacctgcacgccgccagggaccgctc

SEQ ID NO: 36023 - DNA, 220 bp, Chlorella protothecoides
acgcacaatgcacatccttttcactgtcaccaacatgcagaactactacggaatggccttttttaggcaccctacgaattgggcttcacctatggatgatgacacgaccaagacctcgcttagcttgccaccaccgactgttaggatgaaagaggataccgagatggacaatgcgtaagtggtccagagcatggagtgtccaaggcttggattggaacat

SEQ ID NO: 36024 - DNA, 120 bp, Chlorella protothecoides
ctgaagtgctctgtgcaagttttggtcgagcactgtggcgagattttgtgaatgaatggttttgtaacatatcatccgtgctgtgtatggatgtgacgggcggggagacgtggagagctt

SEQ ID NO: 36025 - DNA, 80 bp, Chlorella protothecoides
ggggagtccacggttgatggggagggggagaccacgggggacggtgaggttgacggggatttcttcggcgaggaagaggg

SEQ ID NO: 36026 - DNA, 2276 bp, Chlorella protothecoides
  modified_base (1000)..(1078): a, c, t, g, unknown or other
  modified_base (1505)..(1576): a, c, t, g, unknown or other
tacacagatagagtactacgataaggcagattccaaatccaatactgcgttcttgaccctgattggatgctgggtcgcatcgacgatcaagcagccatcctgggcggtgcccggacgtcgtcgcgccctgactcagatcgatctcgactgcgagctcgacatcgtgcccaggacgcaatcccgtcccattctactacaagttattacatgactactggaatgatagggacctatcgcgtgacccaatctcagggccatctcatcatggtgccgccacgaaccccgctggtgggaggagcactgatcactgatcatccacctctgatcggcatcactcggacactgaatgactttgatcaggtttgcgcaccatcgcagaggatgtatcgatgccgttgagcctcgagcctcacgactctcctgcctccgcatcaaggtgctctgaagggttgtgcacagttgacaaggtcgtgacctctcacctgctcaaggggtagttgatgtcttaggcagagtcatgactcaacagtcatccactcacatccctcatgactgactaccaatgcacctgaatatgcagacgtcaaaaactctctgcacccctccaacgatgtgcttcattgccaaaggcctgtggcaagaatgcccgccaggcaatgcctctgtgatgccagcctgagcctctcaagagatcatacatccgatggtaagaacagagaccgatctgttggaccagtcaccctgttcctgactgcttccctattgagaacgcagctgcatacggtgagcgatgtcttgctgcacagtggtgcgggatacctctgttccccgattccccctctccatccctattggatctccgcctctccgccattgaggcacaatggcctaaaacacctagcccctagaggagatcgggacaggtgtaggatgcttcacctgggaagcactacatctaccctcattgcctgggtgttgtgggggcgggctggcccccacnnnnnnnnnnnnnnnnnnnnnnnnnnnnnnnnnnnnnnnnnnnnnnnnnnnnnnnnnnnnnnnnnnnnnnnnnnnnnnntgagaccccgaatgcggtgtgatgggcttgggtttcataggcgtcgcaaggaggcatggacacggtgtgcggagcgggaacagatggaaagtggggaaagggcccggtcaagggaaacccccacaacactggggcacacagcctgccccgcaccagacaccgccaggcacaggtgaagctgtagactatgtgatcctttcttgggcaccctgtcaacattacgcggcctcacgcagcccatattgtcattcagagcgctctcaatgaagcttccaatgacatccaattgagacacataccttccacctgcttttgcgacctctctcgtacccgccgtctcatttttagcccaaggcatccaatacccgtcctttggggtgatctgcacccttttcactccattctctccccctagacacactcaacnnnnnnnnnnnnnnnnnnnnnnnnnnnnnnnnnnnnnnnnnnnnnnnnnnnnnnnnnnnnnnnnnnnnnnnncatgtatcaactccaggatggttcccagagaattcagcctttcatggggcagggttctttctgttgtgggggcgggtaagaccctacaacgtggactgctgtatttgacctaagttaggaatgttacaggcaagaccccgaatacggtgaggggcttgggtttcaagaacggtgccatgcgtcgtaggcgcggcgcagtgcacggatgcaggtggaaaggggggaagtctccggagagggggcccccacaacactttcacatagggcagggttctttcacacagggcagggttctttcattcaacacgtccccggatgcgatgcgaggcttgggtgtctagccttagctaagcggcgcacagcggagaccacggatgcgggtggaatgggaaaaagagcctggtgaaagggcaactaggacaatgccttgcatacggcgacgtaagagccgtccttattgcagatgaccaggctggggtactctaccgcttggcatacaccattgaaggttgtgccccaaggacgcacgcatgccggagcatctgttggagcttctgtggcgcaaatggcggtggggacatcccttagagtgcagatatgcggataaatgccccccttagcaacgggttccggacacaacttccaaacgcccactcgcacctacatcagtgggggagggggggggggggggggggggggg

SEQ ID NO: 36027 - DNA, 98 bp, Chlorella protothecoides
caattaaaccttgttcagcgcaaaggagcacattctgagggggaggaggcagcgagatatagggttgcagtcctcagcctggcttctcaggctggtgc

SEQ ID NO: 36028 - DNA, 70 bp, Chlorella protothecoides
gcgtcttggtgcttgcgtgtatcatatcactaataacttgggttggccaacacattctgacggcttgtct

SEQ ID NO: 36029 - DNA, 77 bp, Chlorella protothecoides
aaccgtgtactgccggagcagtggcgccagacccagatcaggcatggatggaagtattcgaagccatgggcgcagca

SEQ ID NO: 36030 - DNA, 169 bp, Chlorella protothecoides
ggcacaatgtcgttctgcccgagaaagtggtggtgggtcatgcacaggaagcccagcagtgcactctcgtggccattgtgcatcgggagcttggaccgctccagatcctgtccactggagggttgagtcgacgagcgtacaacatcaggaatacaaacggccgtacagc

SEQ ID NO: 36031 - DNA, 61 bp, Chlorella protothecoides
cgtccgcaagctggatggccaggcgggaggggccggccgccacggccaggttctcggggtt

SEQ ID NO: 36032 - DNA, 708 bp, Chlorella protothecoides
cggcaccgccgcgccgccggggcccaggccggaggggccgtgggcgtgcgccgcgccgccgttggaggacgcggggcggtgcgcctggggcgactgcgtcaccgggctgttcaggttgtcgaaaaacgtgtccgcgcctgtgggtgggtgtgggtggggtgagggctggagggaggggaagcgatgctgggccccagcagcttctctgcaacgtcggccacggtggcggacgggagcgcccacgcttcccagggactgcccgttctctcgtactccgaccgaccgtccccagccgcccagattcctgccccctctcagcccttcaaccccatccctgactcgaacaagcgctcaccgtcagtgctaaaggggtccacctcctggggttccggaggaggatggggggccgcgtccgaggacgcggcgcccaggctcaaccgcgcgacgtcgtccgccgcggcctggaccgccgccggctccgcctcctccaccggtggcaggtcatccccgaaaccgaggcgctccagcaggtagcgccgcgcgtcgggcgcatagtgcgtgcccaggaaggcccaggtctccgcctcgggcgtgccggccagctcggcggcgcggcgcgcgcacagcgtgcgcagcgcctccctgtccccgctggccaccgcgccctccagcagcgagggcgcggcgccaggctcgccgccgcccccg

SEQ ID NO: 36033 - DNA, 61 bp, Chlorella protothecoides
cccgcggcaggctgggcgcaaccaacatatcctcgacccaagcctgtcatggagtacgccc

SEQ ID NO: 36034 - DNA, 183 bp, Chlorella protothecoides
gccccttcccgccccgctcggctggcggcgagcgggtgcggcgcttgccgctcctggtgacgctgccgtgggccagctgctccacggtccggggccgcagcgaggaggcgcgggttgcgatggcggtgccgaggggctgggggtccgggccacccggggctgagccccgggccagcctcttgc

SEQ ID NO: 36035 - DNA, 66 bp, Chlorella protothecoides
ctgttgtcagcttggatccaggaaactggatgcttccccatgcacagggtgccccagtggccctct

SEQ ID NO: 36036 - DNA, 61 bp, Chlorella protothecoides
ggcttcaggcgcagcaatggcgcgctgctcgtgtatcctgccatgcgagagaacggctcca

SEQ ID NO: 36037 - DNA, 11135 bp, Chlorella protothecoides
  modified_base (1396)..(1405): a, c, t, g, unknown or other
  modified_base (2543)..(2552): a, c, t, g, unknown or other
  modified_base (2908)..(2917): a, c, t, g, unknown or other
  modified_base (3308)..(3317): a, c, t, g, unknown or other
  modified_base (3567)..(3648): a, c, t, g, unknown or other
  modified_base (4656)..(4665): a, c, t, g, unknown or other
  modified_base (6063)..(6173): a, c, t, g, unknown or other
  modified_base (6240)..(6249): a, c, t, g, unknown or other
  modified_base (6316)..(6325): a, c, t, g, unknown or other
  modified_base (6495)..(6594): a, c, t, g, unknown or other
  modified_base (7751)..(7760): a, c, t, g, unknown or other
  modified_base (8636)..(8645): a, c, t, g, unknown or other
  modified_base (8914)..(8923): a, c, t, g, unknown or other
  modified_base (9994)..(10003): a, c, t, g, unknown or other
  modified_base (10870)..(10879): a, c, t, g, unknown or other
ccgccgccgcggccgctgccgccgcctccgctgctgcccgcgcctcctcggccgccgcctccgccgccaggcggtccgcgtcgcgcgccgcgcgcttggcctcgcgccgcgcgcgctcctcctccttgcgccgcgcaaggcgcgggtcctggcgcgctgcgctctccaccagctcacgaatgcggcgcgcctccgccttggtccccttctccctcagcttcgcgttgatgcgctcgatccagcgcttgtgctcgcgaccctccgccttgcggtcgtgaaggggaaagtggtgggggtgtgggcgagaagcgggcggggaacatgggtggggctgacggtgaacaaaggtttctggcacaagtctcgttccaatcatccttcaaaccctgtgcggagccctcgcagaatggcagcaggtcacctgcccatccagaaacccacctgctcaatgtcctcctcatctgggtgcgggaactccctccaggacttgaagccgtaccagaagtcgtagaacttgtccacctatggcagtgggcgttgatgggggggatgctgagtggcgtggaggccaggcatgtggcatgggatgctggccgagctagcatgcttcaagggggcccgctggctaggggctcagcatccttgtcgcctcacttgtgttttccggatcaacacttcgcaacgtcctccaactcccagcatcgacaacacagcacagtggctcgcacctcttcatagctgctggtgtcatcccccaacgttggagcgggctggtgcacagcccaccggctgttgcgggagaaggcctggccatacaccgtgtagaaggcctctgccgattccacctcccccggcagcgagtcgtcaaactcgtccagggagtcgaattcgcggcgcttggcggggtcaaacagggtctcgtacgcctcctggatggccttgaacttgtcctctgcttcctgcttcccaacctcgtccccactggggatgccctgcaggagggtggacaacaggccgaatgttcagatcaacccaaggtcaggcctctggtgctgatgaagagccaactgcagccacctgctcctgatgaggccatgtgctgaacactggggaatccctgcatgccagaccactatgcactcccttacctgtttatctgggtggtgaagcagcgcagactttcggtaggccagcctgatctggtctggggtggccatccaccgctcattctggaggcccagcagagcatacagatcgccgtgacccttcttcttccctttcttctttcccttgcccttccattttgtgctgtggggggggagcggggggattttggtaagggtggcgcctactaaaaggtcaggccagactcaaacagctcaaccctctagtcacnnnnnnnnnntaacgggggaattttggtaaggggggcgcctactgaaaggtcaggtcagactcaaacagctcaaccctctagtcacgctcgtactcatcgagccatcccactgagacccgccccgttgaccccgggattgcacaacctgggacggctgaaacatgaaccaaaacaggagcacgaaccccgccccgctcacccagacatggcttcctcatccagagaggagaagtcgttcacgctgctgctcctggactttgcgccggcctcatcgtctgcagcggtgtcctcttcctccgactcctctgcgaaaatggttccattgcatgacaggtgtttggcgtgtgctggcggcatcaagagcacacacatggaccccagagccatgcctctatcccaggtcacggatccccagctcaccatgcaggccggtctgcttgagggcgaagagatggtacaggtgaccggcaggctccttccgatagctcagggtgagggcggagagggagctggtcaccacatatccctcctcgggaacatgacccgattcccaggtcaggaagagggccatgccgccaggtgctggtgcgaaattgggggagttgcagggagccgcccctcgactgtggcggcagcgggaggggcccgagcaccgacaaactcggtgcttagcgtaaaggtgatgcaagtagcttttttaaagatgtggaaatatagcgcaggatatgcccgcactttggtgggaggtggaccggtcatgcacgttcgcgcctgggccccccagccgtgccgaagagcgcgcacgagcatgcgcggcgtgctgggccgagagggtgtccccatgctcgggcacctcggctccacccctccacggaaccaccgcccctgggcctcatcttccgtcccgtgaaagcccaggtggcaagttgctaaagggagaggccggagtggggatccccacggggtctggagccatgaggcgacacctgctcaccgggggttttgcgctcctccggcgggctgtgcaacccagcgcccggcttgctgtgaggtgcgagaatgccgatgaaaactcctttcggcgatggttcctgggcctagccgcgaatctcgactggggttgtcgctcctctccatcattgccctnnnnnnnnnngatgccgatgagaactcctttcggcgatagttcctgggcctagccgcgaatctcgaccggggttgtcgctcctctccatcattgccctccctctgaaacatggtgcagggatgccacagagctggctttgccaggttggactccgctcctccgcgcctttgcctccctgccgcagcacacagtacgtgggactgcggtcggtcgaatgcatgccacttcgagctgcctgcgaagcagcatcagtgtccttctggcttttggggaaccgggtccctgctgggtatgaagccagacactaagctgcccgcctccaacaacttcattccaggagctgaccatgccagcgctgtctccgnnnnnnnnnnttcggttgaatgcatgccactttgagctgcccgcgaagcagcatcagtgtccttctggcttttggggaactgggtccctggtgggtatgaagccaggcaccaagttgcccgcctccaacaacttcattgcaggagctgaccatgccagcgctgtctccgaccatggcgcaaggcaatctggtcacctggtccatcaaggaggggcaggaggttgcgcccggggacgcgattgccgaggtggagaccgacaaggccaccatgacgtgagtgcttgcagggcagggatgattgttttcgggttgggtgcagggcctgcgattgccatgtcagaggatgtagtggggtccttcagaatcctcgcccccccccccccccccccaccatcacacannnnnnnnnnattgtggggttcttcagaaccttcgggggccccccctccccaccaccaccatcacacatcccccaaaagccagtcaaccccctgttcctttgctgccaggtgggagaatcaggacgacggctttgtggccaagcttctggtgccggagggtgcgcaaggcatcgaggtgggcgcacccgtcgcaatcctggtggaggagcagggggacatcgccgccttcaaggactacgcagggccctccagctcccannnnnnnnnnnnnnnnnnnnnnnnnnnnnnnnnnnnnnnnnnnnnnnnnnnnnnnnnnnnnnnnnnnnnnnnnnnnnnnnnngccccagcggtcagcggtcccacgagctaccggctgggccccgccgcccgtatgctcctgagcggcagcggattgggccccggcgacgtcacgcccaccggcccgcatggcatcgtcaccaagggcgatgtcctggcggccctggcctccggtcaggccccccgggccgcatccactgccacggagggcacggagcccgccgcgaagccggctggcaaggagggcacggaggccgctgccacggcgccggccgccaaggaggccgccaagccggcctcaagcgcacccgcgcctgcacaggaccccgctcccgcctcggggcgccggcgcaagacgcgtggcgggcacaccgacgtgcccaactcccagatccggcgcatcatcgccgcgcggctctccgagtccaagtccaccatcccccacctctacctctctgccgacgtggacatggatgcggtggcggcgctgcgcgcaggcctcaagacccagggcctgaagctgtcggtcaacgacttcgtggtcaaggcggcggccggcgcgctggccgccgtccccgccgccaacgcgcactgggacgtggagggggcgagagcggtgcgggacccgggcgtggacatcgccatcgccgtggccacagaggcgggcctcatcacgcccatcgtgcgcggcgctgatgcaaagtcactgccggacgtcgccgaggaggtgcgggagctggccgcgcgcgcgcggcgtaaccggttgaagcccgaggagttccagggcggctccttcagcatctccaacctgggaatgtatggcatcgacagcttctcagccatcatcaacccgccgcaggtggggtggagagggaactgtttggggatatgagagccatggaccaagaggggaaaatggggttagtacctgtggggcatcaggggtgtgtggcgctggcgccgtgagcttgggaaataaccatgcatctccctggtcaaatccaccccggctgtcccagcaccgtctcgnnnnnnnnnnctggggatgtgagagccatggacaaagagggggaagaatggggttagtacccgtggggcatcaggggtgtggcgctggcgccgtgagcttggggaaataagcatgcatctcccaggccacatccaccccggctgtcccagcaccgtctcgattccgggtccaacgcctttccctgcctgcccatgcttccaggcgtgcatcatggcggtgggggccagtcggacggtgacggtcatcggcgccgacggcgcgctcgccaccaagtcggtcatgcgggtgacgctgtccgcagaccaccgagtgtacgacggcgagattgcttcggacctcctggccgccttcaaagccaatctggaggctcccttcaagctcctgctctgatcctggtccctcctcttgcgctgcagcaccctccttgatgtgtgcgtcgcagccgcacccaggcagccccgcaaccgtgctcgagtctgcgcacagttcccttgccgtgcccagtatgatggtttccacatgttgacatgcacacatactctcaaaattgagggcagacgcctcgttcaacaacaaagatcctgtgcagcgagcatgatcaagcggcgcgacaggcatgacaagatgaggggagagggtggccggtattggcaccctcccaaaaagcagcacgcgagacatgcggtgtgctgcggtagaagagaagttaaaaacctgggggagtttgtcctatggtccttagcccggcgacgctcattgacaggaggctgcggagggtttcatccctcagtcatcgtcctccacactcgccgtcacccgcctgccccccttggacttcttcgccaccaatcccaccagtgagccctgttggcagtgggggtggaaagtcagggctgagatgagacaggctgagccccacccttaggaatgcggtgacctggcggggaagatcccttcccactgggccccacacgatgcagacagcattgggagcatgggaggaatctgacctgtcgcccgtcctcccgacactccacacacaagcagcacgcaccacagtgttgtagaagttgttccaggccatgaagatcatgaggcagcccgctaggaagaagccgcggttgccccacaggtcgtcatccctgttctccagattctggagcagggagagcagggagatgaggtggcagcgagttgcttgtgccaaatcaccaggcgtccctgatgtaccatgtagccaatcacatacaaacagaacttgtgatgcctatcctatggctctgcccagcggcgctctgtatcatgccttgatgcctctgatgtcactaaagccagcactccctccccgcccgaccctcaccaggtagccctcggtccgaagcatggcccagtaggagtgcttgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaccatctgggtgcttgaaggatggggtagtggcgggctatcgtcatccccagcatgcaccgcagnnnnnnnnnncgaccatctgggtgcttgaaggatggggtggcggcaggctatcgtcatccccagcatgcaccgcagnnnnnnnnnntcctctgatgtcaccaaagccagcactccctccacgcccgaccctcaccagatagccctcggttcgaagcatggcccagtaggagtgcttgatcatgacgccgcccaggtacacttgcaggccctgttgaagaaagcagggcaaggggcaatgccttgagtggtgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccagtggtcctgaacaacacctggcacgcgtcgggccagtagattcccatagcccttcgagtcacacaaggccaaagcgcgccagaaggctggcccggcaccaagaaattcccatcgagatccacaaatcctgcccccattcaacccccctccacacacgcacctgcagcaggaagaggagcgggtagaggaagaccagctggccgtgggcccccacgccgtcccccgccacgacatccatcgtggagttcttgcccagcgcgatgcgggtgtacatgcgccggcgctggtacctgtgcgcggcgtgggagggggaggcctgggtctgggccggagggtgggtgtggcacacaccgctgtgccctgcagtggagctctcacatggcactgacacactctgatcagcggctctgccttgagacctcgcacgccgcctgcgcctggcctgcgcggccatcgccaatttcccctcgtccagaacacgccctggacgtgaccagccatccaggcaggcactcccccaggccaaggcaccagcccccaccctcctgcaccccacctgttctgggtcaggatgacgacgctctgcagcatgggccaccagaggaagccgttgatggccttgcggaaggtgggcgagtcgacggggagggagaggaggaggcaggaggtccccgccgcccagtagtggtggtggatccaccagggccggatgtgcgacccattcagcttgagcaccgactcacgcagtgccgaggcgacgtagtagaagagcatccagcagacaaagagctggacgcccaccagcaggacgggggccattgacacgccgtcccgcgactccgacagcgcctgggtgcggcgcaggccccactgcagcactgcggcgaaggcaaacatggtgtaggcggaacggttgcggaagcggtggtagtccaccttcatctgctggctctggtccttgcgcagggccaccacgttgctgctgggccccagcagcaggctcagcacgtagggctgccgcgtcttggcgtagcgccgcctgcgtggatttgggcatgggtttgagtctggtcggggggattcatgagtggctccaggacggcagtgggaaggaccgggtggcgcaggggcggggcgagagcaggagggtnnnnnnnnnncatttgggcatgggttagagtctggtcggggggattcatgagaggctccaggacggcagtgggaaggaccgggcggcgcaggggcggggcgagagcaggagggtgtgcgcagagcaaagggttcagggagcagacatgggacccaagcatcaagagtaaagccaagcccaactaccgcaagcctgctgctcaggaccatcacccgctgccccatccatcgtctgctcacaggtcgccggcggggccattgccatgcagcacgccctgcgccctctccagctgattcaccacctcctcccagcggtcgtctgactggagggccacccgggcggcctgcaggtcccgcttcagggcacgggacacgccaaccacctcctctgccagggcatcgctctcgctgatgacccgctgattgtacccgcgggcgcgactgctcaggttccggctgtgatggggatgtgaggcagtggatggtaaggtccgaacctcatcccaactcggcgggtggcatggagggcgcgcacgccgatggacccactcacgtctgggtgaggagcaagtccgccttatgagaagccgactccagcgcctgtgcaggaagatcgagagatgcgcaagccattataatcttctaatgatttcaggcgttgcaccacagaggtaaccctcaaaccactcacggggtcggtcatgtcgacctgggactggcgccaggcgcaagggggtgctgttcgtggacaaggaccactcaaacccagattggagttcgcttgagaatgcaccagacacggttttgcggtggtcatgcagcctcttctcgttgccaaaccgatctcgcaacagggaacccactgctcggaagggctggtgacgtgnnnnnnnnnntacactgttctgcagtggtcatgcggcctcttctcgttgctaaaccgatctcgcaacagggaaacccactgctcggaagggctggtgacgtggctgatgggggcaggctggctggtgcggtcccattagagtctccaggcaccgacagaattgagatgcctgcatgtaaacctgctctcaggctctcagccagtcatctgccctgcatgtggtcctttggtcctattctgtggggaagggaaaggttcatatggcccttcggtactggnnnnnnnnnngagccagtcatctgccctgcatgtggtcgtttggtcctattctgtgggggaaaggaaaggttcatatggcccttcggtactggctgctggcttcatgcccccctgcatcagcccacacccctgatctgccagcttgcccagatgtgtgtaaaccccacagaaactctctgaccgatacgcagtttaccgacaattcagctttgtcgcatacccaatcttacgatggtatccacgcaagtattgtcgaaagcagccagcttcgtcggcgctctgcgggagcatggcgtcgtccgtaccttgtcagtgcccaccgtccgccagtcccggcgctgccagtccggcaaggcggggaccaatctacctgtaaagcatgccatgacctccaggagcatgaacgtggttgccgcatccggcaatggggccacagctcccagcgccggcctgcccatcgacctgcgtggtgggtgccgcgatactgttgaagggcatgcagttctctgtagagcccctcttctacatgccatgtacgattatattgcctccccttgcaacggcgcagggaagaaggcgttcatcgcgggtgtcgccgacgaccaggtgcccagatcacttggacgctgcacccggcctgttggtgccagctgatccccgccttgcctcaagaacatcgaactgacaccaacaatccctttcctgcgccagggtttcggctgggccatcgccaagcagctggcggaggcgggggccgagatctccctcggtgtctgggtgcctgccctgaacatctttgagagcagctaccgccgtgggaagtttgacgccaaccgcaagctggccaacggcagcctgctggagtttgcccacatatatcccatggatgccgtgtttgacacccccgaggacgtcccgcccgaggtgtggggccttcttggaatggcttgaccgcaccttgcattccacaggactcccaacttcccctccactggggaagtttctcaagcagcacagatcgccccccgtttcctctgccatatacccccgggggaccctgcatcgctgcacgcagctcgnnnnnnnnnnactcgaccgcaccttgcattccacaggactcccgacttcccctccactgggaaagtttctgaagcagcacagatcgcccccccgtttcctctgccatatacccctgggggaccctgcatcgctgcacacagctcgtgccaggcctatgctgcatgcatgcctgccgccccatgcctgcgcacctggaacctcaccgccccattgtgctccaaacccttcccctccccccttatctttaacccccaccaccccaccaccccatccccaccccagatcgccgagaacaagcgctacgccgggaacgaggggtacaccgtgtcggaagccgccgagaagctggcccgcgacgtgggcaagatcgacatcctggtgcactccctggccaacggccccgaggtccagaagccgctgctggagaccagccggcgcggctacctggccgccctctccgcctcctcctactccctcatctccatgctccagcgcttcggcccgctgctcaaccccggcggcgcggtcatctcgctgacctacctggccggcgcgcgcgtcatccccggctacggcggcggcatgagctccgccaaggccgcgctggagtccgacaccaaggtccttgcctttgaggcggggcgcaagtggaacgtgcgcgtgaacaccatctcagcgggccccctgggctcgcgcgcggccaaggccatcggcttcatcgacgacatgatcaggtgagattctgtcttgggaggacggggtctgtactgcttggtggcttgcggctgcggtgtgtcggtttgtgcggggactgtatgggcttgccacaaggatgtgggggggggggggggggaggcccccccccccccccccccnnnnnnnnnncaagtgggcttgccacaaggaagtggggtggggggtgggggtgtgaatgctccctctcccacctgccgctccaggggaaggctcctcgctccaacaaccggtcgcttgcccggcctgtgccgattctttcattccatctcgaaggggcacccacctccaccgccacctccaccgccaccaccacccacatacaaccccctcaacatccctaaatgaacaaacccgcaggtactcgtacgagaatgcgcccatccag

SEQ ID NO: 36038 - DNA, 62 bp, Chlorella protothecoides
ctggaggcacaacgtgagttagtggagttttgtcctgcagcctcatcctgtcgatgctgctg

SEQ ID NO: 36039 - DNA, 106 bp, Chlorella protothecoides
ttgctgaggggagaaagcgtgaatagctcgacgtgagtagttgcggtttggagtggcagtatgggatgaacctcgtagctggcttggcaagggagcagatttgaga

SEQ ID NO: 36040 - DNA, 61 bp, Chlorella protothecoides
atgtcaggctgggctacacttgccattgacaatcagcacgcagggtggtttatgccctgcg

SEQ ID NO: 36041 - DNA, 61 bp, Chlorella protothecoides
gatctcggccacgcgcgcgccaaagggcgcaggcggcggccggatcagggaccacagcgcc

SEQ ID NO: 36042 - DNA, 80 bp, Chlorella protothecoides
ccaggtgaagacgtttggttgctgctgctgctgttgttgttgtgtatttgttttgaggggggtggggtgttgttgtgtgg

SEQ ID NO: 36043 - DNA, 70 bp, Chlorella protothecoides
ccacggacatcccccctcaaatattgtcaagtaagccttctctagatcttaacatgcttgttcgcgatgc

SEQ ID NO: 36044 - DNA, 211 bp, Chlorella protothecoides
gtgccagggaggaaagaagggaaatccggggtggaaagggtgggaatggacttcatcctggttgattccatggatggcagggtggcaaagcatgggtgctgggcgaagaggtctgtcgaggggcttccatgtgtcgtagctatactccacctgccgcacgcccctcaccccccacgcccaccccctccacaaatgcagagctgtcgacgga

SEQ ID NO: 36045 - DNA, 119 bp, Chlorella protothecoides
ccttcgcaggaccctgcgcggcgctggacgctcgactcggtgctgcggcacccctgggcgaggggcggtggcccaggtcccgtcgagcaggacggcgcccaccctttctcgccgctcca

SEQ ID NO: 36046 - DNA, 104 bp, Chlorella protothecoides
gtagagctgatcctgctcttccttctttcatataaagtggcgacccagcgaactcccccactccgtataggggctggcggcgatcaggcacgtggctgtacaag

SEQ ID NO: 36047 - DNA, 79 bp, Chlorella protothecoides
atgcgcccggcgcggaacccgatggaggtcttgggccggaccggccgtgaaccgcccttcatgccctcggcgctggctg

SEQ ID NO: 36048 - DNA, 98 bp, Chlorella protothecoides
ccccccctcccccaggcagccgcgccccccaggcctgcccacctgacaggacaagaatggtggacaggccgccgtcctttccaaaggctatgtcggtg

SEQ ID NO: 36049 - DNA, 61 bp, Chlorella protothecoides
gcccgtcctcggcttccttgtcctcgccgcactcgccgtgcgtggggctgccgtcctcccc

SEQ ID NO: 36050 - DNA, 72 bp, Chlorella protothecoides
ctttgcgcagagcgtcgcctccaccgacgactcccagcgccagcctgaagagttctgcggggccaaggtggt

SEQ ID NO: 36051 - DNA, 74 bp, Chlorella protothecoides
atactacgagtgagtcacagagggggggggggaagtgaggttcgttggcatggcaccggggcgaggtcgcataa

SEQ ID NO: 36052 - DNA, 69 bp, Chlorella protothecoides
gcggcagacagcaatggcaatatcggctcccgcaacagaggcaagaacaactttggcaccaacaacgtc

SEQ ID NO: 36053 - DNA, 1585 bp, Chlorella protothecoides
  modified_base (99)..(108): a, c, t, g, unknown or other
  modified_base (560)..(569): a, c, t, g, unknown or other
cctgttcagtgtggatgtggaggacgtggaagaagcggtggtggacgagtccctcctggtgcgtgtctgcccatcggctggggctgggtggcctgccannnnnnnnnnagccggtcgggactgcggaggacgacgactcctccagtgatgccacccgccagacgttctccagcctgttcagtgtggatgtggaggacgtggaggaagcggtggtggacgagtcccttctggtgcgtgtaggcccatcggctggggctgggtggcctgccatgctatgggctgggtgccctgcttggtggcgtgtcgccctccatcatcatacctttgtgttttcccctctcctccagcaccctgcgtgtcccgccgcacacgccctcctccccaggtctgcctctctattgcaccctgcgcagaattgccctcctctcaccccaccccctttcatagacccctcctgccctgaccacccctcctccccgacccccacccctcccctcacatacaccttaaacccccccctccctgctcccgcgcgcagctggtcaactgcgggctgtctnnnnnnnnnntgcccccaacccccaccactcccctcacatacaccttaaactcccccctccatgctctcgcgcgcagctggtcaactgcgggctgtctgacgtgacggtgaaggcgctggaggcgcgcggcatccgctccatgttccccgtccagaagcgtgtttttgagccggccatggccgggcaggatctgatcgcgcgcgcacgcacggggtccggcaagaccctggccttcgcgctgccggtggcggagaagatcatggcggagcgcggcggcgcggaggggcgcgcgcgcggacgcgcgccgctgtgcgtggtgctggccccgacgcgcgagctggcgacgcaggtggagcgcgagttcgcgtcggtggcgcctcgcttggccacagcctgcctgtacggcggcgcgcccgcggaggcgcagcgccgcgcgctgcgcgcgggcgtggacgtggtggtgggcacgcccggccgcgtcatcgacctggtggagcagggcgccctggacctgacccaggtgcgcttcgccatcctggatgaggccgaccagatgctggccatcgggttcgcggaggacacggagcgcatcctgggctacgcgccgcgcgagcgccagaccatgctcttctccgccaccacccccgcctggatcaagaagctggtggcctcccacctccgcgcccccgtcaacatcgacctgattgggcagggggccagcgggaagctggcagagtccatcaccgcccacgccatccaggtggcgcccgaggtgcggcgcagcgtgctggtcgacgtgctcacagtttacggcgcgggcgggaagagcatcgtgttcacgcagaccaagcgtgaggctgacgaggtggccgcgggcgtgtcctcccacctcccctgctctgtgagtttagactttgtctgatgttttcttggggtggggtggggacctagctgggttgggtggcgttggtccctcgtgcatgcaggggaatgcgagggtggggacggggcggcaatgctcgcac

SEQ ID NO: 36054 - DNA, 61 bp, Chlorella protothecoides
aaggaagcacaggctcgcatgccaaacgccaccttggtccagatgaagatgctgccgctgc

SEQ ID NO: 36055 - DNA, 70 bp, Chlorella protothecoides
attccaaggcatgtgcccaccactttgaccagtccccaaaattcctctgagtagacggcaccccccctgc

SEQ ID NO: 36056 - DNA, 112 bp, Chlorella protothecoides
ggatctgctgacttgatgactcgattgggcagcgtcgacactgcggcggccagaccagcttccagagttgcagcacccagggaccctcaccctgaaggcctggggacgtctt

SEQ ID NO: 36057 - DNA, 5653 bp, Chlorella protothecoides
  modified_base (819)..(828): a, c, t, g, unknown or other
  modified_base (973)..(982): a, c, t, g, unknown or other
  modified_base (2213)..(2222): a, c, t, g, unknown or other
  modified_base (2894)..(2903): a, c, t, g, unknown or other
  modified_base (3105)..(3114): a, c, t, g, unknown or other
  modified_base (3210)..(3219): a, c, t, g, unknown or other
  modified_base (4252)..(4261): a, c, t, g, unknown or other
  modified_base (4564)..(4573): a, c, t, g, unknown or other
  modified_base (4795)..(4804): a, c, t, g, unknown or other
  modified_base (5553)..(5562): a, c, t, g, unknown or other
cgggcggcgtgcgccccgacgccacgctttcctcgcccgccgacccgccacgcgccagggtggacgcttcggcggccagcgctccggcgcgcctcgcccccgacgccgcgcggcgcctggacctcgaagacagcgaggcggtggatgaggcacggcgcgcgagcggcgaggccagcgaccgcagcgaggccagcgaccgcagcgaggccacgctgctcgcactgtccctgggggaaaaccaggcagacgagggaagtgaccaaggtcctgcgcctgcgcagcccgcaggcgacctggatgtcgacgaggcgccagacccaggtggcagcccgctccggcaggcggggtcctcggccgtggacatcccgcgcccgcggcggcctggcggctcccgcgacggctcgccagagggcaaggtgcgtgactgtgtggtagcatgcagagagaaacggggcatgcaggcatcgccaggcgtgggacgttgcgcattacaatcgttgctgtgggaatcggcaacggcagacacacacatccctcaagcaccactctctcccgacgcacacagtctgcggggcgggaggccggcgccgcggtctccgccctctccaccgccctgtcgcgcgccgacagcggcggcgccgcccgcctcggccggctcgaccgcgtgcagctgtcgctctgcctgcctcacctggcgccgggcatgcccgggcacatcgtggcggagctgtttgagaggtggtgtggtgggtctgtgtgttctttgccctttcctgggcttgcgttcccaaacatacatgctctccaccgcacgaggcnnnnnnnnnncctgtgtgtttttcgccctttcctgggcttgcattcacaaacatacatgctctccaccgcacgaggcctgtggagtgaaggccactcgcgcatccactcgctgtgttcgtgccgttccttttcacatccccaccccacacgtgcnnnnnnnnnntcactcgcgcatcccgtcgctgtgtttgtgccattccttttcacatccccaccccccacgtgctgacgcgtcgcgcgtgcctcccaccacctcgccacgcaggcaccgcgtgtcggccgaggacatggtggcggcccccgacgcactgctggcctcgcccgacctcgcgtgccgcgtgggtcagaccgtgtacccctggcccgcggccctgcccctgctggtggccctggtttcttttggccccgacgcggcccagcacgtgcacgacgcgctgccggcggcgggccagacctggcccatcctggacccgatcgcgacggggcggggctccggcggggaggcggacggggaggagggcacctcgccccggatgcggggcggcagccccggcgggcgctggcgctcctggctctcgctgtcctggggcgggcggtcggggaggtcgcggggcgccagccccgcgccccgcgacccgggcgccgggccggagggggagggcccggcggggggcgggccctccgccaggccggtggaggagagggatgctggcccggagcgtgtgacccctgagcaggcatgctttcttttgtttctttgggggtgggagagggggcgttccgtccacagggacagcctgccagtcagggcgctcgccctcctgcacgcatctccagatgcgcagggctccgggcagcgtcgtgtgcctgccaccccagcctgtgacgctgcttgccctcctccctcgcttctcgtccacaggaacaggcactcctggagcagctggccaagggggagggcccggcctccatccaggtgcgcatggaacccaccgtcgagattgcggggccggatgcgccatgattggcatgcgtggaacgcagctgcgcgccccgctcccgctctcgaccgcacccacccccgcccatcccttcctctccgccgccaggtcacggatgtggagggcctgcacaccggccccggcggcgagcggtttgtcatcctgcgcaagcgggccttcgtgcccacccagctccagctgtccagtctgagcccgctgctgaaggagggcaggaacaccatcctcttccgattcggcaagcaggagctccacggtgagggggggggtgcccggggggggtgggggggcacagaggggcaccgcctgccgcgcgccgatggcacccacgcagcccacccgatctccagcaatcctctcggcccatccccgctnnnnnnnnnnctttggcaagcaggagctccacggtgagaggggggtgcctggggagtcgggggggcacagaggtgcaccgccagccgcgcgccgatcgcacccatgcagcacaccagagctccagcaatcctctcggcccatccccgctccctccccttcagcctacgtctacctcatgccgtggagcacgcggctcgtcatctccgacatcgacgggaccatcacgaagagcgacgtcctggggcacctgggcgccctcctcggctatggtgagtgacgcgagggtgtagaaagggggagagggagggtcgaggggggcgtcgatcgtcttggggtgatggtgcagccagacggcagccagtctgcacagaacagaggcacgggaagcatgtgtgctcggcaaaggactggctcgtctgggacccgccttgcatgtagatgctgtcctcaggtgccggtgcccctgatcgctgcccaaacccaccccatttccgatgctctgctttccaccacgccgccagactggacgcatgcggggatcacacacctgttctctgccatcaagagcaaccactacaacttcctgttcttgtcgtcaagatccatcgcccaggtagaccttgccagctagatgagccagggctcgcggctgggtgccgcaggatccttgctcccagcacnnnnnnnnnntttggggtgatggtgcagccagacagcagccagtctgcacagaagagaggcacgggaagcatgtgtgctcggccagggactggctcgtctgggaccctccttgcatgcagatgctgtcctcaggtgccagcgcccctgatcgctgcccaaacccaccccatctccgatgccctgctttccaccacgccgccagactggacgnnnnnnnnnnaaactcagttcccaccccttccctgccaggcctccattacacgtgattacctccacagtctgatagaaaacgggaccaccatgccagacgggcctnnnnnnnnnngacctcaattcccaccccttccctgccaggcctccatcacacgtgattacctccacagtctgattgaaaacgggaccaccatgccagacgggcctgtcatcatctccccagacggcctcttcccatccctgtaccgtgaggtgactcgcctgagggcgctggcctggagcttggtcttgcacagtgggagcaggggggggtccgaggcttgccaagccccctgtggcgctgaatgcaggtgcagtgcctccgcgcctggccgcctgtcaggatcgacagacccactcgcgcctgccatgcctgcaggtgatcctgcggcgcccccacgagttcaagatccggtgcctcgaggacatccgctcgctcttccccccggactggaacccgttctacgccgggtttgggaaccgggatacggacgagatctcgtacctggccgtgggcgtcccaccctcccgaatcttcatcatcaaccccaagggtgcgctggggctgggacaggcatcagacctgggctcggtggtttgcatgccatggtcgaagtggcttcactctgccttcctgagcttcgggatgatccacggcacatctcacagtggctaatcagagggacggcgcatggctgctcctgccattcgagcgtcacagtgcacgcttcggtgcttttgtccgatcccctcccacccacccaaccctcccaccaggcgagctccggaaggcctcctcggtggtgcgcacctccacctggtccaccctttcttccctgagccgactcgtggacgacatgttcccggcgctgaaggcgccgaccctccaggatccttctgctggcacccaggtgcttggagtttggggggaaggtgctggaggacggaaattggcctgctacagagcaggggcccctgcatgctcagcagatcccacatggtctctacagatcatgctctcgtggggtctctgctgccgcctgcctgcttttctcattcatcctttaccctcgcccccgcagcgcgaggagttttctgattacctnnnnnnnnnntggagcaagggcccctgtatcctcagcagatcccacactgggcatgttctctacaaatcatgctctcgtggggtctctgctgccacctgcttgcttttctcattcatcctttaccctcgctcccgcagcgcgaggagttttctgattacctctactggcgggtgcaaccccccatcaccatcgggtgggtcgggtggcgagacctgccagtgcgtgatgtactacgcctggagctggcagacagcgcctgctgtggcagacggatgccagcctgatgcctttgcactgccagttggtatccgnnnnnnnnnnatgatgtactatgcctggagctggcagacagcgcctgctatggcagacggatgccagcatgatgcctttgcactgccagttggtatccgtcacatgtacacgattctccactcgtctgtgtggtgcaggtacaccgaccccccgcaccagccgccgcacccgcccagtcgtttccacacaccctgtccatgttgcaggtcagaggacgaggagttcgatgannnnnnnnnngtcgtctgtgtggtgtgagtacaccacccccccgccaccagccgccgcacccgcccagtcctttccacgcaccctgtccatattgcaggtcagaggacgaggagttcgatgacgcatacagccccaccaccgacagcagcgagggcagtggaagcagcgccagtagccacgacggcggggatgggggcggcattcccacgcggtgaccgacgccgcgggggccctgctcggcgtgattggccctgcctgggcgcccatgcctctgcctttttggccgcagcctgcctttgctcaaagtgtaaaattatgggtaatacaaaggtatggcctggggcacatgagtaagggtggagcacgcagcaaatcaggaaaggatgcatttactagtagtcagcacaggacaaagttcacacgggtgagcgcgtcgtgacggcgggagcccctgcctggtcaattcgtttcgttcgattgggagggggcccggtagctggcgcccctcagaggaaaacggtgcaaaaaattccgtcctgggctgttcgccccggtcatggcctggcggcgtgcggctggagctgcacgtcacacagcgtgtggcccagctggcgcgccaggctctccagctgctgccgcacggccgcggcgtcaggctgcgacggggcctgggcccaggcctccgtctcgggccggtgcaaggcgccggccgtccagggccgggcgagcggctgcgccggcgcgtaggcgggccgcgnnnnnnnnnnccctgggcccaggcctgcgtctcgggccagtgcgaggcgccgcccgtccagggccgggcgggcggctgcgccggcgcgtaggcgggccgcg

SEQ ID NO: 36058 - DNA, 75 bp, Chlorella protothecoides
cccagcatgagcccaaagtcaccatgggtgcggaggaaaaaccagacatgttcaatgacgggcaatcaacagcag

SEQ ID NO: 36059 - DNA, 72 bp, Chlorella protothecoides
gagtcgtgggatgtgaagagtgggcatcattcaagttccccacccaacccctcttcctgccaaactgtgcag

SEQ ID NO: 36060 - DNA, 72 bp, Chlorella protothecoides
ggggctgccccaggggccaaaggcgtgctcgcatgttcctacagcttggcgctgggctctgccgcggcatcc

SEQ ID NO: 36061 - DNA, 137 bp, Chlorella protothecoides
ccccactcgcccagcccggtgtttgccacgcgcgtgagcgcggcgtgcacgtcgtggatggcgcccccgctgggctcggtccacccgcgcactcggcagaagtccatgttgcactggagggccatgagggtccacac

SEQ ID NO: 36062 - DNA, 90 bp, Chlorella protothecoides
gggggagggaggcgggaggcgagcgacgccacaccccgcggcgaccagaatgccccgtcgtcgacatcactgtcagaaagcgcggcggcg

SEQ ID NO: 36063 - DNA, 179 bp, Chlorella protothecoides
gagccatgcactcccggactgcatgctgaccgggagattaccgacacatctcgagttcactcgaaagaaacaatgggtgttccgtttggggtccgaaacctccgacgcgtgcttttgctgggagtcgctggttccggcgcggggaaggatggtgggccggaggagccaacccactccgg

SEQ ID NO: 36064 - DNA, 65 bp, Chlorella protothecoides
ggttcatcgcatttttgtgaccccccccccaaaaaaaaagaaacttccaatacccctcatcaaaa

SEQ ID NO: 36065 - DNA, 80 bp, Chlorella protothecoides
ctccagcccacaatttcccaccccaccccaccccaccccaccgcccagaatcaaacctgtaggagggtctggtagaactc

SEQ ID NO: 36066 - DNA, 158 bp, Chlorella protothecoides
caccatcatcgagcgcatcgtggaggacgtgtccttcgaggccccggagctggtgcgcgcggggtgggtgggtggagggaaatgcgtgagggatgcccttgatggggtgggggggggctcgtctggtggggcccccagagaggagggaggtcagggcg

SEQ ID NO: 36067 - DNA, 197 bp, Chlorella protothecoides
cagatgcagtcgacaaaggcatatgaaacaaagaggaacgcatggcatcctcagtaccgtccaccatagccaccaccgccgccaccaaacctgcagtacagcacgggaggcgagtggttcagaggcatggcgtccgcacagcagaacagcgcagtgaagaaggcaagcgctggatgtcaggacagtggctgctcagg

SEQ ID NO: 36068 - DNA, 61 bp, Chlorella protothecoides
cccaccgctgtgagtgccgatcgaggctgccccagcaaatctgtcacaagttacatgatac

SEQ ID NO: 36069 - DNA, 132 bp, Chlorella protothecoides
gcccatcctgcagcgccttgtgggctctgcacagggctggttcaaccgcagggcatgactgctcaggcgtgcgcatgcactgctcaggactgaccgccgcgctacgccctgctcgtatggtatgatgcacca

SEQ ID NO: 36070 - DNA, 210 bp, Chlorella protothecoides
gcagagggcggatgttgcgatgatgccgtgcgctggaacccctgggtgcggccattgcactctttgctgatgaagcccagtagcagccgggcctggtctgaggggagggcctaaccggtaggccccaacaccgtaaacatcatcccgtccttctcccccaagccctcccatccccgcccacctctcctcgaccgccacaggcgtcgtacg

SEQ ID NO: 36071 - DNA, 61 bp, Chlorella protothecoides
cccaccctcctacaaccattatttacacccgcccccctcctccctcccgctgcagctccca

SEQ ID NO: 36072 - DNA, 106 bp, Chlorella protothecoides
ccaggaatgcgctgcggcccgtgctgaggtgtcgcggctgaccgccgcgctggccgcccgtgacgctgacttggagaagctgcgcgccgagctggccgcctctcag

SEQ ID NO: 36073 - DNA, 61 bp, Chlorella protothecoides
cagcacgcggtcgcccttggcgatcagcgatgtgatgcgccctgaagtccattgggaggag

SEQ ID NO: 36074 - DNA, 130 bp, Chlorella protothecoides
cctgctgaagactcctgcggagaaggctgcagcagccaaaaaggccgccgaggaggaggcttccgtcgctgcgtctgcctgatgggcggccccagctccttttacccctggagcatggccgtcggcgtcc

SEQ ID NO: 36075 - DNA, 61 bp, Chlorella protothecoides
ctgggccgaccagttgcccacgccgacgacggtagtcatgcccgggggggggcggaactgc

SEQ ID NO: 36076 - DNA, 73 bp, Chlorella protothecoides
gcggcgcagcaagcgcggtggtgaccacggtgagacgtatcgtttccccgcccggcgctggctgggggatcgc

SEQ ID NO: 36077 - DNA, 27869 bp, Chlorella protothecoides
  modified_base (671)..(680): a, c, t, g, unknown or other
  modified_base (2464)..(2473): a, c, t, g, unknown or other
  modified_base (2626)..(2834): a, c, t, g, unknown or other
  modified_base (3131)..(3140): a, c, t, g, unknown or other
  modified_base (3305)..(3314): a, c, t, g, unknown or other
  modified_base (3622)..(3631): a, c, t, g, unknown or other
  modified_base (20837)..(20882): a, c, t, g, unknown or other
  modified_base (21977)..(22017): a, c, t, g, unknown or other
cggagaaggagactcctcggggctggggcttggggtcggagacggctcggggctggggccggggatcggggaagttactgggctggagctgggagatggggaaggcgcagggctggggctggaggtcggggagagttcagggctaagagatggagatgcttgggggctggaggtggggctgggacttgggctgggacttgggctgggttctccaccgggagagggactaggagttggccctgggctgggggagccctctggagttggcgatccgccagacggtgcaggtgaagcgatcgtggtgttcccagatgattgagcacctgtggttcctgaagcagatcctgttatgatctgggtaatcccattggcttccgatgtactgctgcccgaagcctgtgggattggacaggagccaaggtatgtattgcacgagtttaattcctaaaggacacctcacgaacacaccattgatcatgaatcgcagctcaccgtagccccagtttcgtccgcagcagctgcgccagatccttcggcgctcacaggcccaggctgggacgactctgagaatgcattgtagttcgattcggccagtctgccaggacctgctgcaactccagagaagctgccggatgtctgagccgtgaaactgccatcgctctccgcctgcnnnnnnnnnnggatgtagtaggcatgaagtgtggagcaaatcagatgccgaaaatgatcgtgcctcgattaaaaacacattgacacagaaggagattatgatgagcgcatacacccttcaaggtgtgtgctcttgccgccgaaacttaccgatccacttccgaacccgtcgatgctcgatccgcttccactggtggtggcctccaatcccgcctcggctagcgcattgttgccggaggccgaccccgcgacttgtccggatgcgctgtagcctgagtctgtggttgccgaacccgaaccctccaccgtgccatccgatgcaccggcaaggctgacggctcccaaaagctttctgcgccgctgaccgagaatcgatggtgctttattcttgttgatacagtggcatccgcgactctcaacacataccctactaggccgcatcggccgctccatgctcgaatcgccatcgaccaatgacacggaaagtgagggatttaggtcgcttccctcaacaagctctgtcctgttacccactcacctagacaagaccgattttcccgaggtcggtgccgcaaggagcaggcatgccatgatgagggccagggacccatggtacatcatggtgactgctaatgagtggcaccacagatgcaatagaccaaactcgtaaatacttttgcattctacgccctgttggaaagtgcatgcatggtacatcacgactttggaatccggaaaccgacgatctgggacaacgtgagaagcccgcatgggacttgccaagtccgcgccagcaagatcacgaataccgtgatgccggtcgaacgccgtaccctagccccgtcgccgcacgcatgccgaatccaagggggacttgacttggacctctggatctgacgatcacacatgtctaggtccgacaggacgtccttgaagttataagattcgcaatccgctatcttgacggtactagctggctgtcggactccggtctgggtgtagcttctaccaaaggcgacacagcttcagggtgggtagctgagcagggctgttctcctccttttgcagaccactcttacgtatcactttccaaggcactgtatcggcgatacgaatgataaaccaaagctcaatcggggcatgatccggcagaagatgcgccggggaccgcgacacctgccaggatcatgtcggatccgtgagaacgagggtgcggagtggcaagagagcggcatgactctgtactacttgcgattctacctgctagaaaactgaacgtgataggcacacgaattatacctgccattctggtgaagggtgcttgcagcgcacctaatctccgagaaacttcacagggctacgcaatcttcgtattctggcgggcagttagatcgagcgcgagctttgtatgccgagccaggcgcggcgagggtatgcgtgacttaagacctcaacactcccgtcatgcaacctcagaatgaggggagggtcaccacgatatcgcgacttcaagtccaagtgctgcctgcctgctttccgtgctggggatgagaatatcacaagattcttcatcttgcgatctgatagtacagcttagagcatccacaaggggcagccactcagagtgggagtgctggagacacatgtacactcgcctgaggggcggggatccctcctcgcatgatcacactgaccagagaccacactctaacctggaggcaagcagccctcccgcgcggctcctgacctgctgttgtgggggcaggctggcccccacaacggtggaccgctgtannnnnnnnnnattgaggtgcgggtgatcgttgtgaatggaagcaccactgcgaagaagggacgagatccaggtgtgccgggtatcccaccctacccacccctcttctcaccttgcttggggttagtgttgtggggggcgggttagaccctacaatgtggactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtactacttctacggtcgcccctcagctgtgagtgttgagatatgggcctttgatggctcttgttgtggagggatggcaagcccccacaacggtggaccgctgtatatgacctgaaataggaattgtacaggtggaccccgaatgcagtgtgatggtcgggtttcataggcttcacaaagcggcgtggactcggtgcagagcgggaaaaggtgtaaagtgggggaaagggcccggtcaagggaaccccccacaacagctctggtcggtatgtaggtatggccggaagactgatgnnnnnnnnnntggcataggcgcggcacagggcacggttgcaggtggaaaggggggaagactccggagagggggcccccacaacacaggcctgcggtatctaggagctgggcgagcccagtgtgctacttctacgatggccccttagctgtgagtgttgagatatgggcctttgannnnnnnnnntgtagcgctactctggagtgtgcaagggcagctgggaagcagcaaccggtgcacaggagatccctgctggtgagatctgagaatctgggacccatgctgctgggaacatggttgccctacgctgaccagcaccacatacagggatgtagagtgtaaaagtccatgctcatcggtatgtcaaatcattacggatggtgaacagctccatcttcaccggccagatgtcatgacatgccatccttgtcatagtccttgcaaacactgtcagtgagcttgtggcctgagaacgccctggagtcagtatcccnnnnnnnnnntaggtgtaaaatgggggagagggcccgggcaagggaacccccccacaacagctctggtcgacgccggtatgtaggtatggccggaagactgatgtacatcggccagcttccatccttgtgctcccgtgcggtcggcaggggcatgcccctctatcttgtcctccgctcaaatttcccatgcctagccctgggtgaatacaggcttgcatgtgaccagtaggcttgacaatggcaacctatcgttatcataatgtggtacgaccaatgcgacagccagcaatggcaactgctatgtggcagcatggagcatgccaaccgccatgagagatatgaacatgtcttgatctcatgctggttttattccgtagcgctaccctggagtgtgcaagggcagctgggcagcagtgagtggaataggggagatcccagctggtgagatctgagaaactggggtccatactgctggcaacgtgggtgccctacgctgaccagcaccacaaaatgggatgtaaaatgtaaaagtccatgctcatccacacgtcaaatcattacggatggtgaacagatccatcttgtcaggccagacttcatgaaataccatccttgttatagtccttgcaaacactgccaatgagcttgcggcctgagaacgccctgaaatcagcatcccctgagaagtcttccgattccccatcattcaccactcaccacaatcttcgagtctctgtatagcctggtcaaaatgtgagaatgcacgagccgaacccttcctaggtccaggacgtaatgcttccttctccccatggcgtgttcccatgcatcggatttgtgcctcattccttcatgcagcacgactcaagaagaggtcgcacgatcccagtagcaaagcaaggagaggtaggggaccgcacgggaagggcgagagagcccgcactcaacgacaacagcagaaatgggacaagggctggacgatatgcagagcgttgggtaccatctgcgagcatcctcaaccagacctgataagatgagttgggtgggacgtcccctagggtggtaatatcgccgaccttttgggcttgccatgtaatggggccggggggtatggctcctgcaacgggagttcgctcgtcatgcacaacacccttagtccacccgtcccctatgaaccatcccatctctgcctgttccacagtccactcccacctatgacttggaactgacttgccttcccacggcaccatcactatgtgttgcgaccactcacatgacaaccttggaccaagggacacttgccccccctgggtataaatacccaccgacctacgttgtaatggccttgttcctgacagtctgtaggttatgttgcacattgacagagtaaggtcgtacctgaaccattgagaccggaggcagagtgccccaagaaatcgctacctctcccgcccccagggcgaccccgttacagcgcatccatgcacggactgtgctccaccagggcagcggcacgagcgcaccgccctctgggctctccaaattgggctcgcgagtcaaaatcggcatgatagtgtgttttagggctttctggagcaggatgtcgttgcgagcctcccatcgtgtgggactagacgacgaggtgactcttgaaaaggtgcaaagtgcgtcacccttcggcacacagcttctcgacctgtcacggtgcctcagcatgagcaacggggcggtgtacgagaaggggatgagtgagacgtagtttgcactactgccatactcgcaaggatttgagtggaagcgtaaccaggatcgctcgctcgacatgcgcagcacgttcctcctcctttgaaaaacttctgcgctgcggaactcccggccaagataccccatcggtttggccgggatcgcactcgttgaatatgcagagcaaccaccacgatgcgggcgggactgctgcagccagtccttcccctggagtggaggcagcccccgctcaggcgcccggtgtccccgcctccatcccgggcatgctcccgggcatgatgccctttttttcgaacatttcaagcttgagtgaagtgagcggcatcccctcccacctcctcaacaacccggccatggtcctcgcagcgcagcagattgctgcccagcgcttcatccaacaccagtacatgaccgggcagatgacgggcgcctatggccatgccatcggccctcccccctcaggaacggcccctcgaccagctgcagcgcctgcgcagcctcctgcgagtgtgccaagctcccacgcagcccctcagggggccatgcagccacacatgacggcagagcctgcgccgctccgcgccccagcagcccttcccatggcggctgggccgggctccgcccagcccattgccgcaagccctcgcgactaccatccaagcactgcacctgaggcccctgccacacacagcatccccacccctgtgcctgtcccggatcggggctccgccccggcccctgcgatcgagggtgacgcgccccctcgctcgccccgcaccgaccctggcggccggctggtgtgggccaaggtcggagcgtacccctggtggccggcaaaggtgctgacgcggggcagggacctgtcgttccctccgagcgaggagccgccacgccctaacgccgtgcccgtgcgcttcttcggcacccacgacttctcgtggatcgggagcaagcgtgccatcatggactgggaggaggtgaggacgggctggagccggtgaggggcggtgcatgcatgcgccggtgcggggcgtgtgaagcgcggtctccaatggtgtccgtgctcctcctgcaggggcgggagcagtgcctggcagagtgctcccaggagtcgttcctggagtctgtccaggagacgatggcgtaccagcgcacaggtgcgacctggggcgcattgtagggtgtacaccctgtgggtctgggcagcagcgtccctgtcgcactggagcctggacggtgtccacttggctcccagtgcacgccatgtccgcttcttccctcaccccaggcatgctgccggacgcattctacgaggcgcccgcgagtacggggggcaggtccaagcagaaggcgggcaaagcgaggaagtcggagggtgagccaggacttatacgcactctggccccgaactgagcgcctgcacatccatgcccacatgcactttcaccatgttccactcacactctcgcagcggacaagggacaccgagcggcgcttgccggggcttctgggcaagggaccggagggctgatcgagttgtctcctcaggacaggcagctgctggtgtccacgcggcgcaagcaacggctgcaggtcggtgctcacgccattgggcgatgccgtgggtgattactcgggggcgtagcatgtccctctacacactgatggcaatactgtgtgcctggaactcagatgcgagcgtagcctgacactcgatcacttcccgaccttgcagagcatgggcttggtaccccctcctgggtcgccttacaccgacttggtggcgcctaacccagccctgctggcgatacaagggatttgggcagcaggacagagcaccatgcccgctctgccgtatggataccaggctgtacaacaacagatggcatgacacgccatggccatgctttaaatatgtaggtggggcagcaagcacgatggagaaatttcagtcaatgtacacacacagctgctgccacaagactggccgtgggagggggctcaatgacgacttggagcctacgagcaccaagagaggagatgcaatgtgcagaaaccctggctaagggggtgacggctgttgctgcgacaacagagcgggaaccttgagcttcagtttcacagagggcgctttggtgacgacagatgccaggttctgcaggcgttcctacgcacaaagggtgctcaagggaggtgtcacttcgcgatttgactgtgcgcaacgctgctggaaaagtgtttctggccttgctcaagccgagtcacaagcatcgagctcttggcggagctgataagcttctgttcctttggagagtataatgcacagcccatcacttcaatccctgccccccgtccgaaccttggcccgccagagaggtgatgtgcacccggccccagagatctcagtctgctacccatacagcggtgtggctgaaatgctgagcaccaggcaccctacatacccgctctgcgcgtgttgccaaggggatcttgtacatggagtccttcagggagtgggggtccctccgcttctctgtggcatgagggcccaagggcgtcagtggttggcacgcaggaagcataggctctgcttcgaggtcgccgtcctccctgcgatccggagttaaccagtacaaccctggcctgcacagcgcacccgcacctgtgggggtccatgccacgaccaatatgtcaacattagcctctttccccaagtgcgttggctgtttctcccacagtcgcacattcccggagaatgtggcacgctgctcatcgcggacgagcctgtgcctcgtcgtcatggtccgcccgcagaagccttgctggctccgttattcaaagcttttcctaaatcaaattataggggtgctgaggggatgtgagtgagctcaatctacgtgacactgcctaagtgggctggcaaccaaccttgcgggcgtcgccttgaacagtgctcggaaactcacccacgccgacgtgctcattggaaggtataaggcagatcaacctggaatgtgtatgccaaaggctttgactgctcgatggtgtgactggctcgaggttgtcgcggcaatctgcgtcacacatgccgtcgtataccataccctccgagggggacttgagcgcgggcgcgccctataccttcaccatctatgcaaattcgaaatcccaggcgcgcttcaactcgaatggcatcgttccagcgaccacgctcacctcgcatcccgtatttgctcttgcctatgtcatgtcattgtgagcgataattatagaacgtcaatttgcaagtcccccgtcaagcagggttccgaaatcgaggacaagctcgcaaagcctgtcaacctggctgagcactccccctgccacccgccatgtctgggaccggcagcggcacacggccctttggagcacatcgcgggaacatgaaagcacgggatgcgtctgccaggtgcgtgtgaccccacccctgcctcttcacttgttatcacaatgacaccaatctgcagctcccagaccactgtggtgctgccaggacagctctcagcgccttgccccacaggtccacgcacgaccgtggcaaacgccgactgaacgacattggcaacggttccagccatgcacaggatgctgaacctgccccaggcatccccgcagaagaggtacgatacgcatgctgcccatgggtcctgcaaaacacgccttccgcctggccaagcatgcctgtttctccactcgctcgtccctccaggaggaggaacttgccttgcaggatcagatggggtttacagaatactcggcggggcctccccgtctgggctggcttgtgaacctcaacacggtaggcttgcatgccacatgcagtagggcagcacagtgtttacacggaatgatcgtgctgatgagctcgacaggaggccctgcctcgaccatcacctttgtgacctcacgtgtttgcaggttcagacagtggacaagagttctaatgctgcaatcagtgcaatcatgggctacttcctctcccaggtgggctacatgttgggaattgtaaggagaggggtcgtgtggttgatcatcgcccgcaagctgtagtctcacgtccatccgcctcgagttctgagcgctaaattcctgcaatgatcgagaaagatgtccagccgggcgtctgagccaccctgccaccacaatcacccctgtcccccaggatgggaccatgttcaggagtgccttccccttcagcccctacttttacctccacgtcaaggtatgcgattgcttgagtgtgagcctgactttcggtcggcctcccttccatccaatcgggatgctccgcatcttcatgccccttcactctacctctgcaggcggggcaggaggctgaggtggacagctggctgcggcgcaagcatgagggcttgatcctggatactgaactggtggagcgagaggatcttgatctggtgtgtaaggatggcccggctcagaataaggccgaggcacagggatgccgagctgcacaactgtggtgttgtgtgttgggcgctgggcgtctggaagcggggcctgcacccagcagtgatcgtctggcaagacatcaccgcctgcatgctgaccatccgccctgctggcctgaggtggttcggactgcgcgccaaccgccgccccccctcccgctctcaggaaaaccacctgtcgggcgcgaagcgcaccctcctgcgcgtgtctttccgcacccaggatcagctgtccaaggtgggggccaggggggcgcagcgtcgggaaccccagcccgtgcgggccgtggaacgagggatgtcgccccgcccagctcgccctccctcgcacaccgccggtgcctgcaggtccgccgggagctcatgcccatcctctaccgcaacaagtccaagcggggcacagcctcggtggccggcgaggagtcgtcgcggcgctggaacaggaagggccaggtgggtgtcgcgtgccctgcgcccaggatcggagtgcccggcctcgcgggtcttcccctctctgcgccagcctccgcacggcggcgagcccctcccctgccccgcgcagggcgccgaggacgcgctgctggacatgagggagcacgacgtcccccaccacgtgcgcttcgccatcgacaccgacgtgcgctgtggggcgtggtactccgtctcggctcaggtgcgagggcgggaagggttccgggctcgggggggtgctggcgtggtctcgcagctcccagcctggcgccctgccggctggtgcgtgcgggtgtagcggccggtcgtggggaggggagtcccaggctgcacaccagcccgctgtcggctggtcatccgcaggcagccctctccgccgcaccaccctgtgcagcaagggaggatgtcgctggagcccaggcccgaaatggtgcagcgggcggaggcacgggtgtgcgcctttgacatcgagaccaccaagctgcccctccagttccccaatgccgagcacgaccaagtcttcatgatctcctacatgatcgatcgccaagggtacctgatcaccaacagggaggtggtggccgaggacatcgaggactttgagtacactcccaaaccggagtttgaaggtgcggggagggactgcgagcggtgtgcaatgcctggacgcctgctgaggcgagccacaccaccctccccaggtcgcccgcccctcctgcctccaataatccaaccacaggtcctttcaccatcttcaactgcgagaatgaggccgcgctgctcaagaaatggtttgagcacatgcgggaggtgagcggtggggtggcggccggcgcagatgggtgggcaagaacagcccagcccgccagggtcagacacttcgccgcgcggcagacattccgtcctccctggcccggctgtatcccagcaccgcatcccaacctccccttgccctccctgtgctcatgcagaccaagccctccatctttgtgacatacaacggcgactttttcgactggccattcatcgagacgcgtgcacataagcatgggctggacatgggggccgagatcgggttcaggtgcaatcgtgtgagcaacgagacactgagcaggtaggtgggccttcaggtgcggcaggatgcgtgcagtctggctgtcgacgctcccactggctgcccagtccggcaagatgtgtaatggaatggcgtgtgcacgagccaagatgcatgcccatggcctagcggggcgattctagggaaacccactgctcaatgtccggccccgctgcatctgcaacaggtcagcggtgcacatggactgcatgcactgggtgaaccgcgactcgtaccttcctcaaggctctcgtgggctcaaggtgagagcaacaggtctgcgtgctcgtccagaggacacaatgccgccaattgcatccgctgccagcctcatactcaatgttgcatgcaccccgcagatggtcaccaaatacaagctggggtacgaccctgtggaggtggatcctgaagatatggtgagcgggatgaggcgacccaatggagcagcatggtcgggcctgacaggccatgcggggtgtgacgacatgcagcccgggcgacgacttcaaatttccctgcctggtcctgactctccgccacctcgagcatgctgtggatggtctacccacccaccccactcctccccgcccccgcccaggtccgttttgcagcggagaggccccaatccatggccagttacagcgtatcagatgcagtagccacctactacctgtacatgacctacgttcaccccttcatcctgaggtgagtgccccgaggtggtagagctccgtggccttgcagcgtgcgtgccctggcctgcgcgcctccctgccctcgagatctggggttcacaccatccggtcccaccgctggcaccaaccaccaacgacccactctcgcagtctggcaaccatcatcccaatgccacctgacgaggtgctccggaaggggtcggggacgctgtgtgaggcgctgctcatggtccaagcctacaaggtgtgcggttggaaggcttcctgcccgcctcggggccttttgcctggagctcacatcctccggatgtgctcaaaccttcacatcacacccgcatctcgcttgcaggccaacgtggtggctcccaacaagcacacgtcctccaccgagaacatgtatgggggcaggttgctggattctgagacgtacattggcggcaaggtcgaggcactggagtctggtgaggaggtgtggttgcactggggcttgccagagaagctcagagtcaggcgcagcagaccagcaggcctaaaccctcttcccggcaccccacttccaggagtattccgcagcgatattccctgcaaattccgtctttcttcggctgcataccaggtgcgacattgaaggcccagcagttttgtgaagtgtccatccgagggtgctggatgtggcgcgttcctgacggcggcaggcaatcgccccggcgctgcctcgccatgcgtcgcatgtgtcggcaccaccaggtcaggcatgctcttttcccccaccattcacacccttcaggggctcctggacaacctggacgctgatctcaagtatgcaatcgagacggaggggaagatggacatgggcgacgtgacgaactatgcagaggtgggtggaggtgcagtgtccctattgctttcatgggcagtcttcgctctgcaaagagatgattacgatcgctggcgtcgatcacagctgtggactgatgacggagctgcgcagctcactccgcccactgagagatgtggttgcctctgcagacaggaccatgtgcaaacttcgctccctcgtaaacatttggtttccgcagatcagagctgcaatagccacccagctggaggcgctccgagactgccccatcagggacgagacccccctcatatatcatctggatgtggcggccatgtaccccaacatcatcctcaccaacaggcacgacggtgcttgatgttgtggtggaccgacggcagactgcatacaggatgctgccccgacgctgcatgacaggtttgtatcataatctgagctgctcccttgtgcggaaaggactgcacgggcaagtgataggtgtgaataattcctgccaatgacagttcattggatcacccactctcaaccatgaacgccaccccttacaggctgcaacccagcgccatcaccaccgacgagcgctgtgcagcctgcgacttcaataaacccggaaagacctgcctgagacccatggagtgggtgtggcgtggggagaccttctctggtacgtgttggggggacgtctgtggagcgactgcttcctggctgaggcggcagcccttatgcacagctccctgagatacctcgccagaatggtccagtgcctgcccgaaggtgccgagtttgcagccagtccgcctccctctcgtccaagcccacacaaccccaatctaccaccccctgcagcgacacggaccgagtacttttcgttgaagacacagctccagtctgagatgttcccgcccctcggccctggggcgccacagcgcagctggtacgagttgaccagcgaagagcggagcaaaaacttgaaggctcgcctgaagggctactgccagaaggtgcgggccgggggggccagtcagtgcgggcggtgtgttgtgaaggttggaggctcggacacgacggcatctcagcaacgtgccctgctgccacgcgatgcacgacccttgtcagcagccaggaccgatctctagggccattcccacgacccaccacttgggtgcaggtgtacaagcgagtcctgaacaagcccactacggagctgaggagcgcaggaatctgccagagagagaattcattctactacgataccgtcgagtccttcaggtgagtgcctgcagaggtctcgcctgcctgcttgcagtcaagtccagaccaaggatgccgcagcaaccccgacaggggtgcgggcctggggtccgaagacggcgacggtgcgttgcctgtgcggtccccggccggctgacaggcggcccacctgatgggacaatgatgccctccgcactgcagggatcggcggtatgagtacaagggtctgaacaaggaatggaaggggaggctggacaaggccaaggtgtgacaggaggtggacgaccgggtgggggtccagcatggtgcagtctgggtgggatcttttggatagcgatatgacgtgccaaatctcacccctgcttttgcaggcttccggcaaccccatccgcatccaggaggcagcagacatgtgcgtcctctacgactcactccaggtgagcagagcgtgttgtctgagtctttgggttgcggaacagctgcgtaagttggtccgtccctgtctagtcatgacttcgggtcctgcatctttccatcaaaaactgacacctctggagcgtggcgccgacctgcattgtaatccccatgcattgcaaaactccatcccaacaccctcacccaccctgcgtccccagctggcgcacaagtgcatcctcaactccttctatggatacgtgatgcgcaaaggggctcgctggtacagcatggagatggctggcgtagtgactcacacgggggcaaacatcatcaaggtgcgaggggagcgcatccctccgtggcatattgacatgggatctgggaaagacggccggcgtgaacctcacaccatgtcggcgccggtcagccagcaagctggcaatccccttgcatgcactctgaggctgccccaggcccctcttgtccgcctgcaccctccctacagcgcgccaacgagctgatcgggcagattgggcggcccctggaactggacaccgacggcatctggtgtgcgctgccggggtccttcccagagacgttcaaggtgcccggccgtggggtgagggagggaaaggggatccctgtgctgctgcccgggacccgttccttgtgcacatgtatgcgctcgtgagctccacacccgcatcatcatgccccgcagttcaagtcccagtccggcaagaccttcaagctgagctatccctgcgcgatgctgaacgtcatggtcgccgccaacaacacaaatgaccaatttgctgtgagtgaggcgcgtgcttccggtttcgtggcaaaagcttggatcgtgggttgtgtgtatctgtatgcgtttgggagcatctccatccggcatgcccatctggtggggcaccaccaggcccttgacagcgacctgactccacgccgtgcgacggtgacagcctctgctccgacccatccacgacgccaggtcctccacgatgaccgaaccaaagagtatcgcaccgagtcgcgcatgagcatcgaattcgaggtggatggcccatacaaggtcagtcttggagccggcccggcccctattcctgggtacgtggtgtccttcccatatatgagcggagtcatgcgcaacttccggcctggttcccttggcgccaactttgcaggcgatgatcctgccggcatccaaggaggagggcaagctgatcaagaagcgctacgccgtgttcaaccacgacggcacgctggccgagctcaaggtgaggttcggggatgcgcacctcgaggacccctgcccctgggactcccatggtcttcagtgctggcgctcgcctggctctgcagcccgacggactcagctggctccgactgccactctaactcttcagggctttgagctgaagcgtcgtggggagctgaagctcatcaaggtcttccaggctgagattttcgaccagttcctgcgcggcgactccctccagggctgctatgacgccgtggctggggtggccaaccgctggctggacatgctggacacccaggtgagctcctgtcgagggtgcagcccgttcgaatgcagacccatgggcgcgtgacagcgtcctggacttggggtcctgcctgcaggctcccattgcactgcgtgcaaagaatgcctggaggttggacctggaccgctcatgcccgtgccactttacctctggcgtctcggcagggcacggacctgacagacacagagctcgtggacctcatctcggagatgtgtgtcatgtccaagagcctggaggcctatgagggtgagttgcagaggtgatgaacggcgcagttgacacggtgcgttgcaggccgcctgtggaccctgatatacgacagggttggcacactgtatggttcacattgtgcccgctgagcatcggcccagagcagccgtccctctgcatcacccacaggccgcaagagctgcgccgtcacctgcgccaatcgcctgagtcagttcctgggggacgagcgcatcaaggacaaggcaagggcgcttggtttttgcgggggctgcgatgcactgttcggcttcgcctgcctggcagggcgttctttgaagcattctccccacatgcagtgtgcacaccgtgtcccaggcggcaaggtggtggaatgaccatgccacctcattctcctccccacctgccctgctatacagggcctggtgtgcaactacgtgatcgcccgcaacccttccagcgcacccacgtccggccgcgccatcccggtggccatcttctccacggagccggccatcgcgcgcacgtacctgcgccgctggtgtggtgacgtcccagattgtgagtcgagggacgaggctcgggacgctgagcccaccgcatccagctgcatggccactcgcgcaggctcaggtggagggcaatgctcagctcactttcttgctccacacacatatgcagctggcccaaacagtgttccggacgtcaggggcatcgttgactggcaatactacaggtaccctgcaaacatgtcggcttgtctgggctgcactggtgcaagaacctggatttgtttcaggcagtctttggggacgaggccgggaaggagcacaaaactctttgcttgaggccataacactaggccaaactcggatgctgcaagcactgggaggagggtgcgcaacaggagcagccgctcaccacaaaacgacaactgtccccatccgcagggagcgactgggaagtgccatccagaagatcatcaccatccctgcagccatgcagctgattcccaaccctgtgcccagggtggcgcacccggactggctgctgcgcaaggtagattccgcatctgtgggaggcatggggcgcgggagatggaccatgggcgcgtggcagaagctggtcatcctgtgccgcactctgggggcttgtcctcattcttccggggctgctcctgcctgctgctcctgcgctgatgtatctgctcttgctgagggccctttggcgccactgctctggccacgcaggtccgagagaagaccgacacccacaagcagcggcggcttgacgccatgctgggtcctgccacggccaagcccagcatcggtctggcaggagcaccacatgcaccagtggaggaggggcagcccagggtccaaggtatgtacacaagggggcctgcatggggtatacgttggacgctgcagctgcccagcattgaagagatgcagcagtgcatgtggcgcactatttgtggagtcatacacagtcagcatcattggttccaatgaaagttaagtgagaagtggaaacaatcccacctgtctgattgcttttgtgggccccaatagcactgtgcatgccacattgcagggtatcccgtggcgctccgagcggcggccctgagctctgaggaggatcctgcgagtggggaggaggcacccagcgaggcctgcccctcccgtcacgaaaactacgcccagtggctggaggtcaagaagcggctgtggcgacagggcgtggaggcgcgcaagaagcggcgcaccgcggccgagcccaaccaccgacgcggcggcagggagggcccggcccagaatccggaggcaggcgcagggggtctggccggcatgctgcggcagcaggctgtctctgctgcctccctgcactggcaggtggtgggcatcgatctcacagagcaaccaggtaggcttgggtagagatcctgtggcagggtcggggtggccggtggcacctagctggagccagcaaaaggacagcaggaattcgcccagaagcatggccgcatgggtcaggcggggtaggaggcggcacgaggccgtgcctggaagcactaccctgccctgctctggaggggaccccaacgcatgctgcgaaacccgcagtgctgacacctcaacacaccccccttcatgacacctcctgcccccccaacccccaccccaccctcgcaacaggcgtgtacaaatgctgggccgtcctgggtgggcgcatgcacgccatcccgctccgcatcccccgcaccttcttcgccaacctgctggccccacccagccacccactggtggccgacatgggggtgctggcgcgccgtgcactgccccacggtgcagccgcagcgaccctggtccagatcgtcatggatgaggcgtccttccgagccgagcaggcagccctgaatgagcgcttgctggcgctgcgggccctcagagtctacgaggacaccctgccgcccacatacaacgcctgcctgcaggtgagaagaccttttgtcgaatggttggtcgtgcaagggggcctcctcgcctgcttgggcggaagggtggtggtgctatgcacacgtcaccaggactgtatgagttgtgctgtggaacccgccggggttgcttcccattgatgcagtggggatgagaaggttggccccctctgctcctttgcgtgcgctccctcaccccctgtccgattcccgtgagcagttggggtgcgttaccgcgttcaacgccccatcggaggcccggaaccttggctcaggggtggacctagctgagctgggcatgaagacggtcacagaggtgggtcggtggggcgtgctgggcgcgagtgtgagggcacagactgctcgaggatggagctgtgtatccggcagatcatccagaaccctcccgagggcatggcctggatggctcacagcagctcagtggttgggattatgtagagtcagggagtcttgctggcaatgcacgtaacgcctgatggccaagactacaccaccaccgcaataaaggcccccttccctgcgcaatgctcccccagtgcgattatctggagcctggggtcctgcgccacatggcgctgtgccagacttctgatgccggacggggcctgcacctcctcatcctccacgtgcctgtcgatcaaaggtgtgctgggggatgggttgatgtttgggctcaggctgggcagtgacgcacaggatcggagggcaaccctgatgagactgatgcagtacaccttcacctggcatctgctgtgcagcccccactccctcgacatggggatgcgtgctacctcactcgccacctccaccccaggctgcacatctgggtgatcaacccggcgccaaggagccaggccgagataaccgagggggcagccacccgggtgtggacggaagccaccgcagcggtgctggagcgtggagaccaccccgccggggtgcgtggatgcatgctatggtggggtggcagggagccgagtttcaggcagccgccaatcgcttggaccacaactcctcaagacgagcggtgcagtgacacggcagtggccctggatgaagcagcaagcgccgctcaacgagtctcggtggccctccaaagtgacaggaggcctccccaacccacacctccgatgcacctcccaacctgcagacgctgccgacacagccggccatggacatctcctatgcacgctcggatgcgcaggcatacaccgcgatcaacagactgctcctgggtctcaggtgcgtcgcggtgaagctcctgcacttccaccacccaacatggggctgatcaagctgggctgggcctgctgccatgcactctgggcgagtccctcatgtacgtgcaagtgtcgggggtcaaccttcatccaggctgtcgactggagcatctgcccatgcaccgcccccaatcccagggaccgagccctgggccccaccctgctcctggtcagctcccccgaggagagcaccctgcgccagtccctgcccagtttgcgagactggcccaccacggccgtgtccacccccgcccaggccgtccccttccccgccctgggctggcagctgcctgccctgcgtgccgcagcgtcccaggcgctggcctgccccgcctggctggaggtgggaggggtcgtagaggatgggagggggggggaatgttgatgacccggctggccgctccctgcgctgagccactcccttaccctgggcgtcctgcctctacagcttgccccatgcaccacccctccggcataccgcgccgcggccggcaacagcccccccccccacgccacacaccctnnnnnnnnnnnnnnnnnnnnnnnnnnnnnnnnnnnnnnnnnnnnnncgcgcaggcccggctgcaagcagcgcgctacgcgcacctccccgtcgcgagcatgggccgagattgggccatcgacgccgccgatgcgctgttcgcgcgccagctgcgcgccgcggggcacctgctgtgggtcagcacccccgacgcggcgaccgctggcggcagcctggcggcgcggccgccggaccgcgcggaggcgctgctgctggaagagcaacgcacgcgcaccgaggtcgccgcgccgggcgtgtaccgcacggtgtgctgcgaggtcaggctcacccacctggccgtgaacgccgtgctggaggtgagggctggccccagggtcgtccgcctggggtgtggggcctgggaacctcgcacggggaagcgcagtgtgcgaagccctggagcacacgctccagtggctgggtcgagggggatctggcatggctcaacaagcctgtcccacccggcccccgcaccatgcaggcggccgccctgtcggagttagagggcacagccctcgtggacgatggcaagggctgcggggccgcctttgtggtcctgcgctccctggcccaggcatggctggacgacgcctcccgccactccaacgtgtgagtgatgttgagagggggagggggtccggggcgaccgcccggtgcccgggcgcggcaagcacgcggggatgggggcgcatggagagtgtcgcccagcgctgcggcgcacgggcgccgacgctcaccccaggtgcgcccctgccccactcatcccccacccctggtgatactcaggtgcgccgacacgctgctcctcaacatgtaccgctggatctgctcgcccgcctcgcgcctccacgaccccgccctgaagcaggtgaggtgtgggggcggatgggggggtgggcggcacattatgccccttttcttgcaggacaagctttactctctgagacacaaacccttcgctcggcttgccctctgagagaaacagcagtccagtggccgtaccgcatggcttggggcccatgacgcagcccacgagcgagaccgtcggctctgcccaatgcacacaggactcccccccccccccccccaccccacccccccnnnnnnnnnnnnnnnnnnnnnnnnnnnnnnnnnnnnnnnnnccctccctcctccctaaccgcacgcagacggtgcaatccctgatgcacaagctcctgctgcacctcgtgtcggagctgcggcggctgggggtcacggtggtccacgcggacgcgacctccctcatcctgtgcacggggaaacgcaacctggccgccgccgtcggctacatcgactacatcctggagacgctgggcaagcgggagctgctgcagtacctctccttcacccccacgcgcatgtggcacgccctgctctacaaggacaggtgtgccaactgggcctgcagaaaagcgtgagagtggctcgtcggcgcacgacgaggctgcccgcgtcgcccatgggcagggccgctctgccctgccacccacgtgatgcagccatgactcacacaccgcccacaccactcgccaggtatgactacattggcattgcggcacgggtgcccgccgtcttcatggatgccctgggacagaccggatcccttgcagaggtgcgggggccactgcgagccagtggggcgagtgacggctcccagtacatgggcctgaagaagcagcaccggccgcggtccactgccactcagcgccaaggcctcacgccttctgccgccttttgaggcctagcaccctctcccacgcaccatgtcacaggcacgcctgctacagacgcatggagaggagctggaggtgagtgcagaggagctcaacgcccctcgcttcgactaccacttcacactgaaggcacgtgaggatgtatggtttggaaggcaaggggctcgtgtgcagatcttgggcccctcaatatggcaagcagacacagccagtcgcttccgacagatgaggagcccagacctccacctcacagccttcaagctctccatgcaggacttcttgccgtctgccctgcatgccaccttcatgacgctggtaacagagttcctgtggctcccatggcaagccgccatgcagggactggagaaagggcccagccagggaggctcccaggtgagatgcagaccatttgacatcgattttgcagtctaccagataggtttgcatggcaaggccaccgcagggagacaaatcctggtcggacacatcatggcagtcccaggatgctgtgtactttgcctgcacactcgtgcacgctgcatcttgcacctgctttggcagcccatctgcaggctgcactgtggtgtccggaacccatggaggtggttagggtgaagatcaggactcggccctgcacccctcccactgcaggccagcaaggacacctcacagagcctggaggcacagacgctctggttgcggaccgccttgcccaatcagttcacctccaacctcttgaagtacgtcaagtacatatcaatgcacgttggagcgaacgatgggatcgaggcccatgctttccccgagcgtgctgggtctcacctctctgcggtgagtgggctggtcgggcgatcaaagggtcgaattgagcagcctgcgtcttgactggcgctgctgttgagggaagcagcgactgctctagccacccagcctgcattcccatggcccagatgcaatgccacagagcaacccagaacgccttcgtcaagctcccaaacattggtcattgcaacctatcacccaggaggagctcgggactccggtgatggccttcataaagtcgatttgtgctgtgttctcgctggacgcctccgtctctgaccaggtgctttggggtgtttgcgggcaggaatccaagatgcatggctgcctggacacaagcacggtgatcgctggtcataccttttgaacacagcgctcactcacgctgctcctcccgctctcgatcaggtgttggtccttcgtcgccaactcctgcgcatggtgcacgtaaaggagttcagcgccgaggccgtcttccaggtgggtcaacattgggttttacccttgagaacgccttgctgtacaggtatgaagattctcgagctgccccctcactccagcctgcaagtcgtcgtcatccccctcatcgtcgtcgaacccccacaggatccctgcgccagccttgtgctgcgtgacgtcatctgcccgcactgccaggactgccaggatctggacgtatgcaaggacccccaggtatgctgcatcgagcaggggccatgctgccgcagtgcgtgccgggcatgggtggacagaatgggctcttttgttgctgcgctgtcatgcccgcggggcaaggggctggcgccatgcaacggcctggcaggcagagttccctcctcctgcatcccgatcacccgcaccccctccccaatccacgtctgtagctgcaggcccacgactggcgctgcggcgcatgcggcgccccgcgcgaccctgtggaggtggagtccgcgctgggcgacgctctgggcacgctgtgtgacgcctccgtgctccaggatctgcagtgcctcaagtgccacagcgtggccaccgaacacctgcgcgcccagtgcgaccattgtggcggcccgctggcgacctgccggccggccgcggagacactagccagggtgcgggtgttcgagagggtggcgcgcttccacggcatgccggtgctggaggagctggctggctgggtgctggcccagcagggcagcaccgcctgaggggctttcccggcctcattttggctgctgcagcaaacacaggcgctggcgttgacaccatcttgcagcgcctgccttgagccaccctctttgcaacgcattgtatacagtcgtgtcacaaggctgccaagatggacatgatagatctaggattggggatgcacatactgtatacaagggcgcttatcctgcaaaaacagatgagagcagatattggagctgagaaacgagatgattcctagaccggagtcagtcatcgttgtcgagcaggggctgaagaaatgggcgcctgtggagcagtgtgtttgcccccatctgtcccacacattatcatgacatgtgctgcaggatcctctccaccagctcgtccttcctcccggagactggcaggtgcttcgccttcagccaaggcttcagggtggaaatggggagctttccgagagtgcccgcctcggcggccacctggggggcagaaatgggacaaggctgttaagcctattggccaaacagaagagggttgcagttccaggaactggtgcatcgatacatcagacgagtagagtgtgagccccggaccagttgcccaggcggcatgcatacctgcacttgccgaatgcaggcgtcgtcatcgaacgtttcgctgtgggtgccgctggacggcggagctcccttccgtttgctgcctgggctgggtgaggcctctgccaccgtcacagcctcctgccataaaggagcggagagaatccgagtcggaatcgcgccctgttcctgtcagcggaacattccctccaagacacaaaaacacccacacatgctgcaacgtaccctgaaggcgcggaccacaggcccgacagccctgaatgcctccacatctgggagggtatcgtccatgacatcctcgccaggctcttctcccatggcaagcgcctccaacacctgaggagaaagaggcggtgcacctcccgcacatgaaacccgttctgcagggcaggaaacgctgcatccctggccaccagctcagcatcccggccaaacccgcaagttcacacctggtagtgcctttggaggtgagggttagcaatgatgtcgctcgaaaactctcccagctggaggtgggcgatgagcgcatccgctgccgccacctgtgcggccgtgggctccacgacctgcagggcaacgccaacatgtgcatcccatcagcaacttgtgtgactttgttgccagagatcctttacttcgatggagatcgacacttccttttctgcggccagcagacacatcttcatgagtgaggccggactgccaaatgtctacaaagaagttctgccatgatattgtagtttgcagccagagcaaccacggccatccccaccatacctaacacacacctgggatccagtaaaggccctgtccatctcgggctgtcgcaaatcatccgcaaaaggcaggtagatgacatggaaccccggggccgcgagctgtttgagtcaggcaggcagaggagtggtgatggggctccagcagcacattcctcgcacggcatggaatggcgacgcaggcaccgcacctactcaatccctccaaatttgatcccggcacagcacaccagggcctcacctggatcccctcctcgtcgctcagcgcctcctgcggcagcagggccacgaggcgcaggcccccgctgtggcttcgcgcaaacacgccaaacgccacctgatcctggtccagcatggcgctgtgcagcgcgacgaagacctggctgctcccgggcaccccgctgtcgtctgcccaaagtgtgtgatgaagcaggggagaagggggtgtcagctgatggagtttctgaatagcaagctgcagactgtccacacccatccaactaatcacagacagtctcaaactccagcaaataccacagagtcgatgtcgcacagtttttgcatcaccctctccacgttgtttctctcccaccgcctcaccagggtagacgaacgatgagctgcggagctgatggtgttccttgagacatgatgtggacttgaagcccagcacccgaatggtgtgggggggcgcagctttcacgctctgaatctcgtgtggctccaagtacacctgcggcacgagaatagtggagggaatgaggtcgttgcatctggtgccttcgacgcacaccaagtcattatgccatgctgcaaaagttgcagtggtcacaggcacacgaaaggcaaacagcgctccctcacacagttgtctgcagggacacaacgctcagacctcctgggtacgcaacccaccgtctttggcacagcactctcacttttggaaagttggcatacttgtagtgtgcgtccttggtgtttggaaagtagagcttgggagcctgcatgtctgcctccggcatctcgcccagcaccgctcctacgattctcgtccatgccgtcaagtgagctctcgtgcaactggatgcagcactgcttatcagcttcatttgcttaagcaacaatcgtaaaataatcctatcagacccatcgtctcaccagtgtcattgtcgatgagggcactgcttatcgtgagcggggcattggtgacggcatgcacccagtgggcctgcaagggaggcatgaggttggtgagagactggaccaggaaccattctgggctgtacttcataccagctgcaatcctgcctgctgtaggcagccaagctctcagccttccaccagcacctgcccctttgttgcaggttgcatggtggcatacatggccacagtaattgcaaggtcaggtccaaggaccatgcgatactggcccaaagaccgctgctggtgcgccttggcacgaactgtgctcttgaggtcctgcattgtgcaaaggaggatcatacttgggaaattcagcacgtgttggcgatggagacaagtatatggcctgcaggctccgaatggcggtgacatgtggataccttctcagctgagcgcccccttcagcgcccactctatacctgcagcttgccaaaacgttctggctccaccggaacgcccccaaacttgctgggggaggacagcgatttgtcttccatctatgttgaaggcggtacaaaatgaagtggagacagagacagagactttacgtgcgtgcttggaagtggcagtctgatcatgagtcatacatggaaaggtgaccctgcaagagtgtattgctggcacccccccc

SEQ ID NO: 36078 - DNA, 80 bp, Chlorella protothecoides
agacatggtgggtggccgctcaaggggtacctgatgagggtgcacggggctttccaatttaggcatgccacaaggacttc

SEQ ID NO: 36079 - DNA, 169 bp, Chlorella protothecoides
gcgggccaggcgcctgcgtcccgggcggcgctggtcgccgccgccgcgagcgccaggtgagggatgtttttgtttgtctcgagaagtctgtgtgccgggtggggtccgtgtgcagatgcagggagtcgtccctttccctgcaccatccccggcgcccctcaggcggggg

SEQ ID NO: 36080 - DNA, 77 bp, Chlorella protothecoides
tgccgcggggctggcctgaaaccctaatctgcctcggaaggtggggaggatgctcgaaacacatgaccatgagccta

SEQ ID NO: 36081 - DNA, 76 bp, Chlorella protothecoides
ctgcttccacaggtgtgtgtgtgtgttgtgtgtgtgtgtgggggggaggccccgtgatgatgggcgggcatgcagg

SEQ ID NO: 36082 - DNA, 61 bp, Chlorella protothecoides
agcacatcctgcgcatagcatgtcaatgtcaaaccggggccatcgtgggtatgggtccagc

SEQ ID NO: 36083 - DNA, 73 bp, Chlorella protothecoides
aggcggcggggccttgggaaggctcgacgggcggcactggccgagcgcaaggaggccgcggcgaacgccgccg

SEQ ID NO: 36084 - DNA, 20889 bp, Chlorella protothecoides
  modified_base (1927)..(1992): a, c, t, g, unknown or other
  modified_base (5285)..(5329): a, c, t, g, unknown or other
  modified_base (8865)..(8932): a, c, t, g, unknown or other
  modified_base (9033)..(9117): a, c, t, g, unknown or other
cgacgccgcgccgcccgacgccgcgccgcccgacgccgcgttgccctcctgcgcgacggccgggctttccgaggccgcctcggcagcaccctccgcgccggtgcgtgcatcggggcagggcgccacctcctcctccgccagctcggcggccaggcccaggatgcgggagggtgagcgcgcgcgcaccgcacccgccaccagctgctccagcaccttgggcgggaagacgacgcgcagcacgtccaggctggcctccatgacctgcaccgaggcgtgcgcgatggtttgcgccatctcgcaggcccagtccgccagccaggccccgtccatggtggggcgcggaccgcgccccgtcagcagcagcgcgcccagcagcgtggcgtgcggcgcgtcgcacgccagcggcgcggcctggcaccagcccaccgcgccgcggcggcgcagctcctccaggtccgagtagtccggcgcggacctaggggggtggggaagaggggaatgggggagaagaatttgaggacagaacaagcgcgaagatgttggggtccggcggcggagacgcagggcggtgagtgtgacttggcgccggccgcgagccaattcgccgcaggctcggcaaccgtaccatcctcctcaaatcagcacagaaccccacatccccccccatcgtctcctcactccagtgcctcgcccatgagctcctccacgttcttgctgtccatcaccatccgggacaggctgggggcacccggcggcaggggccagtcggccagcagggggccccgacacaccgagccccgctccagcacggggatagcctccagctcggtggccgcgccgttggccagcaccaccctggatcgtcggatatggcattcgatcactgggccggcccggacctgctgtcgtgtgagagcaagggcacaacctgcaccaccctgtaagcctttcacacgcggctgctcaccaaatgtcgtcgacgcccaagaatacgctggtaaggttttttgcgcaaaactctggcatgggggcatgcaccaccaaggaagcggccagcgcactggcccagctcccattctcatacggcacgcctgggggcggggcgtcccgtgtcatgtccggtggctcggctccacttttatctgacattctatcaactcgctttggatcatgtgcactgcaaaggccacactcagctttcacgcctggttttgaggccccagcggcaagatccccagagggttttcatgacgaggaaagggagaccatggctgccctgaccctcgcctaacgcgacattgtggccccctcctgctcgtgctgccggccctacggcacctctgtgcttcgaaattcaatatgtttatccgctcaggtctgtcatgatgcctcttcatggcttcaaggccgcgattacatgcgcaatggaccagggagattttatcatggcaatccggccagatgcctcgagtcctcccaaccttgtccaatagcattcgagacaacatcccgagccattacaatgcctgaccgcgcaccatggctgccgggaaaatgttgatatgctctgcaacaagctgaggcaccaccctcgcatggcatctttaagaaagcgggtagaccctccgaaattcctccgaagtgggcgcggcggatgctgccctaacactcaccacttgcgtcgcctatgccgagcaccagttgtgtttgtttgtcgtcgcatggttgtgacttgaagtgtgcagggggatcgtgttccccgcaacaggatagcgttcgtggcctggaccaccaggtttcgacccacaacccaatgctttccgggacggctcgcccgagccacgagtgtttctctggggggagagtattgcttcggggtacatccctacatattaaaccatccatcatgcagcgtccggcgttgaannnnnnnnnnnnnnnnnnnnnnnnnnnnnnnnnnnnnnnnnnnnnnnnnnnnnnnnnnnnnnnnnnggtaggccgggacatgggcacatccgtactctgcttcggcatgctcctggcttgcactcgagtcccccatacatctgtctccaatcgctgcagtcagatgctatgctggagccagcgcggcctcagaattactggccaaggccgtgggctgggcagtcattgggggctcctgcttcaggagcatgccgcagatcgttcgcatctacaagtccaagaggtgggcgccagtccctgtcttggctactcgtaagagggtttctaatattgacatcttcgtgtgtgagagaagggtagcttaaggtcagcaagtcactccctgtgccaagagcatgctgctgtgcctcagcccgcatcgacgccccacctcttcccgcttcattgacccccgccctgtacacacgcgccccctgcagtgttgaagggctgtccaccatggcattcgtcaatgagactgtggtgtgcatcgtcaacatggcctacaacctgaggcacgggtaccccttcagcagctacggcgatgccgccacctgtggcgtccagaacaccgtcatcctcggcctcatgttccgtcacgggtgaggctgcaaatgctgactgaatggctggaacaagcatgcacaccgtctgccgtggcatcttggctgtatgcaacttgtggtgtgggagggtcctggccagaggcttgattccaccttggggactaagatctgtcctgccagcctccctgagagctttggcaagttatcccttgatgctgcagttccagccatcctgcacacctccatctctgccaaccccttcctctgctactcaccccttccaatccctcacttcacgcgacgcagatccatctccaacaggaataaagtcttgatcactgttggtctgaccgcctttgcagcttccttgtgctttggggtctgcagcgacgccctgctggcacgtgagtcacggcaggccaatgcttgtgtgggagacggtgcggtcgttgagctgcacatgcttccaccaccctctgcaacgcctctcactgcctgttgaaaacttgccgcagctgccccagctccagtaccaatgcctcacccacaccaccccgcccgttgccccgccacagagctccaagccagcagcgtgctcctgctggcgctcgggggccgcctgccccagatctggatgaacatcaagaacggcgggagcggggagctcagcatgggcagtgcggccctgtccgtcgctggcaacctcggccgcctcttcaccacgctcacgctcgtggacgacaagctcgtgctggtggcctcggtgtcccagctgctcctcaacgccatcctgctctggcagacggcgcagacggcctggaggaagaaacaggggaccgggcctgtctacaaagcggcgtgaatgggagggtcctgtacgttctggacggtccctcacgctgcagctgccagggaggcttcatcttgtgccttggaaaccatcccggcgtgcgtcacaccgtgtctgcccccctctttttggtgcccacgccatggctccgcgccatctcctgctcgctcacagctgcgagaccagggactcgcagcgctcgccctcacccgtgacaattggtgccctccccgattcatccctgattgactcccaactcaccctttcacgtactcctcgctgctaggcgccctctgtaactgcccgagctgatcatgtgtacgccgggaagcatggatgctgatcttgtgtggggacgcagcacgccacgcatgtgcccgagcccggtggatcacacatccggccattttttccccgatcggcaccagatgccgacgacccccgcctgccccgacactcgccgatctgatcttttcttgcatcctggacttgcttgcttgcacgtaccgtgccatgcctggccagtccagggagtcccccacctcgccggggtgcgggggatgctgagtgccctggcaggcgccatgcgcagcaacctgcgacgccatgcgaccctgcgcccccagctgctgggccccggcgcggtccgggccccctccccggcccgcccaccccggcgccccgacgccaggggttttgcccccctggcgtctgcccccagccgtggcacaggcctgcacctgacccagccctcccggcccggctccccagtggtcacgcaggaggagtcggtgcccttcaccgcctactcccccgccgtcaacgcagcctactgggccacgcgcccagtcaccgtcgcgcagcgcggcctgcagatcggcggcgcgctgctcacctggctggtgcgcggttacctcatggcccgcggaagcccaggcgaggtgctgcagcagcgcgccgaggccctgcgggcggtgctggtggacctgggcgccgcggcggtgaagatcggccaggccgtcagcagcaggtgggatggggtgtggccgcggggtgaagcgcggaggccctggccccgacgtcctccagcagaccgcgggcgatgctcttgctgcagacttggggttagggggtgccgaaccggcttgcctgccgtccgctgcatcctgtactctcgtgctggtggaagtttggaggacgggagatgatctcacaaactccccccgtccttcctcccgcctccctcgcaatccactcccaaacctggcgccccgcgcaggcctgacgtggcccccccggaggtcacgctggagctggagaagctgcaggaccagatcccgcccttcccctccgaccaggccatggccatcatccatgcctccctgggcgcccccgcctccgccttcttctccgacctctcccccgcccccgtggccgcggcctcgctgggccaggtctacgtcggcaccctgcgcgcctctggccggcgcgtggcggtcaaggtgcagcgcccgggcgtggcctccctcatcgcgttggacatctacatcctgcgctgggtggcgcggcgcgtgcagcgcctgcgtcgcatgaacaccgacctggctgcgctgctggatgagtgggccttcagcctgttccgcgagctggactaccgcgtggaggcgcagcagggcacgcgcttcaaggagctgtacggcgacctggaggtttgtgggtcagttggtttctttgtttatgaaagagcagaatggtggttgtctgaaggtatggttgtacacgaaggaggaatcagcacagagtccatggactcctgctcctctatcgtggtgggcacccacctccctcatcgcaccctcgccctctccttggcaagctccctccacccccccccccccccccannnnnnnnnnnnnnnnnnnnnnnnnnnnnnnnnnnnnnnnnnnnnggatgtgtttgtgccgcgcatgtaccacgaactgacaacgcgccgcgtgctgaccatggagtgggtggacggccagcgcctgcgcaccgcaggtggccgcggcgggtctggggacgcaggcggcgcggccagctccgacgacctgcgtctggtggacatcggtgtgcggtgcagcctggagcagatgctggagcaggggtactaccacgccgacccgcacccgggcaacctgctgaagacgcgggacggcaggctggcctacatcgactttggcatgatgggcgagatcgacggcaccatacgcaggcggggtttggagtgtgtgttgtttgcttgtgtgggtgtgggtttgccgccccagagaccccacaagtacccctatctcaaaccctccccccaatgtccaaaccccacatatagaggcctgctgcaagccaccctgcacctgatcaatcgggagtacgaggcgctggctgacgactttgcaatgctgggcatgctgccctccgaagggagaaaggaggaggtcgtggccgcgctgacaggcgtgtttgcagaggcgctgtccggcggcgtcaacaacctgtcctttggggagctgtccaacgacctgggtgggtgatggggatgagggagagggaggagggggtgttacggcctcctattgtcggggtgctgtctgtgctgagcttggtggaggaggagtggatcaggaaaagggcccactcctgcatctgaggggctacctgccaagttggggcaccagtgaagctgttgaccaatggcattatggatgacaggcgtgctcgcctgcgacgcgtattcaccagcagcttctcactccattccctcactactccctgccgcagcaaacacgatgtaccagttcaagttccagatcccttcctactacaccctgctggtccgctccctgtctgtgctggaggtatggaagatgcaatcaatggttggggggactgggacttaggccagctgggtacctacaaggagtgctggacacagcagcaccctctttgtggggtcgaactcaccgtgtgccatggagttgcctcgagcggggcagactcgcgtcgttcccctccgtacatttcggcccttttcacctccacccagggcatcgctctggccagcaaccccgactacaaagtgctgggggcgacctacccctggtgagcgaggctgttgaccggctttgcccagtgcaaaccaccggccctagcacgccactcggccccccctttccccaagttccagtggttgtcctgacgtacacgcataccgagcttcagagtccctgcatccaccgcacaacctcgcacactcacacccccctcctgcccctgcagggtcgctcgccgcctgttgttggacacctcccccgagctgcgctccaccctgctcaccctcctgtacaagaacggccgcttccagttcgaccgcctggtggcgctgctggcgcaggccgcgcagggcggcgccagccgccgcgccgcagcggcggcggcatcaggaggtgtgggcgctgccgccccaccctcggcgtctgacggtgccgccgctgccgccgccaggccccccccctcctcctcgaccgccgaggcgctgggcctgctgctcagcccgcgtggcgacttcctgcgcagcatcctggtggacgagctggccaagggcgtggactcctcctggcgcctgggcgccaacggcgtgttgggctcagcgcggcgcgagctgcgcgctttcctcctggccccggagtcgcagggcggccccgccgcactgcccttcgcctccgtggccgcgcaggccacgctgtcggtgctcttcgccatcccgccgctggccgaggaggccgacgtggagcaggtggagggcatgcgtcgcctggccgccgccgtgaacccgcagcagcccgtcgcaggggcgggggcggtggtgggtggaggcgcccggcccgcctcggcacatgcagctccggcgcacgcttcggcggcgcacgcctcggcgcacgcggcggggtcgctgccccctccgcccgaccagagcctggacggggcgtggactggggtggaggccgtggcctcggccgcgcgctggctggcgcgcgagtcggccacgctggggaaggaggagcgggcggtggccgcgcagctgccgctggccgtcgctcaggcgctgtcctcccgcctctcctcccgtgccatccagttcgtggccgccgtcgcacgggaggacagcggcacggcgccgggcgcgccacgcgggccgtcaggctcgggcgcggtcgacgcccgcgcgacggccgcagccgccgcgccgaccgtgccgaccgcctcccagggcccgccgccgccgtcagcaggccctccctcggcggccacctaccccggcatctccagggccccggtcatgaggcccctggccgcgccgggctaccgcgggaaaggcaccgcgggcacaatggtgctgacgaggccggcgccggctgacagcgccgcgccggcatcctggttaggctaagtcgccgcgacatgcgaagtatcctgttgaacatccaccccgcgcgcttgcaaatacttttcccctttgtcttttttgttgctgcggtcggtgtgagagagcgcatggtgccctggggctgcaggggcgagaagagagagtgaccgcgcgcgcctcgaccacgaagttgaggtgcacaaccctagccggaggggtacagtgcaatggccgcgcacagcaggggcccgcgcggcgattgtgcgcccatcaatcctgagtgccaagcacgagaggcagtaacaaaaccacacattgtcgcgcaggcgtgttgcactgcaggctagtaagtaattgcactgccagtgcaagaagcgtgaggcccaagcactggaggtccggccccccacgatggctgatctgatagccaatgcgaggatcggtggatgtagatcgcagtataacgctggatacccgcattcttgcacaggcgagcatctgcggatgtctgctgtttctcggaggggcagctttgcctcggccaggggaatcagccactattgccaggcccaggaccagctgctccgatgcgatgatattgctgtacgaaccccccttcgtgacactccaattccggcccctcggcacaggtatatccacaggaagcatgcctggcgccccgcccagcctatcccatgcaaggagcagcgggctggcggcccggcgcaggggcgacccactcggtggcttcgccccccatccccatccacccaccccgcgtccgcgcgtgcgcccggcccccgccaccttccgcgtggcccccggcgccgcccccctccccgcctgcctgctggacgtgcatccggaggtggccgccgcgctggcggcgggcgaggcggtggtggcgctggagagcacgatcatcagccacggcatgccccaccccgccaacgtggagaccgctgcgcgggtggaggccgcggtgcgtgccgccggcgccgtgcccgccaccatcgcggtgnnnnnnnnnnnnnnnnnnnnnnnnnnnnnnnnnnnnnnnnnnnnnnnnnnnnnnnnnnnnnnnnnnnnccgccacggtgggcctgacccgcgcccagctggagcggctggggcgcgcggggacggcggtgcgcaaggccagccgccgcgacctggcggcgggcgcggcnnnnnnnnnnnnnnnnnnnnnnnnnnnnnnnnnnnnnnnnnnnnnnnnnnnnnnnnnnnnnnnnnnnnnnnnnnnnnnnnnnnnnccaccgtggccgccacggcgctgctggccgccgccgccggcatccaagtcttcgtcacgggggggctgggtggcgtgcaccgcggcggccacctgtcgctggacgtgtcggcagacctggcggagctggcgcgcagccgcatcgccgtggtctgcgccgggcccaagacactgctggacatcccacgcacattggaggtcctggagacggcgggcgtgggcgtggccgcgctgggcaccgacgagtttcccgccttcttcacgccgcgtagcggctgcgccgcaccgctgcgcgtcgagaacgcggcggggtttgcgcgcatggtcctggcgcaggagcgcctgggactgacctccggcctcatcctgggtgtgttgttggggggaagagggtatggaatgttggggagggggaggtcaggagggggaggtcttggaagaaaagaaatgcacaggaaggagtgcgggggttgagggagagaatggatgagatctgctccccccaggtctggcagcttgtctgcatgtatgtgtattgcgacggagcgttgttttgctgcgtgctgcttaccttccagccgtacacccaccacgactcccgcccctaaaaacagttctcccaccactcatccacccaggtgtgcccatccccgaacacctggcggctgaggggcaagagatcgaggccgccacggccaccgctctggcggaggccgaggcgcagggcatccagggcgccgagatcacgcccttcatgctggacaggatccaggtgctgacgcaggggcgatccctggccgccaacatccagctcatcctgaacaacgccagggtgggcgccgaggtggcggtggagctgtcacggctgaggaggggcgggcagggccaggcgacagaggggtgaagcggcctgtggcagggccgatgcgcggccgggaaggggtggtgcagctgccggggcgcacagctggggaacagcgctgtcgatgagacgtgtggccttcagggacgcaagcaggggagcgaggaaggaggcgccggcacgtggaaatcacaccgctgtggctgcccatgcacaacctggcagaccgctgtggccaatgcaagggtatgcatgatgtgcccctgttgagcatggattcagcaagcaggcagcaggacctggtacaccgactctcacatgaagagtgctccagaatctcctcgtgcacgctgtttgcacgcaccacctggagacctcatcgagccctcatgacgtgcaatcacaagccagaggatttcacatgagcagcagggaggaaggagtctctgcatgctgcaagcctgattctgagccctgccaacaagcagaccagcatcacagcagcgcccagtttggagagggggtggacttgatccagtcaaaatccagcactcgggcccagtggcctgcatcctcccccagcccatgcccctccaggtcctggagggttgaacattgtgtggaacgttgtcagcatgccgcggcaatggtttgatcgctgggctgcccagacactgttatgtactcgtaggccatgcctcggaaggcccagtcagccgatcgctgccccagcatggcgcaccctgcaacctccacgcctcccctccgcacttgcctcctgggagggccccggccctgacgatgtctgcaagggcccaaagccgaggccggagctgtgctcgatgatgggcgcactggaggagcgcaggtgaaatcgggtgtcgtgcgaggcatggatcctgacctggtgcgccgccaggttgaaggtgcacgccctcgcccctgcgaggtatccagagacgggaaaggtcggtgggaaggcgaggaggtgtggtggctggcttgggctacatcaatcacagtgttgaaaccccccagcctccttgcccaagtggagcaatggggctcccctccccacctagcaatccccgcacgcgcaccctcgatgaggcaggcgccggccacgggccccgcagtcacgctgcaccgttccagatcgtcgatatacagggcggccgggcagcccagcagcatgatggcctggtcccgcagtcccgtcaagctcacctcctccccgctcacgaccaagggggagccactcggcagcgtcgacgagttgaagtgcagcgtggacggcctgtgcgggggttgggcgggtgtggcgccctgcagtgcggcggctgaggccgggggcggaggctcaccctcggctgcctgcgctgccggggttgcgctctgctccaccgtgcccgccggctcgggcgtgggtgcaaaggcgaatcgccgccgagggcccgaggcgcgcagagtctcctccaacgcctcggacatgtccgtcagctcggccgtcaaccggcgcaggtcgtactgggggagccagtaggacgcctccgccaggccctgcagcgtcagagaaggctacacctcgtaatcttggagaattcagcccgtttggctgtacccagcgacaaggcatgttgagcacccgcagcataacaatgacacgcaacaatgtgtgataccaggcgggttcacgaagcctgccccagatccctgctccccaacatgcctgctggagtcccatgattgcgtctcgcgcaggggtttccccggatttgtcgcccttcaccgccccaacgagagcctcagcagcggccttctcccttgcatggcgagccagaaagacatccgtggcttccctcggatccgcctcctgcgccgctagcactgccctgtccgcggagtggagctctcgatccctttctcggcgctgccaccgggagatggcgtccgccaggccggacggtgctgcagcctccgccatggcttcgagtcctgccgccgggtcaaagctgcggatcacttgtcagggggaaggcttcagaagtgcgatctccaaagatcctatgtatgcatattcagaatactttgaatgagtcaatgtgctctgggatggggaatggtcattggagtcgttctcccaccgtcgtatgcatggctgtgcgcaggtggaatttgcagtggcacgcccagcatgcaagcgctctcttcggacgacacccccctcattcctgttggtggccagcaagaggtcatatggacaacgaactccttccattttattatttaatggacgccaaggtgcggtaatcgctgctctccatacaggcggagattggcagtagaggcccgccgaccctgaccggagcctgcggcaccccctctttccaccgtgccccattctgccccctggatcctcacgcaggctcccagcatcatcaaggtcgagagtccctgtgccgtggacgcccttcaaaagtgtctgaaggcgaacaagggtgaccacagcaaggtgagggacgcaggcttggggaaatagagctgacgtgtcggcactgccgtgccagcccttcaccaatccccacccaccgcccggtcctgaccagtgcaaggagcaggtggaagccttcaactccagctgcggtcggggtgcgaaatggggcacaagagggtcgccgtgaaggacctgcacgatcaggtgatggccaccctggacgaggccctggggtgggtgcacgaccagcgcacccaccgcgtgtcggagtgcattgaggtcagcgagctggaggtcgccgcggtccggggcgcggtgcagtctctcaagatgggcctggtgaagctggcggtgctcagggacgggcggtcgcccgcgccgccgcccaaggccacagggtccctggtgcacgaggtgcgagacgccgcgcgggcgctgggggcggccgccgcacagtgcgcgcggcgcggtggtgcgaccctgcgcaaggaggtggtgcgcgcgatgaccgccgtggtcgagcccgccaaacgggtgctggccagcacgggcgtgcccgcgcccgacccggaggccgtgctccgcgctgccgccctcgccgtggagtcgtgcgatgacgcggagcgtgcagcatggaccaacagggaggcgctggggcgcagcctggacacggtgagcgtcgagaggtggtggttctgaggtggggtccggtgggcgggggggggaagggccggaggaagtctgggcgtatgtctttgagagccagagactgtgctgttcaccgccgcccgctccgcaccctgcgatcagattgcccgtatggcggaggatgcccggcgcgagctggcagagctggacctcgagccgatgtcaaacggcgattgcgacggggccgagggcgtccctgaaggtggcgagggaggactcgacgcgtgcgctgccggtcagaaggccgggaacgcccgcgcgcgcgggggagagtgcgagcgggaggggcctggtcgggagcaggcgcaggagggcagcggcggtgagtcggaggagctggccctgagcagggcagactccgacgtagccaaggccatcctggaggtcctgagccgggccgctgcgatgctgtccctgctgaggccgctgctcgacgaacagccccagggatcctttgactgggcagagtgggaggtgctgatcacaaacaccaacaagctgggtgagtcgctggatggacttgcggtggttgtctacccccccctccaccccagtgaggtcagggaggctggcagcgaggtcaacgtccacttgcatgcgatgaaggactggagaccagagggcctggatgcccgacgttacactgggtacctcgcagcatatgacgccatggatggagccctgaccaaactggaggaggcctgtcagaggatgtccatgggcaacgaattcgtcgacatgacgcagaaggtggcaggtgccattaggaggatggagctcgattccttcacgctgcgctgatcggctggccgcgatgtacacccagatgcgtggcctgaagctccagggacatgatcttgtgcttgtagtgatgcaggaggcaaggggagggggcaagtgattgatgaggttgcagtgtgacgaagagggattgagtgttccgctcacagtgggtgtagcagacttacacagacagagtctcttgcccatggcagtgtttcgatattcgatgtgggtcccattccccgaagtcaaacgctgcacatgattggcgaggggaaacctttttgactgcggtctcagcgcctgttttgggaagtcatgttgaagcaatccaatgagaaatagaatcttggacggtgtgctctcgtcctttgcatggcattctgtccaggtaatctaaaacaggcacgcgtagcatgagcatgccgcccttggacgacagctctcccgacccatggccaaaacggcagctttcttccgtgttgcacacttaatgacatcaaggtgcagtgagtgacatcctccagtcggacgaggacaggctgcagcggaaagccgactttgacgggcccggcagcggcccccctattcccctgtgcctcatgatgccgactttccctccacacaggcaccaagcagcatcagggtcgagattaattgtgcgttgaacgcactacaagagcctttgaaggtgcgcacgggcgacaacggcaaggtgagggaacaataagccgggatgaggatcgagcagctctcctgcccgccctgccatgccaccacctcactactcccttcaatgcccgggctcgtccagtgttcggagcagtagaaaacccctcaaccccagctgtaccctgggtccgcaatggggcgcaagggtaggggcacaatcagcgtgaaagggctgcaggaccaggcggcggccagcctggctcaggcactggagagggtgcgcaacacccccatctgcgaagatcctcgaggcgaggtcagcgaggcagaggtcgccgatgctcggcacgcggtggccactctgaggcacagcctggtgagcctggcggcgctctgggacgggcggtcgcccgcgccgacgcccccggtcctggagtcccatctccgcgaggtcgcggccgccgggcgggcgctgagcacggcggcgtcgcgctgcgcgcgctccgccggccccaccctgcacttctggatgcggaacctgttggcctccatctccgaggccgccaagcaggcgctggccagcatgggcacgctggaatcccgccccgacaccctccgccgtgccgtcaatcttgccatggaggcatgcgatgccgcggagcgcgcgtcctggaccaacagggaggtgctggcgcgcaggctgaacggggtgagcactgatgggggtactgtatgcggttcgggaagggtggtggggggcgggaggacttctgaccacctgcctctgagagtgccagagacagcgtcgcctgccactcaccgccacccggcgccccgcgtccccccggcagatggttcagctggcggaggaggcccggcgtgaggtggaggagttggaccttgagccgtcgcctgaggatgactacgggtgctgggacgaggtggaaggtttggcatctgctcaggaggaggaccaggagggcagcgacgacgacccaggggaggtggtggtgagcaggagagactccatcacagccaaggccatcctggaggtcctgagcagggctgctgagatgctgtccctgctgaggccgctgctcgaggaccagccccaggggctcttcgactggatgaagtgggaggtactgatcccaaaggccgaccacttggtgaagtccctgggtaggcaggcgctgctcgtctaccccccatcgatgccggggaggtggggcaggccagcgaagatgtcaaggcccgacttgtggcactggagcaggcctgggacccaatgggtttggatgccctcccatccgaacgcttctttgcagcacatagcgccgtggagggagccctgaccgaactggagaaggcatggcagatgaagtatgtgtgcgacaaagtagctgccaacatgaggaaaaggtcagatgccattgcgggctggaggctccttccgttttgctgagctggactggtgcgacgtacccacagctgcgtggcctggaactatggagatgtggtgtcgtacatgttgttgatttaggtatcggcgatgaagtgcagtgattgcagcctgtcatagggagacccacttgaccacccattattgggttctgcagtcatgcccagtcgcaatctcatctgccacctctcttctcagaatgggtgtggatgtgcctatggtgggttaggcaggcgcataggggcttgatattcgtaaagtgcacacacacatacataatcagtatggcccaggagcctgggtcctgggggcatctctgtcaccagtcgaagcagctctttggattagaggttgggaggtctaggagctccttgacttcctttggggggttcagcttcaggtcaacagccctctcccacctgcgaaccaaggcatacagggatggtgtcagcagccagagatggataaccgtacactccaaccgcccttgcaccgattgatacaacgcaaaagcctagcctaccgcccctctcctggaaacccacctttctaatcgtgtcacccccatgctcggcccatacttggaggtcatgtcgaattggcggaggagggcctccacctcctcggcatcgaggctctcgatgctgggtgctgcagcgggcttggtgccggaccccgccttgctctcgggccgtgcagcctcgctcccgggcctcttctgcctgaatgagctccaaacagcgctggacatccttgctcccgctctctcagtcagcgactgctctgggtctgcctccccggctgtgtagtggggacccgtcttccacaccggggaaggggctcggaaggtgatgggcaccggatctcaacaaatcgaaagcttgttttatatttcacggatgggatcacctcagtattgcagagtatgtgagtctgagagcttcggccacagcccacgcctcgattgtgaggactgcgcgggggatgtcggagtgtcccgcaacattgtggtaacaaattcgctaccaccaacagaggatcttagaaaacccgtgggaccggggttcgagtccccgtatgcgaatgttccaaacgatacgatcgcatatcgtataggtggttagtatacacggctctcacgcctcgaaaacctcatattttgcactttttgccttcgcgttgatatttatgtaggaaggattggtgtgtgcctggatcaccagcacgcgggcatcaggacctagtgcacaggtccccccctcacgattgggatacatgtgccacatgttttactgatgatgcatgcgcaggggtgatcagggtcagtgaacaagcaatggccagtcatttttccaaacccgccaacgcaatgctggagccggttcagctccagggatttggtgcaagatgatgtcagggtcgattttatctctaagcaccctccagaacggctccagcagctcagaaggccagcctgtgtgaaggctcctcccccgccctccttgacattgtgccgggagggactggcgctcaggaagcctgcctggcctctgtggagttgtgcaatggacaatggttgctgggttgggcggggaggacctgccgatttgttgcagggaatatgtcacggcccccactggagcgcctgcccatcgacatctggtggcgcgtgagaaagggtgtcaggacccaggtcaatgctgccagacaccgttcatcacagccatccccccacctgagtcagcgtagctgcggcgcctctcgggcgagacggtgtccaaagagccctccgcccggctccgcagcatgcctgcgcaggggacggatcgtggccatcgcagcctgcggttgcagcccggggatgagctcgggagccggaagaggtactccggctgacccaggactccatagcttctgtaaactatcaaacgacccatcaagggtaactccactcaactcacactacttctcgccagcgagaatgccccaacccctcctccaaatatacagcctcaccagagtcgcccctccaggaggtgggcgtggccagccctcgctcagtcagccgtgcactccagtcccgacctgaccgcacggggtcgaccccgtcgggcgctgctgcaaagtcggtggatgacctgcggggattgctcggcgaggagtgggtgagatggcggtagccccgtcgctgatggagcatgaccgtgtgcctcccgtcggcgcaccctgcacaaccccccccttccctcctcgcccccaaacccgcctggtcttggcgcccatgaagggcgacagccagcgccgcaggccgtcggtgaggctggtgcgggcgtcgctgaccctggacacccctggcgtggccgccgccgcgtcccccgccggggcctgtaacattggcgttaggtggttggggtgcaaggctctgaggctgggtccaaaaaagccaggcccctgccggtctccagggccagccaggtcagcacacgggagcgccgcgccaaaccccctctccatacacacccatggtccgcccctcccagcacacccgggcctgccacccctcccagtacaccccgcctgccgcccaccagcgcacctggggtggcgaggtcagcgcccccagcctgaggcgaggcacggctgccggccgtcccctgctgctgctgctcccgctccatgccgggtcgccggacagggaggccacgggggcctcgggaaagggcgacaaaccccggtcatgatcgtggtggggccgtgactcggcgccctcgccctcatcgtcgtcgtcggacgactcgtcctctcttggttctgcagcggcgcgcgcctcggcgccggcccctggctcccgcgggccgcccgacaccgggggctcctccctgctcggcacggcaggccccagggagagtgggccttggcgataccccgccagcacctcgctgaggtcaagcgttgtggtggagccgccgctgacgttggcggggcgggctggggaagctggggccactggcggcgccgggaccctgaaactagggggcgggcagtggtgcctcgcgatcagggacctcggacccagggtggaggggcatgcagcgctcctcagcgagccaggacggctccccctcgtcctgcaggctcgcgacacgacgacaggctttgcccccagtgacccacctctcgacctcatcccagcaccagcccccaccccgccagagtcacaccaccgcacagctcccccgcctcacccagccgcttcatcgacggactccgcgccggccccgtgggcgtgcagcgccgccagtcgcgcgcgcctcaccgccagcccggcctcgatggggttgggcgcggcgtccgcggcgccccggcccgccacggacccgccctcctgggcggtgggatgcgcgggcttcggatgcagtgccggcgcggaccccagcgcgcgagccggcgagctgcctctcacctcctgcccgtgcacgccacccggagccgcaaccgacggcgtggccgcggtggcaaaggccggattgtaaaagaggcgggcctgggggtcgatggggggcccggtgtaggtcgcccgcatcgccatgcggtagtggtcgagctcggcgtcctgcctggcctccgcggcgcgcgccgcggaccgctcggcgctggtggcagtgtccggtccgcgtgccacgctgccggtcccccgccccccctccgtcccggggcacaccgccaggctggcgcccgccagcgccgaggccgacacgcacgacgcctcgggcccggcatccccccaggcgtggggcgccgagccccgtgtctccgcgggggagggcgctgacggcgcgcagcgcggcgccgaccctggcgccccgctggagccggagctggcggtgggcgcgcggcgcgcggcctcgcccgccctggccggcgtccgcgagtccagggaccaggctgcgccgctgacgccgccgctcaggccggggacgtcgccgccgctggactcgcactggtacagggccgcgttgaagcgcggcgccttgcgagtggagaaggaagggtcgaggggggttgcgcggcggcggagggatgggtcacccgcggcactcgccacgcgcttcaccgcacgtccttgccggtgacgaggcggtccaagtggcggggaacggcggtgcatccccatgcacagctgccccagacccgttcccgacatcgcgcacccctcgacccccgggtccgaccccaccctccgccacacccctcccacctcccgcgcgccacgaggctccagccccgcagagcgggcgaggagggccgcgccgcccagcgccaccttgcggcccgccgggcccaggggactggcctgcgcgtcgtacctcccccccgtcgccgccccgcccggcgagtcgtcgctgtcgcacagtatgtgcacggccgcgatcctgccagggtcggttccgccccggccgcccgtcgggctgccgtacttttcgcgcaggctgacctctcggggctcgccgccgccgcccttctccaggtcgggcccgcccccgctcgagggcgcgggggtgaagggcgagccggcacgggacagcgctcggcgccgccgtcgcacgcacagcagcgtgctcaccgccgccgcgatggccagcgccaccagcacggggcccaggatggcgcccagcggaggcccgcccgaggccacgctggcgtcctccaccgtgccgttggccggcgggggcggcggggcccaggcgactgcgccagggccggggccggggccgggggcgggggcgggcgc

SEQ ID NO: 36085 - DNA, 82 bp, Chlorella protothecoides
gcgggatctgactggcgcagttggttgccttgatcggcaaaccagagggggtgggggggcgggagaaggggaagcagggggg

SEQ ID NO: 36086 - DNA, 76 bp, Chlorella protothecoides
ttgcggcgcatggttgtttggaccagggtgaggggccttacgcggtccccccccccccagccccctcacgaatgaa

SEQ ID NO: 36087 - DNA, 14872 bp, Chlorella protothecoides
  modified_base (1078)..(1087): a, c, t, g, unknown or other
  modified_base (1851)..(1860): a, c, t, g, unknown or other
  modified_base (2773)..(2782): a, c, t, g, unknown or other
  modified_base (3074)..(3083): a, c, t, g, unknown or other
  modified_base (3736)..(3745): a, c, t, g, unknown or other
  modified_base (4386)..(4395): a, c, t, g, unknown or other
  modified_base (5307)..(5316): a, c, t, g, unknown or other
  modified_base (5691)..(5700): a, c, t, g, unknown or other
  modified_base (6109)..(6118): a, c, t, g, unknown or other
  modified_base (6575)..(6584): a, c, t, g, unknown or other
  modified_base (7161)..(7170): a, c, t, g, unknown or other
  modified_base (7477)..(7486): a, c, t, g, unknown or other
  modified_base (7966)..(7975): a, c, t, g, unknown or other
  modified_base (8103)..(8225): a, c, t, g, unknown or other
  modified_base (9053)..(9062): a, c, t, g, unknown or other
  modified_base (9267)..(9276): a, c, t, g, unknown or other
  modified_base (10239)..(10303): a, c, t, g, unknown or other
  modified_base (10792)..(10801): a, c, t, g, unknown or other
  modified_base (11456)..(11465): a, c, t, g, unknown or other
  modified_base (12537)..(12546): a, c, t, g, unknown or other
  modified_base (12673)..(12682): a, c, t, g, unknown or other
  modified_base (12815)..(12824): a, c, t, g, unknown or other
  modified_base (13696)..(13705): a, c, t, g, unknown or other
  modified_base (14162)..(14171): a, c, t, g, unknown or other
  modified_base (14526)..(14535): a, c, t, g, unknown or other
gactggaggtccgcgtgcgcggccccgccgaggccagcgcccagcactccggcggtggcggcggcgccggggcccagccccgtgccagcgcgcacggggttgcgccgcgccaggcgcgcggccttctcggcggccgactcggcgtagcgcaccaccagcgactgcaggctgccggcgggcgtggtgttgttcagcgcggcgatggcgcgctcgctgtcgcggcggctggccatgcgcaccagcgcggaggcgccgcggaagtggtccaggcaggggaagagcttgacgtcctgcacgccgccgatgccctcaaacagggcctggacgtcggacaccgtggaggcggcgggtaggtgcttgacatacacactctctgagggggtcaggcccgacacgggggaggcggccggcgggccagcgtcggcgtcggcaaacttcacctgcagcgtctggccgtgggtggtggtggcgtccagggcgttgatggccgcctgggcgtcctcaaaagactggaaacggacgaagccgtacctgtgcatggatggcatcggagggtggggcctgggaaggcaggcttccaagggacgcgagccaggaatgcctcactcccttccctgcatattaattcccaaagcacaggcgccagcatacacagacagcagatgtcgacgcgacattcaaggcggccagacattcaactacaatggtgcccgcaatgggggcccggagggcagacagactgggccatctcccctcccacccacccacccgccatgactcacccaaggctgtgcttggtgacagagtgccgcaccaggcgaatggatgtcagggtaccgtactgctgaaagagtgcggtgatctccacctctccccaggccagaggcaggcctcgcacgaagacattggggtgggccataggcgggttgctccccatcgaggccccgactgcccttgtcacctggcacattgcagcacacttgaagcctcctcagtagaccatgatagttattaaaggtagaatcgcgcgagaatggagcccagcacccctcggagcgagtcgaaatcctgtactgcnnnnnnnnnncttataaaaggtagaatcaagcgagaatggagcccagcatccctcggagcgagtcgaaatcctgtactgcacccttccctacccacccggtactggtcgggattgtgtgaagttctaagcacgtggccgtctccgccgcataaatagtatttgtgggagttagattagtcgatgaagaggtgcaaatgggagcatgggagggtaggagcaacaggggagacgcccgggccgggagtccgtggtagtctgataaggagcagactgagtgccaaacggaaggcggggcgagtccctgccccacaacaataagcacaatcgagctttgaatgagtatcaagcaatttcaagggctgattcgactcccacacaatgattctcccgccgtcgttgacggagacgaggttggcagggattcctccctcgtgtcgtcgcgtcacatttgcccagtccccggggagacgagcccggagcccgcagggggaagggttctgggatgatccccaatggatcaaaaccatgcaaaattcgagactgtgcatcttcaattagatgttggataaatgggatacgcagaatgatctgcagatcgcctgcgccccggcatgcaggctcgcgtctaaagcgtacgagggtaatgggcaccatgcaaggtactcctacggagctcctttcctggtcattgcagatgtaaaacaccccctcgcagatgcttgctgtgagatatttgtcgacggatggagatgaggtgtcggtgacactcagtnnnnnnnnnnatcgctgtgagatctttgtcgaccgatggagatgaggtgtcggtgacactcagtccaacctgcccgagctgcacgccaaattctcaagctgcagccggaggcttggcactagagccttttggacggaagatcaagagcgatacatggcacacgtagtgataggccgcactctgtgtcgcgagcctcgacattccaggacacctcatgttaagggtttcataggcaggggttcagcttccaagccgagagttacccaacgagcgtttcttcacgctgagctgtctggataagggtgaagaagaattgaccgaagttggacgctcctcccatcactaatgaatcccgcagcccctgcactggggggggtccatcagctccagatttcacgcagttgaaaaaaccgcggagcgcccggctccctcctggatccagacgcagcgcgttaatgcttactcacgattccagcatcgctcgcgaatctaacaggaagtatttcccaagtagattgcatggtatttatctgaacgggggtctgacaaggaaagcccccaggaaaccacatatcccgcctgcgaaggccggcactcagtgaagccctaccgatctacaagacccggccgatcccgtggggcatgagttccaacacggttagcatcatcaacaatgtcactgtgtacctgccagagtgcgctgtgcacgtgacggcggatagcatctcctacacaggctcccaggagttccaacccaccacctgggagtacttcaaggtgagcgccatctgcaccacccacgcagggagctggcgtgacccggactgaaagagtagcctttcttgctcgtctcgagagtattcacctccctatctcacaggggtttgtgccgacggtgctccccggtgtcatcctcggtggcnnnnnnnnnnataacccggactgaaagggtagccttccttgctcgtctcgagagtatccacctccctatctcacaggggtttgtgccaacggtgctccccggtgtcatcctcggtggcttggccttgattggactgatcttcttcctcgtatgggtaggcagcgatgaagtccaggcttggggtgttggacctccttcgggcagggcgagcgcgagccttgttctgcggggcatcagtcccctccgggggaccctgcgcgaggccatgggaccccagggagggacatggggaggctagcatnnnnnnnnnngtcgggcagggcgagcgcgagtcttgttctgcggggcatcagtcccccctgggggacctgcgcgaggccatggacccccagggagggacatggggaggctagcatgccacctggttgacatcacccagcccccccccctcacccccccctccggcaccctccagatctgcgtccaggcatgccgcctgcgcaagaagcccgactcagaggcacactccgagaaggaccggttgaccgagcccttcgccatggcctctggcccagggatggagcccggcaagcatgcgccccgccacgccatcctcttcatcgtcttcacgctcctcctaggcctggcggtggttggggtgtcggcgtgggggatggccctcagcatacagagcacgaaggatcagatcccagggttctgggccgtggtggacgacataaactccaatgtgagtggcggtgggacatggtgtgtgcaatgcacctgttatgggttgccgggacaatctgatgtctttatttacctcaagtctgggaagagtaaaggtggcggttcccagcaatgtgcgcttcttgcgctggggccaggactattgtgtgagattcaagccaggaatccatttccttggcctgacatgacgcaggcaaccgccatccaggggtannnnnnnnnnggtaaaggtggaggttcccggcattgtgcgcttcttgcgctggggccaggactgttgtgtacgattcaagccaggaatccatttccttggcccgtcatgacgcaggcaaccgccatccaggggtacttggccaacatcaactcgagtgtgctggtcattacgcctggcctgaacgtcatcgtcgacgaggctgcgactcgtaagtgccactgatttgctcggtacatgaatagactgctgccaccatttgctgcccatcttgagggctcctgcctgcacgcctgcagaaggtttggtcctgcagcgcacacacctaccacctccccccatccatccaccatgcagtggtcagcctgattgccgaagaggccaacgtgaccgtcagcaccagtgacatccagaatactgcacagagcctggtgaccgatctcggcaaggtaggcaactctatcagcagcgtcacgtccttcgtttacacggatatcgtccaggtgagtgtgtgcgtctgatgtgagtggggagcaccataccgctgactgccacagctgcttggacaccattgagccttctaaaagcaaacgtgggacatggctggacagaccctgagcatatagcagaagtacatggatcctgcttcgagnnnnnnnnnntgtttatacggatatcgtccaggtgagtgagtgcgtgtggtttgagtggggagcaccatgccgctgactgccacagctgcttggacaacattgagccttctaaaaagcaaaagtgggacatggccggacagaccctgaacacatagcagaagtacatggatcctgcttcgagtaccattcatttcccacatgccacatcaatcaatgcattttaagaacttttattcatttcctttcctcaaatcgacccatcccatcactcttgcagcgggttacgagactgtatggcaacagtgtatggactgtgacgcagagggtgcaacacacatatcgcttcatccccattgccattgtattcggcgtcgtcatcctcctcacgctcatcctgctgtggctgggagcgcggatgaagtaccccaagacgacctcatttgtcgtcgcgctgtactggacatcggtcgccctgctcatgttcctgggagtgggtgaggcggaggaagcggcaggaggctgctgtgctagcactagtggatttgggcgggcaaagttgtttgctgctctgccctttttgcctttttcaatggtgcggcctcattcgatgcaaacctacttgggcatgctttgccatcagtttggggtctggatgggcaaccctccccgtgcatgagcgctgtccactcacatccacccaacctgcacccacccaggcctgctcaacggaatattcgaggttgcaaatgatgcatgtcgctactccgagacttatgcccacgatcgtatacgctcttcaatgagttcaaggaacctgggtctggtaggttggtgcagggcggcttgttcgtatgggggcgacgcctgtctccgggatgcatgccagcaaacgaagaggctgcccaggcagccctggagcannnnnnnnnnatacgggggcgacgcctgtctcctggatgcatgccagcaatcgaagaggctgcccaggcagccctggagcacggttctgaatggcaaccccgcctcggcctccgacccctgtcaccgcagtttgatagggtgtggtcgtactacatcgtaaacacccctatctctgtgccgtatgctgactacatcaccggagcaccggtgcaggaggtccttgccgccctgcaggtgggatgatggtggtgtgtgacagggagccgtggtacactgacagccatctccaggtctctttccgcaaagctgatcagtgcaattgcctctggctcaacctccttcttacaccacacctctccccacacagaccagcgacgtggatgnnnnnnnnnngcctcaaggtctccttcagcaaagctgatcagtgcgattgcctctggctcatcctccttcttacaccacaactctccccacacagaccagcgacgtggatgacataatccaagcactgtccaggcttaacaccacggtgatccagacccagactgggctcagcagctcggacgccgcggccgtcagcactgccgtccaggccatccccacgctcctcaaaagcagtgagcccggaggccagagccctgtggagttgcgagaggttctctggtatcttgcaccctcgtcgctgtcgtgccagggcagggtggctatgctttgacagtcacgcatggtgtgctcaactgacaccctgtctgacttgccccactcccccttacccacaagtcgtcggcttggtggccagccnnnnnnnnnntacgcatggtgtgcgcaactgataccctgtctgacttgccccactccccctgacccacaagtcgtcggcttggtggccagcctgtcgcgagagaatctgcgcccgatctacctgaacctcaaggttctcgcctgctgcaccatggccaacaaagtacacagcacctgggtttcatggacggtggcgggggtcctcgcctttgtctttgcgctgctcctctctgcgcgagtcatcagccacacggtcgtcacggccaggcagcgacgtttggaggtgcgtgctggaaaggggctgtaccggggactggagggtgggcaggtggtcatgtcctgtggggtgatttcgggtcactcacgatagcaggcctgcgctccctgcactgtggagccccccctttgcgggtcccttgacgagccaagcccgcttaaccgggtcccctctcctgacaggaggaggnnnnnnnnnntactggagggtgggcaggtggtcatgtccttttggttgattcgggtcactcacgatagaaggcctgcgctctttgtactgtggagccccccctttgcgggccccttgacgagccaagctcgctgaaccgggtcccctctcctgacaggaggaggagatgcagcgcgcgttcatgacctccgtggaggcctttgacgcctaccacgcgagcatgccacctgggcagcccgctccctccgcccagcccccaccctcagctggagccaaccatccgagctccggtctggcatcacccgaatgttcggaccccagtgctccaccaatgcctcccccaaggcatgcaggatattatgatggccgctacaacagctgatgtgcaggcccctgtacttgtaaatatgacttctgacgacaagtgtctcaggatcgagtcttcaccaccctcaatggccggtgccccctcaccattgcctgctcaatttgctcatgtaaacagagctctgccgcctcacacacattgcctccagctgtggcatcttacacggccgtgtgctgtcgcgaacaagccagtgcagtgnnnnnnnnnngtgtgatcacgacttctgacgacgagtgtctcaggatcgagtcttcgccaccctcaatggccggtgcccccccatcactgcctgctcgatttgctcatgtatacagagctctgccgcctcacacacattgcctcaagctgtggcgtcttaaatggctgtgtgctgtcgcgaacaagccagtgcagtggtgggcatgcgggtggcaggggcgcaggagcgtcggagtcctcaccaccacctgccccagctgtgggtctggagagccggcccacccgcttgggcctgccgatcctgggaaggagagagnnnnnnnnnntcggagcatcggagtcctcgccacctcctgccccagctgtgggcctggagagccggcccacgcgattgggcctgccgatcctgggaaggagagagtataccatgccccgaattcatcgggcagggggttgagagtgttgggatgaaagggcgcattattgttccaaaggatcaaggagaggagagtgctcttgcggcggcacgggccgtcggcccaccagcccccatgtgccagtcgcggctccatgtcatgggggtggctggaccgccgtcgcacccttgccggtgcccgtggagaatctaggggctatggcgttgctgctgaagcagctctccatgggggagggggccaggcggaaggaggcctgcggcacgccaggcaatgccgctgcctcaccagacagggtgcccgaggtggaggccgggccggggccccctggcgcggcctgcgggggcgcgtcgaagggcgaggatgggaagnnnnnnnnnnacctgcgacggcacgggtcgtcggccagccacccccatgtgacagtcgctgctccatgtcatgggggtggctggacccccgtcacacccttgccggcgcccgtggagaatctaggggctatggcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgccagacgggatgcccgaggtgaaggcggggccggcgccggggtcccctggcgcggcctgtgggggcgcgtcgaagggcgaggatgggaaggaaggactggccctgacccggacgccaggtgattcgccttgcacgccggcagcggtgcccgccccgccgccactgcctgccgcgccgctgctgctggccgccccgccgctgccgctcctctcctgctgctgctggcgggaggtggccgactccccaccctcgctggcgcgggggggggcgctgggcgcttgcggggcgggtgcctcggcgatcccgcccagcacagcctgtcgctcctgcgcggtgtggcaggtgtgtggtgggagccgtatcagctactgggtgggaggggcgccaaacggcctgtacggagcagggcatgcaaggatggcacccgcgggcccggtctgcacatcaggcttgcccctcaatagaccatccgattgagtgcacaggctgactgcatccgcacgtcccccctccccgcccccaatcccaccccacactcaccgctgacgcggcctcggcgaccgcctcctccggcgaggcgctgctgaggtccacgacgacgaccgtgacgttgtcccgactgccccggtccaccgccgcgcgggtcagcacggtggctgccactcttgccgcgctctgccgatgcggggtgggttgaggacggcctgagtgtccacgacgtcgctgtccgattctccaccgcccctccacaccctgttcctccgtgctgctcacaccctgggccccaccccagcaccccgccgtctcgacaccccactccctgnnnnnnnnnntaggtttgtgtgtgctcatcctgtcaccgtgcacggccgcagggctgtggtcgccacggcctccacgcacacgaccatcacagggtccctcacacgtgtgcagcagccacgcggtacccaccccctccctgccccgatacacccacacagtggaacccgcccacctccggctcggcaatgacgtagggccgcaggctgtggtcgnnnnnnnnnncccgattctccaccgccctccacgccctgttcctccgtgctgctcacaccctggaccccaccccaacaccccgccgtctcgacaccccactccctgtgcctctcaagggctcgcaggctcccccgttgaaacggggcattcccagcaccaggcaccctcgcctgcctgccacaccgccgccaagcccacctgtcggctgctgccacgctggcgggcgcggaggaggcactttcgggccagggtgcaagcctcctggttgcccatcacgtcccacagcccgtcgctggccatgaccaggagctcgtctgcagggtgccggtgcacgatggtgacctgcgaggggagtgggagtgggctgggtttgtgtgtgctcatcctgtcactgtgcacggccgcagggctgcggtcgccacggcctccacacacacaaacatcacagggtccctcacacgtgtgcagtaggcaggcggtacctaccccctccccccccgatacacccacggagtggaacccgcccacctccggctctgcaatgacgtagggccgcaggctgtggtcgccgatggcgcgtgacacggccagcaggcccatgacgcggacgccgttccagaacaggatctgcccgcccgcggcctccacgcgcgcggtctcgtcctcccgcgccgccttgtggtcgtcggtcagcggcagggccaggccatcccggcacagcaccgcgcgcgagtcgccggcgttcgccacatacagcatgctggcgccaatgaggaccaccaccgcagtggtgcccaccaaggccaggtgctcatagccgcccgcccgtccaaactcgtcgtccgtgaggtggaaggcgcgggtcagcgccgcttctaccgcctcccgccccacgctcagcgacagcggcgaggcgccgggcggggaggcgccctgcatcgcggccgccgctgccgtcgaggcggcggccgnnnnnnnnnnnnnnnnnnnnnnnnnnnnnnnnnnnnnnnnnnnnnnnnnnnnnnnnnnnnnnnnngacgaaccccagggtcgagctgtcgtcgctgcgctcaggcccggacccgatcgtcgtgccggtggtggtggtgccggcagcggacagggaggcggcgatgtccaggacgctggcgtcggcagagggggccggcgggggcttgacctcgtcggcggcctcgccggcggccgcgccgcgcggcagcgcggcctccaggccgccatcgtcgccgcggagcagggcctcgttgccctcgaacacctcacgcacgcgcgtgtgcagcacccgtgagcagtgcagcgcggcgtcggcgccgccatggccgtcgaagacgccgaagaagtgcagcgtctcgcgcacggagctgccgctggtgtcgccgtcggagagagggccggcaggtcggggtcctgaccccccgcttgtcaggctggagttcaaggagccctccgcgctggcccccgacccgggcgaggtccgggtgatcacccgcgccgagcgcaggagggnnnnnnnnnnccctgacccgccgcttgtcaggctggagttcatggagccctcagcgctggcccccgacccgggcgaggtctgggtgatcacccgcgccgagcgcaggaggggggccacgcgcggcggcagcgactcctccaggccccccgagtctacgacaacggagaggagggagggcaccacgacgcaggcatcctccatcttggacctcctcccgatcacggccttgctgccaaagggggggcaggtgttgttggcccgcgccgtgggagagccctggggggtgtccccggaggaggcacgccgcgccgcctgctgctgctgctggtgggcgggcgacatgctgactgcctgctgcgaccctggcgtgtgggcatgctgctgcgtgctggcatccgacgctgcagatgtcgtgggcgcgtcgcccgaccgatgcgcgggggggtcacgccccaggcttctccttgccggtgagagctgggatccttgcagtcgatcatctgcaggagggcggggtggggagggtgcatttgatatgcagggcctggcagcggacaggggacgttgggccaggagccaggggccgcactggaccagcctcgtcctgtacgcgtccacaatgagggtggccctcgggacagcagcgactccctcaccttggccnnnnnnnnnnggatgtcgtgggcgcgtcgcccgaccgatgtgcgggggggtcacgccccaagcttctccttgccggtgaaagctgggatccttgcagtcgatcatctgcaggagggagggttggggagggtaagtttgatatgcagggcctggcagcggataggggacattgggccaggagtggggggcgcactggaccagcctcgtcctgtacgggtccacagggagggtggccctcgcgggacagcagcgactccctcaccttggcccatggagttctgcttcttgaggggctgcagctccgcccgacactccggcacaggcgagcctgaccgatggcgccgggcaacccggcgtggtgtcagcgtgcccggggggaggggttcttcaccccgagagacgtccgcgggcacctccacacccgcacgcctgatacccggaaccttgtctgccggtaatcctactctcctcctacaacgcgggggaaaggtgtggatgcatgagcctgcattcaagcatgggcggcaccggctcctgcctcgaagctagagcgcgggggccggaggctggggaaaacaggcagcgtgacccgcgacgccgatgcagaggccacaaggatgaaagtttgaggtctggcccgagcggcggacacgggctcaccgtggaaggcggaagatgcagcaccactgacgttggggggagtgctcagcggccgggacatggcttttcccccgccattcttgggccatagagcatcgaaatggatggatggggtcactcgaggtcctcggtcgggttcacagggcgcctcatcatcgctcactgggaaagctgagcggagagctgtggcattgatcgacccgggaggcacccgttgcgaaggtcctgtcggaaagactgagagggaacttcccaattccgaccgccctttgaacagtaacactctgcggcaaggattgggcgacctaaatagaagctcggtatggagtcacctccgtcccgatggaagcgtgttcgctgcaactccactgctttcagagcaggaacgggttggggtcacgtggcactcaaccctgcgcccnnnnnnnnnnattatttcagagcaggaacgggctggggtcacgtggcactcaaccctgcgccctccctgctgcagcttccgtacgatacatggtctggcacctctggtgtgctcaggcacacccacatgctcctttnnnnnnnnnnccccgtgttcacctggaggcaccctccaagccagacccatcctggccaggacccactgtccgggtctcaagcgcattacaacttctaagaaaggtcaacaaagagttttctttagagattgcaaagttagggnnnnnnnnnncagacagagaggcgtggtgccaaaacctgattgtcagcctggatgaggcacggggggaggggagtgtcccgtgtttacctggaggcaccctccaagccagacccttcctggccaggactcactctccgggtctcaagcgcattacaacctctaagaaaggtcaacaacgagttttctttagagattgcaaagttaggggcagtccttggcatatgtagggcgcagatgtagtgagcggggggggagtgaagcggggggggggcggttccttgtgggagggcaatgtgccacagaccggcctcctccagccgccctgcccaggcctgagagcactggggccacgcaaatcctccccacgccacgagtaataggagcatggacaaggcaaagcagacaaacacggggaaagaggtcgtctggggacgaagagtgcgggggttgggagctggcaaactccatcgagctccatgcgcgcaccggggcacggaggggatgggtccagcccggcagtacatcccagctccaagacgtaaagccagggtaatcgaacagggaaggggaggaggcaagtaaatcaaatgtggctcggtgtctggggacacctcagggcacgctgctcccgcttgtgcagggaggaggggcagcctggagggatggcatgtggctgtcgcagcacgtcgtgtgcgtgctgatcggcctccctccacagggctccccgccggctggaccagcaggactcaatttcacgctgaaaggtgtggtgcaactcccctcacgctcattcgagggcggcgaggtggtgccacaccccctcgcctgcaatgagtggaggggatccactccctcacgtcgacaggcgcggtttcacgtcnnnnnnnnnnatgtggtgcagctcccctcacactcattccagggcggcgaggtggtgccacgcccccttgcctgcaatgagtggaggggatccactcccctcacgtcgacaggcgcggtttcacgtcgccaggcagcgcgacgactggggggcggggtgggggtttgcgtcagcggatgggtgcgggcagggcaggctcgatgcgccggcggcacgaccgtcccgcacgccggagggggggatcccaagttgttcgcatgtccgcctgccacccggaccccttcagctggcgggtgcgtgcaggtgaggagccccgagtttcctacccccctccttcttccgaccacaccagcagcccccgacccacgcgcgcggcgcacccccccaaaacacacacacacactcactgggcgcgagggcggcggcggcagagtacgcggcggggtcgcccgccagcgcctgcgcgnnnnnnnnnntcactaggcgcgagggcggcggcggcagagtatgcggcggggtcgcccgccagcgcctgcgcgctgggcatcagcgcctccatgccgggcgggaactcgaggtgcgcgggcagcacgccgcccggcacctgcatcagcgcctgcgccgccacgtgggcctgggcctgcatggacccgggcgtgccgccgtcccgtgccccggccgacatgctcagcgagcgcggcgcctgcagcagagggggggggggtgtgttcggggtgaccggcatcagacgggccgcccaaggtgcggcagcgccggggccacaaccccatgacgccccgtgctggtcgtttggccgccctctcgcagctnnnnnnnnnntttgtttggggtgaccggcgtcagacgggccgcccaaggtgcggcagagcaggggccacaaccccatgacggcccatgctggtcgtttggccgccctctcgcagctcgtcgcggccagacgccctcaaacacccctcccgctggtcccccaccgagggaccccgcccctgctttccccccaaagcctaccggcggcgcgtgcaggctgctcatggagcgctccaggctcacgctggcggcggcggcgatggccgcggcgtgctgctgctgcgccgcctgcgcctgcgccgccgcggcggcctggtactggtggtgctgcgcggcggccgcggcggtg

SEQ ID NO: 36088 - DNA, 61 bp, Chlorella protothecoides
ctcctgcttgtgctgtgctgcaacctgtgcaagctcagcgcgatgtgcccggtgcagctca

SEQ ID NO: 36089 - DNA, 91 bp, Chlorella protothecoides
agcatgagcgaggcctccttgggggtgggggtatcagcaacggattggtgtctggcgccactggcagaggactgtttcaccgaacacagtg

SEQ ID NO: 36090 - DNA, 112 bp, Chlorella protothecoides
aaaatcccttgcctgatctgcgagacctcccgcaaactcttcggctgcgggccgtgcactggaagacagtgtgactggtcgatcaggctgtaggtgaggcatgccaaaccag

SEQ ID NO: 36091 - DNA, 116 bp, Chlorella protothecoides
atggaccttgaccccaaccccatctcacctcactccactcaccctttcctccaacagcccacggtcccccctcctttccccccccccagtgatgaacgccctgctgagcctgagcc

SEQ ID NO: 36092 - DNA, 74 bp, Chlorella protothecoides
cacgtggccaccaaccgccggcgcaagtaggaaagggggtccgaaaggcgtcggggagggacggagtagacttc

SEQ ID NO: 36093 - DNA, 440 bp, Chlorella protothecoides
  modified_base (190)..(294): a, c, t, g, unknown or other
  modified_base (353)..(382): a, c, t, g, unknown or other
tggctccgccacctgagatgctggactgcaatgtctggatgtcgcggaaggaggcgacatccagccccgcctggaggggcgagtacctctcgcagtcaggggggccgggtgagctgcgatggaacagcccctgcagaaggaatgtgagaggggggggggtgccctctagagcgcagcatatggagcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctcaaggcggacctgcccctggctgtacttcctcggtacaagcgacccgcgcatnnnnnnnnnnnnnnnnnnnnnnnnnnnnnngagccccaaggcagacctgcccctggcagtacttcctcggtacaagcgacccgcgcat

SEQ ID NO: 36094 - DNA, 72 bp, Chlorella protothecoides
cgtgggatatcgaggagaacttggtacgctttgacaagtcataatacgtttggaaatggtgatcgggctgcc

SEQ ID NO: 36095 - DNA, 137 bp, Chlorella protothecoides
ttcggctgaggcgggcgggtccactgacgcagacacaggaagtggcagcgcagctgccgggagggggcctggcagcgccgctgctggggctggcagggctggcaccgccgccgggggaaggtctggaagcgcctctg

SEQ ID NO: 36096 - DNA, 795 bp, Chlorella protothecoides
  modified_base (160)..(256): a, c, t, g, unknown or other
cccccccatcccccctcctccctgcccccctttccaccagaaacagaacccagccccagccacccaccgtggggttgtggaggtggtacaggaccatcatggagctgtgcttggtgcggcgcagggagtcgaactggtagtggttgccctggcacagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaagaactcgttctccatctccggcgcgccgtcggcggtgggcgggatgagggcgcagggcaggggccgcagcgcgcccagctcgatgcccgcgggcaggcccggcaggcagggcggggcggaggggtcgggggcacgcggcgcggccagcgcccccgacccggcaccggcgccggcggccgccgcgctgtagcaggcggggcagagctggaagcgggtgagggtctgggtgcggctggcctcgccgccggggcggtccagcgcgatgccgtcaaaggtgcgctccgcgcgcaccgtgacgcgcgcggggggggaggggtgcaccagacgcacgtccccagagatgtagccgcggcaggagctgcacggctccgccaggtgggccacgatgaagtcctcgcgcatgccgctgatggtttcgcccagccgcgccaggatgcgcacgtccagacctgcgccctgcagccccagccgcttgcccttggtggccttgctccggcccccacctgtggtagatgtgtgtgtgtgtgtggggggg

SEQ ID NO: 36097 - DNA, 76 bp, Chlorella protothecoides
cgaagggccaccagcgcccggggccggccatccctgggcagcctgcctgtggcccctccgcctgatcctcccgacc

SEQ ID NO: 36098 - DNA, 40616 bp, Chlorella protothecoides
  modified_base (975)..(984): a, c, t, g, unknown or other
  modified_base (1546)..(1555): a, c, t, g, unknown or other
  modified_base (2307)..(2316): a, c, t, g, unknown or other
  modified_base (2796)..(2805): a, c, t, g, unknown or other
  modified_base (3164)..(3173): a, c, t, g, unknown or other
  modified_base (4001)..(4010): a, c, t, g, unknown or other
  modified_base (5115)..(5124): a, c, t, g, unknown or other
  modified_base (5663)..(5672): a, c, t, g, unknown or other
  modified_base (5951)..(5960): a, c, t, g, unknown or other
  modified_base (6565)..(6574): a, c, t, g, unknown or other
  modified_base (7112)..(7121): a, c, t, g, unknown or other
  modified_base (7317)..(7326): a, c, t, g, unknown or other
  modified_base (7444)..(7453): a, c, t, g, unknown or other
  modified_base (7607)..(7616): a, c, t, g, unknown or other
  modified_base (8046)..(8055): a, c, t, g, unknown or other
  modified_base (8471)..(8480): a, c, t, g, unknown or other
  modified_base (8598)..(8725): a, c, t, g, unknown or other
  modified_base (8795)..(8804): a, c, t, g, unknown or other
  modified_base (8869)..(8878): a, c, t, g, unknown or other
  modified_base (10462)..(10471): a, c, t, g, unknown or other
  modified_base (10885)..(10894): a, c, t, g, unknown or other
  modified_base (10957)..(10966): a, c, t, g, unknown or other
  modified_base (11657)..(11666): a, c, t, g, unknown or other
  modified_base (12902)..(12911): a, c, t, g, unknown or other
  modified_base (13020)..(13029): a, c, t, g, unknown or other
  modified_base (13338)..(13347): a, c, t, g, unknown or other
  modified_base (13724)..(13733): a, c, t, g, unknown or other
  modified_base (15150)..(15159): a, c, t, g, unknown or other
  modified_base (15594)..(15603): a, c, t, g, unknown or other
  modified_base (16051)..(16060): a, c, t, g, unknown or other
  modified_base (17566)..(17582): a, c, t, g, unknown or other
  modified_base (17747)..(17756): a, c, t, g, unknown or other
  modified_base (17962)..(17971): a, c, t, g, unknown or other
  modified_base (18125)..(18134): a, c, t, g, unknown or other
  modified_base (18533)..(18542): a, c, t, g, unknown or other
  modified_base (18719)..(18728): a, c, t, g, unknown or other
  modified_base (19062)..(19071): a, c, t, g, unknown or other
  modified_base (19374)..(19383): a, c, t, g, unknown or other
  modified_base (20451)..(20460): a, c, t, g, unknown or other
  modified_base (21051)..(21060): a, c, t, g, unknown or other
  modified_base (21606)..(21615): a, c, t, g, unknown or other
  modified_base (22104)..(22113): a, c, t, g, unknown or other
  modified_base (22729)..(22738): a, c, t, g, unknown or other
  modified_base (22960)..(22969): a, c, t, g, unknown or other
  modified_base (23247)..(23256): a, c, t, g, unknown or other
  modified_base (23734)..(23743): a, c, t, g, unknown or other
  modified_base (24556)..(24565): a, c, t, g, unknown or other
  modified_base (26288)..(26297): a, c, t, g, unknown or other
  modified_base (27098)..(27107): a, c, t, g, unknown or other
  modified_base (27517)..(27526): a, c, t, g, unknown or other
  modified_base (28701)..(28710): a, c, t, g, unknown or other
  modified_base (28866)..(28875): a, c, t, g, unknown or other
  modified_base (30672)..(30681): a, c, t, g, unknown or other
  modified_base (31403)..(31412): a, c, t, g, unknown or other
  modified_base (32790)..(32799): a, c, t, g, unknown or other
  modified_base (33537)..(33546): a, c, t, g, unknown or other
  modified_base (34085)..(34094): a, c, t, g, unknown or other
  modified_base (34718)..(34727): a, c, t, g, unknown or other
  modified_base (35161)..(35170): a, c, t, g, unknown or other
  modified_base (35810)..(35819): a, c, t, g, unknown or other
  modified_base (36095)..(36104): a, c, t, g, unknown or other
  modified_base (37011)..(37020): a, c, t, g, unknown or other
  modified_base (37436)..(37445): a, c, t, g, unknown or other
  modified_base (37593)..(37602): a, c, t, g, unknown or other
  modified_base (38057)..(38066): a, c, t, g, unknown or other
  modified_base (38152)..(38161): a, c, t, g, unknown or other
  modified_base (39539)..(39548): a, c, t, g, unknown or other
cgggggggggctggagctgcacaggaggccgtgcgactcctggcgccgttcatggagtgatatacactggcgtttggtggccacaggggcagaggaacgtcgggctttcaagcgtggaatgaagggccagcatgtttgtcgatgccgctcgccagctgctctgagtgccaaaaccagggcacctgttcgatctccccgtccagtcaacccgtctcacatgcagtgtgtctggtcgacagtcttgtgggacaggggcacgagcatgtatgtttttgcatcagtgtggatcacaggtgtcaggcagggaggtcaacggagcagctgctgccaaacagcatgccctgctcttctcctccgtggtcaaaatgacagcggcactccatcacgctgcgcgcgggtctctggtgcaatcagtagggtggtggcacaggggaggcaggctgcctggtggtcaaagaaggcccaccactctctgactgtgggaaggccctgatctcgagcgcggttcctcaggagaaagggcaaggacagacgtcacggcacactcggcgttactccagcctcaggcagtgcagcccccagagaaagcgtggcccaggctgcaacactccactttggacgcgtaggcgccccagcctcgctggcagaccgactgatcgtcggtctgggagcatgcctgcttcgggtaccactgggaagctgcccagcagggggccaccttgtagcagcccccggcgaatgcggcgccgggggcacagcaatcgtcctgactggtccactgcgcatgggaatgcccgggacgctggtgtgtcgggtgtgactcgggcatgccaagggacaggcctcagcctgggtgacatgacagacgagagcactcttcggttcagaccaacacgtgcgatggggtttgcccatgaacaggcactccatgtactcggagaccccctctcctacctgaccccagttctgggcacnnnnnnnnnnacgggacgctggtgtgtcgggtgtgactcgagcttgccaagggacagacctcagcctgggtgaaatgacagacgagagcatacttcgtttcagaccaacacttgcggtggggtttgcccatgaacaagcactccatgtactcggagacaacctctcctacctgaccccagttctgggcacactgggtggcgtttctgctgactgtgcaggtcttggtcgggtagtaggtgcctgccacccagcactctgccacctcggaggagcagccaccggggaaggccccagcgccactggcactgcagcagatgtcctcggtagcgtatgcattgaagccgcgcacgcaggcagagaggctggtctcctttctgcaggtctgaattgggtacctgaggagggtgggaatccatgcgtttctctgtgagcctttggagaacgttctgactcaggtggagtgatccatgctcccagtgctgggccggtgttcatggcggcgacacgtgaggaacatatagtttgatggtcaccaaactcaactcagaccacttgccaggagtcaggcacnnnnnnnnnngctgactcaggtgtagggatccatgctcccagtgctgggctggtgttcatggtggcgacacgtgaggaacatatgctttgatggtcaccaaattaaactcagaccacttgccaggagtcaggcacgtagcagggggcggtgaggtgggcctggttaaggcctctagaggcgtacgtcagtgcgcacaggctgagcagggttgccaggaacagtttcggagggttggagtgcatggtgccgagcggtgggtctcgatacgtataccttggcttatgcccgcgatctgtactatactgtagcaagacaagtactttatacccccgaatgcccaattatccgagatggccgcgtatgaattccgtgggaactcgcctgttccggcatgggtggtgtgggttccggagagcggaggccaaaccatgtgactggaggtggccgtgggacatttcgtaccagggtccctcagccccattcaatcaggattaccccacgagcgacttgacctcgaacacgtaatggatactcgcaagaggggcgcctacaatacgcgcattcatatcgaccatgcaaccccttgcgacgatgcaactttgacgtatctacgaaacccagatacactgccagatccaggtatgatacatgtgcacacagctgacttcgcttctggatgaacagatcctatgatatgcagaaacttctcaggggttaaagagctcgtcgtgagaaaaggcttgaagctctggatcatccannnnnnnnnntttttacgtatctacgaaacccaggtacaagatacactgccagatccaggtatgatatatgtgcacacagctgacttcgcttgtaaatgaccagatcttatgatatgcagaaacttctcagggggtaaagagcttgtcgcgagaaaaggcttgaagctctggatcatccaactgcacgcgtgcaatcccaatatctcgtcgtatctgagatagcagctccggcaggcccccaaaagaaatctccggtctgcatttgcatggagatcgggaagatctggtaaatactggtggatatccaatccaggaacaaatattgcaccgtagcggtagatttatgctgagatcttaaaacgataggcggagcttctatgaacatcgaatatacccaaagaaccccctacaagctaacccgagcatgagcaatccagcggcaagtgaccatttgtgccagatttaaccacctctcccggccctctcacnnnnnnnnnncaagaaccctacaagctaacccgaacatgagcaatccagaggcaagtgaccatttgtgctagatttaaccacctctcccggccctctcacctcataaatcccaggatcacaagttttgtggaccgtccgtagaaatcctctgagaacccatgcatgatgtgtgcctccacactcacttccgggtctgctcacagaggatgacggactggttggttggtgataaaacatgtgagccaactcgcgagcgtgttgtgaacaggtctgagtgcattccttccattcgcttgcaaagcctgcacccattggcacttgtattctgagagcactcaatcatttgaatcctcgcacctgcatccccnnnnnnnnnnttattcgcttgcaaagcctgcagccattggcacttgtattctgagaacactaaatcatttgaatcctcgcacctgcatccccgaaagtaggccgctctcctacattgaggaccatcttatgaacagccctgtctgcgtctggtgcgtctggcaccgcgtcgacttgggcccacctgcactcgacatacaggaggacaaggccgaaggggtgctgtgggcatcatcgcatggcagcttcaatgacaatgcctccaggtcattctctcgagccgagagcggcacccaacccaagaggtgctggggaggcaggcgtgccagtccctctgccatcattcaacccacacccccaagcagctcacccaaagtagactcccttcggaagactgtcaggaaatccttccgggggaacattcgcggtcgggactcctagctgacgagatcctcgcccaaacccagatacaacaggcccgctcatccgcagcggtcctcctgggaaagcataccgcagtggtacctgaggagggtggcgaggttacaactggaaatagtagactttgactgaaatgaaaatgacacactttgggtcgaacctttccatcctgttgcacatcaatatctcccaaacctgaaggagtgcgcgatacatgtcaggctggtccacatactcgcgacatgcgaggggcagggtatggatcaggcgctgcaaggccacctcgtctggcagctcatgcggtaccacctcgggctctctttgcctgtgtcgcaaatgcgagacagtgttcggaagggctgtgcttagtgttggtcacttgaaggccatgtgaactnnnnnnnnnnaggctctctttgtctgtgtcgcaaatgcgagacagtgtttggaagggctgtattgagtgttggtcacttgaaggccatgtgaactttatgtttcgttactacagccaaacttccgcaaagctgtcaatcaatgcacctcctgaactcatcctgccacctgaattcctggagccaagcacgccctagcgggtgactgatgctgatgtacccgcctggttggatcagctgcgtcgcccgcagcagcgcggcatgctggtcgtacagatttccgaagacggcgttgaagaaaacggcggaaaacgggccctgcgacgatcttaggggactgatcagactgcatcgacaaatctcagagcaggtgcttcgtgcgcaacaagggcctcctcaactacctgcccatcccccaggacatgctatcacctggtacaaaggaagctctgccacgtctcccggccatgtgcgcacacatggcacattgcccaggctgtcaccctgcccgaaccgtgcctccacctgagccagcatggcagggcaggtgtccacagccagaatgtcttggatgcccagggcttgcaggtggggaatcagggcctcgatcccacacccagcatccagcactcggctggcaggccccaggccaggcaccgagccggctatcgtgtgcaggcgggcatcgatctcgggggtgatgccgtccctcaaatcctgcacccgcgacgagaagaaggacgcctgacgctccgcgtgggtcctggcctctgatgcagaggcctgcacggacagagatcgggaatgtacaggaatttccctgcacccagctcgcagatcacgcctgagcggacgaactcgcggcacggaaccgggggatccagcagagcaccctccagcgtgcgaccgtatcggcacgaggatgggagctggtgccgcgcatgcaaacattgctgtgttgtggaggcttcaaagcaatggttctgggtgtcgtgcgggaaatgggtcgcgatcacatacatgcgtcatggctgagaattcctgccggggcgccagcgccctgcgaaccccatgtgtggagtacctttggtgtacgagggacggcagtttacacgannnnnnnnnntgcatgcaaacattgctgtgatgtggaggcttcaaagcaatggtcctgggtgtcgtgcgggaagtgggtcgcgatcacatacatgcgtcatggctgagagttcctgccggggcaccagcgccctgcgaaccccaatgtgcggagtaccttggtgtacgagggacggcagtttacacgatcctgtagcgtgaatggtggcagaccagagcgagagcaagtcaagaagagcacacaaagtcaaggaccgggaagagggatccatggcatcacaccgcgtcactgcaccggcacccgcgggtccgtgccaagactcatctgagcggcgagttggccggagagcgcgtcctctcctcccgccctctcgatctgtgggatgggcgacggatgatgggccctcgatgtcggacaatgctctgcacatgctgcacctcggtcgagtcattcggtctactggccggccagaccagcacaccacacagtgccttggacctgcacaccgtccctcaggcagcggacagcaccacaaactcacataatcnnnnnnnnnncggacctgcacaccgcccctcacccagcggacagcaccacaaactcacataatcggcgctctccgcggccgcgtactcgtcgctcatgccctggaccacctcccgcgcgtccaggaactcatccaggctcagctcgatgccagacccgctggaccgatggaacatggggaattcctgcgcagggggcaggggagaatgggaatgtaatgcaggagggtgggatggggggatggggagatcagtgtgcggcgtgagggcagcgctcctcgccagcctcannnnnnnnnngtccaggctcagctcgatgccagacccactggatcgatggaacatggggaactcctgcgcgggggggcatgggagaatgggaatgacatgcagaagggtggggtggggggatggggagatcagtgtgcagcgtgagggcagcgctcctcgccagcctcacccgaagcatcagcctccaaagcgccagctcgaatgacagcggctctgcagattggcactcgtggtcccccaacaagcgccaataaaccctctcccaccccaccttgtagttgtccacgaaggccttgcgctggaagagcttgtcgaactgggagatggtgcggttgaacaggtggcggatggaggtgtggtttgccagcatcaggcccgacacccggtgtcccgatttggtgtacggcgacttgcgggacagcgccacctggcgggaggtgttaggagttgcttttccttagaataggggcatgccttcccatgtaccttgccactgctgagagggtggcagtggtgtccccggacaggccacgctgccagagtatcctggaattccggccctgtgcatctcagcctccctcccagcacctggatggaggcggggccccactcgnnnnnnnnnngggtgttgggagttgctcttccttagaatgggggcatgccgtcccatgtaccttgccaccgctgagagggtggcagtggtgtccccgggcaggccacgctggcagagcatcctggaatgccagccctgtgcatctcagccttcctccaagcacctggatggaggcggggccccactcgatgaagttggccagccgccgctcccggatgcgcatcagggactggtggagctgggtggggtccacgtcgccctgcatggtgaggaaagcacggaaatgctgagcctgtggcttcacgtgtgctcgagttcggacactggcgtgccagcgggctgcgccgcagcggcctgacgggcagacacgccacgcagcgacaggcacgcaaattcatcacaggagacggggcgcccatgcaaggtgccgtcactggcatcccctggcagatgagcctgcgcacccaatccctcttttcctgcatgccttcctccccatcatcccgctcaccccccacctccccctttccaacacacctggatgatgnnnnnnnnnngatcccctggcagatgagcctgcgcccccaatccctcttttcccgcatgcctttctccccatcatcccgctcaccccccaccctccccctttccaacacacctggatgatgttcaggatggagatgtacttggactggtcaaggcccttggcacgcgagggcgtggacaccatgaggttcttgggctgtgggtgtnnnnnnnnnnagaaatgctgagcctgtggcttcacctgtgctcgagtttgggctcttgcgtgccgacgggctacgccgcagcggcctgacgggcaggcacgccacgcagcgacaggcacgcaaattcnnnnnnnnnncgagggagggaaggtgggaatggaccccagggaatcttgcaattccacatccactgcagcccagatgtcccttctgcagccaccaactcgcaaaacgggctgctgatgtcccaagctcagccgcaatccggcgctcttccctccagttcatccnnnnnnnnnntgagggagggaaggtgggaatggacctcagggaatcttacaattccacatccactgcagcccagatgtcactttgcagccacaaattcgcaaaacgggctgctgatgtcccaaggtcagccacaatccggcgctcttccctccagttcatccccaaaccaccatcaagatccgtacctggagtagccggcgcatgacatccagcaccgtggtcttcctgacgatggccgccgccctgctttcctcgctgtccagggtcacgggggtgtaacctgggcatgatgtccgagagcacgtggcattggggaggaggcgtcggtctgggtttccctccccgcacagcgatccccactccccggccccagctgcctgaaacgcgcaggctgcggcgattgcccccccctgccctggccccctcccacgcaccggcnnnnnnnnnncagagcccgtggcattggggaggaggcgttagtctggttttccctccctgcacagcgatccccactccccagccccagctgcctgaggagggcaggctgcggcgagtgccccaccctgccctggccccctcccacgcaccggccatgaggaagtggcactgcgggatggggatgagggaggccagcaggcccacaaggtcgttgttcatgtagcctgcagagggttgttccaggaaagagggaaaagtgagggccatggggagcatgcacgcgcatggaggcccacatccaagcacgagcacgggaggcagtcgataaaaggtggggacagcgcggccagttgcggcggtgggggcctttgatgacccctgcagtgcatcctccgacgtgtgtcgctccattcccagcctctccannnnnnnnnngggaaagagggggaagtgagcaccgtggggagcatacatgcgcatggaggcccacatcaaagcatgagcaagagaggcagtcaatacaaggtggggacagcgcggccagttgcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggatgctgcccggggtgcgcaccagcattcaaggtaaggcgcttgagcgtgagcagggagttgtagnnnnnnnnnnctccccgccgctccctccctccccactgccgatgcctgggtatcgcagtgtggcggtgctggctnnnnnnnnnnttcccaggcgctcccctcctccctactgccgatacctgggtatcgcagtgtggcggtgctggctgccatgacggtcgacaccaggctgttggtgtgagagaaggagggattagggatgtgcagtcgctcggttgccaggcggttgagcgccgtgttgtccagcaccgtcaccgcgtctggtgggtgaggaagagaggggtttggggtgttggaggcagcgggtggatgggagtgcatgctgcttcacagcggaagcctgcaagggatgctgcccggggcgcgcaccggcattcaaggtcaggcgcttgagcgtgagcagggagttgtagggctgcaccaccacgtcgctgctctctgactggtttggaaacacggagtaggtctggaccagcttgcgcgggtagcggtcgttcagggcctccagcaggtaggagcccatgccggagccggtgccacccgcgatggagtggcagagggtgaagccctccaacgagtcggagtagcccagctcgcggtccaccatgtccaggatgtcgtcctgcaccgactcgccctggtggtacccggaggcccagttgttgcccgcgccgcctccgtggtcggacaggaagatgttctccgggttgaacaggttgcgcacctctgagttctggatgccgttgattaccctggggttggcgggagggggtgttaagaagcgcggggggggctttaggtgcgctgagtggggcagggctgggcgtgtgcaatagcccatggagccgggtcagggggttgcagcagcagcgcagcatcctgagggcctgctgcgccctcgggggatcatgttcaataaatgccaacagccctctgaaatgatcgtccatctcagacctgggctccaggtcgatcaggcaggcgcgggggatgtagcgctcgtcgtcagcttggtagaagaacacgtccttcctgtcaccggtgtcgccggccgcggcgtagtcctggagaatgccgtcattgttgatgccgtgctccagacacagcttcctccagaactcggtgcccacctgggggcacggggccacgatgcgttccggtgggtgccggtcggggagtggtccacagcctatgcagtgtgcgagccccagcacccgccacgcacctgattgccgcattgaccaacttgcagcgtgattatctcgcgcggcatgctgctccggaaggggggcgtgcgtctcaggagccgtgagcgaggtctcgagcacttgcaccaccacgtgtgagatgcgttctagcaacgctgtgagccctcgctgatgcccaggccgtcagatctgctccaggactggctaattagtagccttgtacacccttgggacaggaaccagcatggggcgagccgcaggtctccgcgccaggttccctgcgtgcaccgctttgaaaattcgctcgcatggcgggagctgccccatcccacaaatgattcctttaggaggcagcgggcggcctttcgacctgggtttgttgctgtttccttactcgacatctgaaaattctttttgctcgttaaatcttggggtggggcgctctgccacccggtgtaannnnnnnnnncttgctggttcctaattcgacatctgagaattctttttgctcgttaaatcctggggtggggcgctctgccacccggtgtaaccttcggcagcggactttgggtcgggacgggatggctctccgcagggctatcctcgttgtcttgctgggggcactctccgccctggccatccggccagacagcggggaggcacgcgggatgagctccatgctctacaagcggaagcgcgacaagcagactgacaaggagcgcacaaacatgcgtcctatcattggggttgtctcccaggtgggcaggaggctctggctcgattttgcccgtcaaacgaccgcccatatctttcttgtgactggggatcgctgttcgagattttgcagagcgtgtcgaacttttctcgcaacggcatatatgtnnnnnnnnnntctcggcatgttttcggattgctcgactcatcagactgaaagtccggctgcagacgcaagggnnnnnnnnnntattgctgttcgagatattgcagagcgcgtcgaacttttctcgcaacggcatatatgtgcaggagggggatcctgcacccaagggccacacctacatcgcggcctcctacatcaagttcttggaagctgcgggagcccgtgtgattccgattctggccgacatgccccccgaggaggtggagcgccggtgagtggatggggctagttcctcgcgctgcgcgtcgtctcggaatcgcaccgactcggcatgttttcggattggtcggctcatgagactgaaagtccggctgcagacgcaagggcagagctgaagctgaccggctcattctcccaacaccctccccccgacacacagattcaagctcgtgaatggtattcttgtgcctggtggttctcaggtcctgcggcctggccatggtttctatgacgtcacctccaagatctttgaactcaccctgaaggccaacgaccatggcgacttcttccctgtaagaagatatctgaaggatgaacggcacggtgggatggagtgtttgacagacttcccggtctcccatccatggttggctgagatgcatagccctgttcgatgccccgaaactgcctctgcagtacacctagaaatttcttgtatctgagcagggcccccatcttccttatcatgcagctgcatggtacctgccttgggttnnnnnnnnnnattcttgtatctgagcagtccccccatcttccttaccatgcagctgcatggtacctgccttgggttcgagacccttgccgtgattgcctccaagaaccacagcattctctcagagtttgatgccgagaacctgccctcgcccttgttccccactgacaaggcagagaagaggtgggcttgatgtttaccttcttgttgacgttgctgtatgcctgtcgtagaaacagtgatcctcacgtacggctctctgctcacagacttctatttctcccatcactgcagtgagtttttctctgtgctgccgcacaaagtgtatgagaacctgctgaccaagccctacgccatggagaaccacgtcaatggtatgtgcagggggaaagcaagttcttctctggcctttggattttgcacagtacgtgcagccccgctgcaaggccctctttgcacgtttgtcctttgcccatccccaaatcctttcatcatccgatggcagggctggcatggactgccattgccgagaatcccacgctggtggatttctttgacgtgctcacgctgtccatcgaccggggtggccgaacctatgtcagtaccatggaggccatagactacccaatcaccgccacccagtggtgcgcaggcggcaggttttgaaggtcctcacgacgtgactgaatggttgacaccttctcccctgtgtcgcgcattgcttccgctctggggatacaacctctccagcttcataccccatcgccatgcaagtgccatctacaacctacatgacacgcaggcacccagagaaaaatgcctacgaatggacgcttgacaaggacatcccacacaacccagaggccatcgtcatcacacaggtctgaacgtgtgggtgagactccctattgagttccagcaatttagcttcctaatctaatccacttcacttcacctgctgttcccttgctgggttctcatgccactcaacccaatccatggtgacaggaggtcggcaacttcttcgtcaaccgggcgcgacgcaatcagcacaacatcgccaaccatgatgatgaggtggacctgctcatctacaattttgacctcgtctacactggcaaggtgagggcactgctgtggcgtgctgatgggagtgcactcgctgctgggttgcactccagttccaggcacctacgaattgcggctggataaggcattgcacttggaatggtgcctctaccctgccannnnnnnnnnctgtgggtgagactccctattgagttgcagcaatttagcttcctgatctaatccacctcacttcacctgctgttcccctgctgggttctcatgccactcaacccaatcnnnnnnnnnngctgtatcctttatgctagctcttaaacatccttctatcatccctacttcttccaactgtcccaaaaacacacaggctaagttcgagggggaggaggtggactttgatgagtcctacttcttcccaccctgggagaaggtgcgcgaggtggaggaggccaagcgtcaggcgaggagcggctgaacaagtgcctggacgcagctgcgggcgcttgccttggcaggaggattgcggaggaaggatgagaggtgtcagaggtctagtgtgtgcatgttgactgggcgccaccccttcccagggtgctccacnnnnnnnnnnagaaggatgagagatgtcagaggtctagtgtgtgtatgttgaatgggcgccaccccttcccagggtgctccacacccaggaactgaaatacgtgagcttgagagtcttgttgtagcatgtgcagcttgttacgtcttgtcaagtgccggaagcgtgggtgtgctcagccctggcagcaagggcccttgaacattagtcgagggatgcaagtcacgctggcacccagttgcagcgccgcatgttgagagagcaagtgccaactcagcgtgcgcataccacattgcacagaacgcacagttgggaagatggcagggaattacggaggctcttcccctgctgcatccatgtccttttgcctcatctccattgcaacgtcnnnnnnnnnnatgcgcataccacattgcacagaacgcacaggaagatggcagggaattacggaggcttttcccctgctgcatccacgtccttttgcctcatctccattgcaacgtcctctgcctcttccaggattgtgaagctccgtgccccaaggatgtccatcagggcattcacctctcggtccatcacacgttccggctcagggctgcccgagggactagcactggggccctctctgtcctcagggccaggcgtgccgccaaccgtaccctgacccggcccttcagattgactcccgcaggtagcctgaacatcctgagaacatcgaaagggaaggttggaacctcgccgccagacaatcagccaacacctccctgcagcttgggatctctgggagacaagaccacagctgagagcacctttcaacacccaccgcatgatcttggcgctgctgcgccagcattccacccagcatggccttcagctgggccctctcatgctcggcaaactggtccttcatccgctgcagctcctccagctgggccttctgcatcagcaggtgctgccgcagagcctccagctgagcagcctcctgcatggcgtgatgttggttgagactggtattaatcatgggaggaggccatctttgaggacacgagggaatcagctctcttgctgtgtaagtgatgctatggggtgacctgatgacagggatattgcagcatacagcacttcccgtcagatgacgcgcaccatctcctgtgcaggggctgtccgccagcggtgccatatctataattgaggatggaaatggaagggaatgggcaaccacataatgaccaggtagtgtggaaacgtgtcactgaatttgccaacccccacctgacgcacgaccctcgcgagtgtggacatgatcgaatctagaagggcgttctagtatgtgcacatgcaaagggcccctattcggagaggttctagcactgaagtggcagtctccctacagtggaagagtcgagtcctacagctgaagcagatcaacacgccgggtggccgagagggtttcttagatcaaaatttcacatatattcgatgcagccaaacggctgaacggatgcattcctgcgaagacgggaaagtgcacgtccgaccagagcaggctcagcattctgctcgaggatgttggatcggttcgtgagcgctgctgcaggatcctgagagacgtcgaacgcgatccacaagcaaagcttgctataactcaatgctattcctcgtctaatcctcgcagactccctggaactcctgccgcgaacgagggcgagcggcgctcgacgagtttgcaaggggccttgtcctctcgacctgctcccatgtctccacaatctcagccaggagtatcaccgagttgaagtttgaactctcaacacnnnnnnnnnntctgcgaagacgggaaagtgcacgtccgaacagagcaggcgcagcattctgctcgagatgttggatcggttcgagagcgctgctgcaggatcctgagagacattgaacgcgatccacaagcaaaacttggtataacttgatgctattgctcgtctaatcctcgcagactccctggacctcctgccgcgaacgagggcgagcggcgctcgacgagtttgcaaggggctttttcctctcgacctgctcccatgtctccacattctcaaccaggagtgtcaccgagttgaagtttgaactctcaacaccatggcaagacagggcatgtatttccaagcctctctgctcctggctgtcgtcactttgctgtttggcaacagcagcgcccagaccggcgatgcacgattaagccggttcccggtatccgtgcacgacatnnnnnnnnnncatttccaagcctctctcctcctggctgtcgtcaccctgcgttttggcagcggcagcgcccagaccggcgatgcacgatcaagccggttcccggtatccgtgcacgacatcgttgcggcccttcctggtgatgtggaccacatggacgtggctcgcgcaagccgcatctggcgcaaggttggatgggagtcgggaaagggaggtgcagaggcaatggcgggtgggcccttggaggatggctgtgctgatcaaggagagtgggaaagggctaccaaaggtggggaggtagtgcctacaagcacgcccagcacgtcgaacccgatcaatatggtgcctttgcagcttgaacgcaatcactgtaacttgtccgaggcaccaaacaggatctctgcgcaccgaacaaatttcaccattgcacagggtgtcatccggacctacatcgctggcnnnnnnnnnntaaggggagtgggaaagggctcccgaaggtcgggaggtagtgtctacaagcatgcccagcacgttgaacccgaccagtatggtgcctttacggattgaacgcaatcactgtaacttgtccgaggcaccacacagtatctctgcgcaccgaacagttctcaccattgcgcagggtgtcatccggacctacatcgctggcaacacccctcccacccccgaggttgtggcagagggcctcctgcacaacgagacctgggcctactacccggatgacaagccgcggaggtaagacactcgcagagtttggtgtatttgcgctggagcagttctgttccaggagaggagggcctcggtaccacagctactctgactgacccaatgatccgctcctctggcatatgcatagacctcaagtacacacacatactccaacatgccgctcgacaggtccatgtatgctggggacacacgggcaggcctggtgcccttcctggcccacgcccactttggcgacacctacagctggctcctgtacatggacgacgacaccgtcttcttcccccccgccctcctccacctcctgcgcgactttgatcccgccatcccctacttcatcaccggtgggtgccagagttgctatcaagcaggggttgggaaggtgctgatggggcccagtgggcgcgcacattgttctgtggccctccctgcctcgccgggatcttgcatgaatcatgaccctgaggtgcatgctcccctgtgcgccccttccctgcctgcggcttcaggctctcaaatcgaccatcatgcaacccgcctgcgcagaccacctctggtacgccaacggcacgggaccggcgacgcacccccatccccaggccccgcgctgcctgccctgccacttcgacgaggcgccgtacgcgcgccggcgccgctccttccccgcgccgcgcggctgcccctgcaccccgcagctgctctgcgccgcggcgccgcgcgtgttcaacgcgcactgcgacatcccacgccaccccgccaacaccttttccatgcacggcggcgcgggggcggtgctctccgccggcctcctccgcgcggtgggcctggacttcatggaggcttgctccctgagcctgcagtccaccggcggcgacgccttcatctccatctgcctctggcaggccggctactttgtcaccgacccggggctgtccgtgttcatggagggcgtgcacgcctttgacccggggcccgaggaccggctgggggccatgcgcctcctggccgcctacatcgacgggcaccgggagggcgcggaccggcactgggtcaccacctgcgacgaggcctgtgagcgccagctgggggccatggtctccctgcacatccggtccaggtcgtttgcggcgctggacgacgccgcctccttcatcaaggccatcaccaccctgtatgaggcgagcatgggagtgggtgtgtatgtgtgggagggggggggggggttttgggnnnnnnnnnnnnnnnnntgtaatggggggtcttcgtggtcgttaagaagtagaaagctccgtggcgggctggtggtggcgctgaaacccgcttcgccaggttcctcgccgcccgctggcggagcggggtgacgggggtggggggagtgccatggggtatgagcatgcagcagatggtatgcnnnnnnnnnngaacccgcttcgccaggttcctcaccgcccactggcggagcggggtgacaggggtggggggagtgctgtggggtatgagcatgcagcagatggtatgcggggcggtggattgagggaacagccctgaaaaagatcctggcagagccctgcgcttccgtcgccccctcatcccgaagaagtccctgcccttcctccgctgactccannnnnnnnnncgccctgcaaacgatcctcgcaaagccctgcgcttccgccgccccctcatcccgatgaagtccctgcccttcctccgctgactccaggtgtatcaggagctgttgcaccacaaggaggagagggagaggcccgctgcggaagcggcgggcgccnnnnnnnnnncagggtcgcggcggccgccgcggcggtcgccgcacagaaactccccgacgtccggacggcggcggccgcagccaatgggaccgggacgggcgcggcggggggtggcagtgaaagcgccgagtcgctggaggaccaggcgcaccgcctcgccatggacaagaccaaggccggcgcgcaggcggccgtggtggcgggcgccatggccgagaccgaggccgagaccgaggccctggcggcggcggcggcaaaggagacggtggcggggacggcggcgggcctcgccgccgcggcgcaggaggagatcgtggtgtcggagacgggccatgacgcggccgccggggacggcgtggtcgcggcggctggggaaagggagcagaccgagccttcaaagccgggtgnnnnnnnnnnagcggccggcggggacggcgtggtcgcggcaactggggaaggggagcagaccgagccttcaaagccgggtgaggctggacaagcgagtgtggagggccaagaggctggtatggtgctggaagccacggctgccggacaggaggcccctggcactgccgctgctgccgggcaggaggnnnnnnnnnncagagggccaagaggctggtatggtgttgcaagccacggctgccggacaggaggcctctggcactgccgctgctgccgggcaggaggcctcgaccaccgtggctgccagtcaggacagctccgatgccgcggctgctgggcaggttgccgctgcagaccagggcgtgtcagcggctgtgcggtgatgggcatcgtgatccgcagctggggtccttcatcccccggcatgtttggctgcacagaatggagcctcccacctggactgcatgcactataccttgaaggtgtcttctctgctattgaccgggatgagggaaggatagagcaccggctnnnnnnnnnnttggggtccttcatcccccgacatgtttggctgcacagaatggagcctctcacctcgactgcatgtactataccttgaagatatcttctctgctattgcccgggatgagggaaggatagagcaccggctgagaaatggtcttctcccccactgagcaaagtgtatgaccaaggcagataagttgcactccctccaagagcgctggcgcgcgcaatcccccaggaggccaaaaacaaacaaagataaccatcgtctgagataggatgtggaccacatcaataccatgcattcaaatagtttctnnnnnnnnnntaatcaaagacaaccatcgtctgagatagaatgtggactacatcaataccatgcattcaaatagtttctctgacgaaaaatgcggatcgccatgacgcttgtggggctcggcaggagcttgtgcgcatcatcagctggcccagcgaaacaggcatggacctgccgatcacatgcggatctcagcgcgtctgtgtcacgggcctaccccacagagccccgggtaggcgtcggcgtggttgtactgagggagctgagccctggaaaccccgagaccctgctcataaggcgcgcaaaggcccccaacaaaggtgaatgggtggcatggttccatgagcccttgtggcattgctgtggggggtttgacatgcagatgcgagggccacaactcagcgcctcctgcggaagagctactgacgcactgtcctgcacgcccggtcccactccctgtcccttcctgccccaggggactggtgtttccctggaggcagcctcgagctgggggagacgctggtgcagtgcgcagtgcgggagacgctggaggagactgggctgaggctgagatgccggctgccgcaggcggagcacggccagcccaacgcccgccacccccccttgagcccggacctggcgtatccctcatccttcatcgccggcgatgcgattacatacgatgatgcgggggccctggccttccactatgccatcgtcaatgtggcgggggtgccggagaacccggaggccgcagtcgtccctggggacgacgccgccgatgcacgctggtttccagtgaccgacctccgtgggttgaagggtgaggaggtgtctgagagtgggactgtggcgtgacggtgttgtatggggtcctgtgagggaatgtcggtgagcattgggcatgctggatattctgggagtgtcccttaagatgcacacggctgtgggtgtgggcttacgagaacccatgagagtgtcaggtcgcccgccccacccacccaactgccatcccagtcgcagatctggtgccaacctgcgactttgtagcggaggaggcggtgcggaggtttgccatcnnnnnnnnnntttacgagaacccatgagagtgccgggtcgcctgccccactcacccaactgccatcctggttgcagatctggtgccaacctgcgactttgtggcggaggaggcggtgcggaggtttgccatccgatgacacccatgcaggctggagtgaggcttgaggccagcataggtccgtcatgccatgtttcttcacgtccctgatagattttgttgctctcgtcccctcatgtacttccactcatttgtgcttgtcaggagcactggaactgcccattagtgacacagtgggagacaggctgatgttcgtgaggtctgtcatgcacccaactaaatattcaggaacggtgcagcatccgcagcggccttggatgggagctgggctgcttcaccgccctcttcttctagaaccgcaaacttccctgtctccagaaactcgtcgatctggccggggtggtgtgaggcatggtgtggcgagtacgcgagtgtcattcctgtaggtcaagagtctccctgcccaaacctgatctctcccctcttcaccccagatccctgcagaaacacccccccggcttgccttggctgcagagcccttnnnnnnnnnnggcccaaatctgatctctcccctcttcaccccagatctctgcagaaacacccccggcttgccttggctgcagagcccttccccaccccagccacgcccttgaggtccttggaggatgtgatcttggtgggccagcccgccaagaccttttggacctttgcaaaggcgttggccttgaagccatcgcccactgcgagtcgagcaaggtgtggatggggatggttgggtgcaggcacgtcgacctcagatttggatgccaggtgcaggcactcacttgagattcaggagggcggatgcctctgcacctgcccaccacgccaccccttacatctccgaaagtgatcggtgagggtctggaaggcattcgccaggtcgtcgttcttgcctgaagagccctcaaacaccacctccttcttcgcctcaccctccctgggccggcccaggttgagattgtgtcttggttgtggcgcaagcacatgcagtgggctgccaaaggcgcctcccagggaatcgctacatgagccagtcggcaggcaagcggccacannnnnnnnnngaaggcgcctcccaagggaatccttccatgagccagtcggcaggcaagcggccacacgccacaccactcacccaaacacctcttctggtgtcttgaaggctatgccaatggcctccgcaaagcccctgcgggggatgggagtgtgaccaaaggttgggacacagagcaggacgggacactcctccgacaatacaccagccttgcaggccccttccatgggtgttgtcgaccggtgcaacacccagagcgaccactactttccatctcacttgtcagtgtcagagggggtggggttgtttgtcccctggatgtcacccacgcgcccagccatgtcgccgacatagaacgactgtgacaagtctgtgatagcgaggggaggcatcagggtctgaatgtgcaaccagcctctcttctgggagaatccaacatgcggtcttatcccagggcaaacagcttcaaagccgacaagcctccaaggtgtccacagcnnnnnnnnnncgggagaatccaaaatgcgatcttaccccagggcaaacagcttcgaagccgacaagcctccaaggtgtccacagcggcagcatcgaaagcaagacatgcacatgcacggcaccctcttcctcaaaagaccaagggcttggctcgatcctcttccctccccacctggtttaacaccggcattgcagtgctctgtgaagaagtcccacatgccggtgccgggcttcctcagatcgtcagggagtgtggacatgaagacctggtggcagggatagccacgcagcatgagggtcttggtggaatccccagtgagtgcactccctggctggcatgggctgcatgcagggtgtgctgcacctcagtccacccattgggcgcaaaggaggtgcctgtacccagcgtcaagacctcgagtgagtcaagacgacacgagattctgaagccccacctgagcatggagggggccgtcctttccagtcagggcggcgaggacattgtccactcggccacgggtcttcactgccccggcccctgcgagggcactacggatgcctccttggttcctgcatgtttgcaggggggtgacaaagggcatggatgaatagagatggtactgcannnnnnnnnnaaggacattgtccactcggccccgggtctttactgccccggcccctgtgagggcactccggatgcctccttggttcctgcgtgtttgcagggaggtggcatagggcatggatgaatagagatggtactgcacgagggttgtgaggttcgcgtcgatcaatcacatcagcacagggaactcgggaagctgtccaaggcagtgcataggatccaactacaaaannnnnnnnnngggttcgcgtcgatcaatcacatgagcacagggaacttgggaagctgtgcaaggcagtgcataggatccaactacaaaaacaatccgtctcacgagaagatcacaagctggtagccctccagctcagctagtcgccgcaactcggtcggcacctgtgagtaatgaggcatgcgcatgtgtcaggatgtaattcatcaggaaggagccccggacggcggggttcagtcatgccatgtcgtggtgcaaaaaccatacatgggcgggcagcctgacacacnnnnnnnnnnccatgcgcatgtgtcaggatgtacttcatcaggagggaggcctggacggcggggtttagtcatgccatgtcatggtgcaaccatacatgggcgggcagcctgacacaccaccaagtaccacctgctggcatgttctgctggctgtgccacggcccaggccaaactcagctccccagcccacctggacgccctccaccacctctcatctcaccccaccacctcaccctcttgttgaaccacttccagtcgtctgcatccagggcaaatcgagcacgactcttgacatgcaccaaggtgccatcctgagggaggtgagggtattgagctggaggcatggcggcgagcatggaaggcgtttgggtaaggcagccacgcactcagtgtgcatctctgcaggttggcctgagtgtcccgccgtggctccttctccacatccctcaatcccaaatgctcaccagatcaaaagctgcaatcttcnnnnnnnnnnacaggttggcctgaatgtcccgcagtggctccttctccacatccctctatcccagatgctcaccagatcaaaagctgcaatcttcttggagccctgggctgcaggcacagccctgtagtgacagtgagggggcgaacatgcattggaatgaatttgggacaggtctgcatcaggtgtgaccttgggaaagccaccatgcctcctcctctgatctcaatgcgctcacttgtaaatgaggctagggggatgcagcgtccaaccatcctcagtggcggtcggctctgtgagagctggctgcttcggtcgcgaggccgacttgcttggagagccctctgcatggtgtagtcagtgccaggatgtcaaggtgtcctgtaacagcccagtccactgcagcaagcatcccaggcacacgcatgcctgtctttggagcgcggctcgggttcttcttcttgggttttacatcctcatcgccgcctgatatctctggattgtccttgacgggcttcaccgctgtagctttgcgtttgggcgccatcctccccgacaccaaagcacccgacaatcgagcaccttgaaggaaacaccgctgtactggagctggtatgttgatcagcgtagctgtgaggcctaggggtcttactacatctggtaggatcatccgatgcgaggtacagacatgctcatttcgatctccgagaatcaccgtccgcaagtaaataaatcactgtccagcccatcgatcgcaggatgctgtggttgacatgccaggcgctacctttcatacttacagattttattgcctgcgctctacannnnnnnnnnaatgctttcgttgacatgccaggtgctaccttccacacttacagattttattgcctgcgctctacatcgtatctgacaacctctcattgacgtcgacattgtagtgatcttggtgccatggctgaggactggcggcaagccatccctcctcaattcgcacacctggccgatgaaattctgagcgatgttcgtaccaagtggtcgcaactgagtggtggtcctggcgtgctggactcgttcaaggcattcgttgccgcagtagactggaaggtgagggattggtggtgggcgttccctcgcaaggactgcacgggtgctgaggcattccttgatcatccaatccatttgctcgaggctgccccgctccagggatgttatgggcaggtcagtagccctcctgcctgaaactcacaggaggagcgctggctgcaagggctcctggcggtccatggcatgctcctcctggcagccatcctcctgcgacacaacgtggctgtgcaggccatcatcttcttcattgctggtgggtagattgggcattacgcttgctacctcaccagatcagtcaatgagacaccctgctgttgcatgcagtcgaatgctgggtccgggccactcgcccatgacttttcacccctgcggcccccctcccaaccaatcacacagcacccctggtgtactttgctgagaggctcaatggcctggcggcttcccactggcagcgcttctcctcgcagaactacttcgatgctcacggcatcttcctctcggcagtcctgtcggctcccctcctcttggtcatgtttgtcattctggtgagttgtggactcccaagcaggttgggtggcatccagcacgcacgctcacatctctggtcatggatgccctcctgctgccatcgagtggcactctggctcccttcatcctaaccctaaagctccctccatggtccctcgcccaggtgaactacctcctggcggcctcgggcctcttgataaaaatgaagcgacgtgaactgcagtacaaggctaggcagcgccgagcggcagaggcaaagaaaggcgaatagtgcgcccctcgcatgcacgtgatactctgggggcactgtcctttttgcctgcaggtcagctcataatgggctggatgcagcacgaatctttgtcacattcgcttgagttacacccaagcagacagtgagcatggggcgagcatttgttatttgtcaggggacagcaagttgtcacttctatagcacacacaattgaggcaagatttggagaaccagctgccagggttcggaccctcccaaagacaaatcattatctggattgcctggacgattcaaccaaacactctcgttacaggtactgggatagaggtcagtccagaattggcagggatcaatcatgcaaaggcttgctcgggctgtcaaacgggggagtttgagaccccagggcttggcgaggtgtctggcaggttggatcaggagaaggacttggccaaaattctggagaatccgtatggcaaatgaaataaaatcgggaacgtgcatcgagccagtggatccaccatggcatcaggcacaacacgcttatgctgtcaccaaaccccagcattgtaatgtggtagcttcctaggcgtttacgctctgcggtcatgaagggcaggggttcagatccaatcttgggtttagtctcctgttcctcttttgcaaaaggatggnnnnnnnnnntagaccatctgcacaagacgcttgtgctgtcaccaaaccccagcattgtgatgtggtagcttcctaggcgtttatgctctgcggtgatgaaggggcaggggttcagatccaatcttgggttttgtctcctgttcctcttttgcaaaaggatgggtggcgaatggcaggcacacacggcatgcagacgctcccgtctggccaacttctgcaggatacatttctcctctgtccaacctcgccaactcaccttcccacgctggtactcgtccagcactgccctggcgccatcaccattgtaatcaaagatgaagttggtcgtcacgccggagaggtatccctcacggtggagcaccgcccagaccagcgagccgtcaaacccagactcgcgcgcctcgctcagctcaaagtcgaagagagtgttcctggaggacagccagcctgcgggcatgtgcgagagggagcttgacatgggctttggggggtggcccatgctgggaccctggtgcgcagggagtcagatacagtttgtaacctcccaagaacaggtccatgcatttccagtggcagtgccactgacagccatggtgacacagcccccacagcatccactataatgcctggctccaaccttgggcgctgatcccttgcccaccttcctccatgccgtactcctcaaggacaatgggtttgcctgcagggggaggagtattgcggctgtcattgcctcggaatgatgctccacagtatgactccagctgtcaccccaaggttgtggtggaaagccagagggatgcagcaaannnnnnnnnngtccacagtatgactccagacatcaccgcaaggatgtggtggaaagccagagggatgcagcaaagcccctttgtccccctcctgcggctgagcgcactgtgccataccagctcggcgcgcttgctccccgcgagagcgaatgtagttctctcccagccaggtgtagtcgctgggagtgaatccccagctcgctgcatgtgtgttgattgggtgagggccatgaggctcgaccgaatactttaataagctgttccagctccacaacccataagcgtggccgttggggagggagattatcgacaggaatggttggcaatgcgacacacacacttcattcccaaggtcgactaccctcctctccataccctgcttgtgctctctgctgctcaccagggtagacgtgcagggtnnnnnnnnnnttgggggtgaatccccagcttgctgcatgggtgttaattgggcgagggccatgaggctcgcccgaatactataatgagctgttccagctccacaccccataagcgtggccgtaggggagggagattatcgacaggaatggttggcaatgcaacacacacaattcattcacaagtacgactattctcctctccacaccccgcttgtgctccctgctgctcaccagggtagacgtgcagggtggcaaagtccacgttggggtcctccaggttggatgcgacccagtccgtgccggtgagcccattattgagccaggtgtgcccattgcagcagtcgccattggtggtgaatccctcgtgcccggtggagaccatgtggttgcaatccagggacttgatgtgggcgctcatctcgcgcgtccaggccgtcatgagagcccctggcgcaaagccgttgctggagtcgtagccgttgctggtgcggggctggggttgcggttgggcaagggggtcaaaggcttaaggtatgtatctgggagggggggtccccacgatgcagtgatctgaatgtgacgggggaggatggaacatgcctgcaaacgcaggatggccgagcgtcgcaaggcatgcatccgcgcccccccccctcaacacctttgcaaccagatctgcagagcttattttcgaacgcgcccatcacacctcgtttccaagttgccaggcgaggatggtggggtcatccacatagcgctggcctggaagggaaaaagtttggatctggatttggagcctaagtgcagtctgcagcgcgagcttcagcgcatcgctggcacccacgatgcggcgagcctggcagttcgcacaacccccacctgtgacggtgttggtgcgtgtggcgagcttggtgatgtagtccttgaagtacttgcggatctctgggtcggtgtagaacagctcctgaggagcaccagtgcccttgacggaatccacatagaactgtggcaggaggttgggcaccgatgaagcgagaggcgcatggtgacatgcatgaggggatgcacggcgcagattgacagggtgcatgagttatacacagcactctattacgagaacccccccctccaacccatggtaaaagtctgcacataccctctggcctccatagaacggccagtagnnnnnnnnnnttgagttaaatacagcactctattacgagcaccaccccctccaacccatgctacgagtctgcacagaccctctggcctccatagaacggccagtagttggtgagcgtgaggacgaggcggatgcccttggcagctgccgctgcgagcacaaagtcnnnnnnnnnncctacattgcgtcaatggtggggaaaaagaggatcattggtgcaggtcgcgatgcatcactctgtgcaacaagaacagctccctgagcatcgagtgcgcaccgcccctgagcacctcttgagggcctcctcgttgtattcgccgaggcggggctggaaggggacgggggtcaggatgttctgctgggttccatacccgtcgctgaaggcaaacacgcggagcacatttgcacccttcattgcgtgcacctgggcggcaggaggagcatggattggttgctgttacgagtggttgatgcattgtcagtcgcagagaaaatcgacggcatggttgcttagcctgttctgatcactctatcaacacacagcgccgtgtatattggccggtgtactgctcggagcagatgcagaatcaagctagaggtccattcatgcatgattacttgctggaagagcctactgggaggacgtgcaagacgagtggcacgccttgtcccacattgccaatgctctccaacacgctgcatacaccagccccttcaggagaacagaactcagatccttactgccatcaaggaggtcacgtcatcgggcgagagcaggtcggcctgggcggcgtagaacgcattcgttcccgcggcgtaccacctccggtcgttgaggacgaggtcgccattcttggccttcacgaacccgtcattcagcccgctcttgcccggcccggtcgaagtctgcgatgttggcagcggcgttagggagagctggcatgcagccaagatgaatcaaatctggtttaacaagtgctacaccggcatgcaggatccgaggtcgctcgaggtaggccgactcccaccgaatcttccatggccacgcgggatcgggcaagatcgaatgtggcggccagcaccaccgcaccgtggaaatggagtttgtcgtcgcgtagtcccctgctccagagtagttcaggttcctgatctggttgatctgcacttgaaaccttgctcgcgcgatgctctcgagttcggcttcggatggggcgtcgctggactggatgctcgaagtgtcccggcaggcacagtattcggctgcctgacacgtcatggccagcgcgttcatgatcaaccagacggccagggtctgcatggcaggagatggggacctcacagggatggtacggcgcaaccatggatggcatgaagccggcatgctcgcttaccaagctggtgtgagtgttcaccatctgattccgtgagcagagactggggaggttggtacttcactgctggactcaatgaccacctctggggtcaacagaatctgctttggctgtggttggggaggtgagaggaaatggtttgcccaaaattatctcattcgtcagagcgtgcaatgcgcttgaagacggccctgcaaaggtacagtgcacccccctgcataccggaatgggaatgttcggtcgaagccgccaaatccggggagcctgtagtgccggcgatggatgagcgacgtattcggatgggatggaagtcccgcaagaataagctaccgaaaggatgatgatggagagtatctgaaggtagctgttcttgttgccctaccaaccgacttgaatgcacaaagttgggtgctcatggcttcatgctgctcacgtgctgtcagctgaatgcatctaccaaaatctgaccagatgcgcgtttgacgaagtaccgttcgcctgcactgcgtcttcgaaccctctcttgggcttttgtgacctcgaacatggggttttggagcgttggtagcggagtttgatccnnnnnnnnnnccttcgaaccgtctcttgggattttgtgacctcgaacatgggcttttggagcgttggtagcggagtttgatccgtgtgtccggtgcaggtgtacacagccttgcgttctccctcagcctgacccggcatggtgacttcagggcccagggctacatacccgctgctcatgaccatgcagtcgattacactttcatgcacgcatcaagctacgaatacaacaccatttgcgcatgtttgaagcaagccagctatggtattgatgacacgaagaacgagtccgaccgagggcatgctatcgtgcatggagtccatcgcccggtgcacttacatcggcaaggacccctttagaaccttgttttcaaccggccctgagagactagatctgatacttcaaggaatacctcagtgcgacactgggtgtagcacactgcttgcgggttcaccgtggtgatcgtcgttgtggactggcggacagccatgtgaccccttccttccggggcagagagcggccgggccaggatcgatcgaccatcccgatgttctgatcatatcgtaaacaagtaaaaaggatgaaaattcactcccccgccgtgctgcatgccggcatgaccgtctatgatagcatcccggtaattcgcctcgaggtggaccgatcaacgacacactgggccgctctctacctaagagcagttgtgattacactcagctgcataagaagatgnnnnnnnnnncagcatcccggtaatccgcctcgaggcggaccgatcaacgacacactgggctgctctctgcctaagagcaggtgtgattacactcagctgcataagaagatgcagaaatgatccaagattccgaaaatcggacttttggactagtaccatactcgtgcaatggcagtctgggttcaaaccaaggtatcttgaccaatggtgaacggttgcgacattgcgagggcttggcaggactgggtaccccatccaaagtaaactgtgacagactgtgccacgcctgcgatcaggaatgtaatcaccaacacaaggaactcgcctcaatctgaagccattgaccttctacagaagcaagtgcaaagatctcccccaccctacgtccaaacttatcataagaatgacgcttaaagcatacagcaagaggaacctggcagtgctatgcagcatggtgaagaaccaaacaactagaataagttccaaaagtttcgccagcttgcgcttggtggccgctgcttccgctgtgatccagccttcccgccttgccttgcctctgcacgaggagcgtctgaggccggcagccacttgatggggtgcttgttgtagatgggccagtctggaacactcatcaggagtgagatgcccacgccgcagctgaaggcgatgagcatgttagcaaagctctgcgtcaggtagcccacgagaaaggccactgcccctgacagactaagtatcgcgacatacagcttctccgacaagcgctggccctggaaatccatcctggcagtaagctccgctcctggaatcgtcgtctgtcgggacgggggctgcccggtatcgacccgctgatcgcccgcggtaatatactggtaagtatctgattggtggttacacggatgagtgcagcactcttgatgagaatgtgatgcagatgggtcgagcgctttaacttcaaggtcctcgagcgcgccccaggttgtcgcgccctgagcccaggctaggatgacaagcagggagatagatcacatgcggtcagatcgttttggtagagggggccagaggggctgcaacaataaacaatgtgccacctccaggcgaagcagatgggctcttctggcatatctcgggatccagtttcagggctgtcgccatgtcggcccgcgtgctgatgctctccacctcccagcccaaggccgcaaagtactgtaggcaggcgaggttttgaggtgaggagtgatcatccatgacagcatcagaacccatggagggagggttgaaacaaggcgaaactgcaggcgcacagtccatgccacaggatcgccttccctgggaactgatcgcctcacatctgtggggtcggtggggcagccaaacttccaagtgnnnnnnnnnncagggagggttgaaacaaggtgaaactgcaggcgcacaatccatgccacaggaccgccttccctggtaactgatcgcctcacatctgttgggtcggtggggcagccaaacttccaagtggcaatcaactcggcccggggcgagcgcaccccgctgagcctgttcagcatgctctctgtgaggctcattgtcagcagggcggagttctggctggacagccctgggacaaaggagagataggatggcatgtaatgtgggttgggtgtggggcatgacaaagtcagacagccgctcaaaatgatcatgaattggcgagagattggcgcctgcatcatgcatggggacggtttgggcacgaggggccattcaaagcagcctggtcataagccttgataggtctaccttgcccctcagcctcacttgaaatggtcgacaagaggctggcgacgctcttgccctccagatctggacagattggaatggagaggtgaggcagaaatgtggcgaggagaacccagagcatggaagggtcgtatggagctccctgtggcattgcttccccaagtccgcaagtaaaccacatggtgcttgcaaaacctcagcagcagcccacgagtaccttcctcatacaagaaacccgtgcaatcaagcacaccgtcccagccagagcatgctgcaagtgagctctcttgatgagaagcaaagctcgcacccacgctgaccattactcacacatgannnnnnnnnntcgtcccagccagagcatgctgcaagtaagctctcttgatgagaagcaaagcttgcacccacgctgaccattactcacacatgagaagtccctcggcaagccagacgaccgggctccccgggtcaaagccagaagccaacagcgactcccaccacccaggttcctccaggtcagcttccacgcccttccaactgcctgtcaggagtgggtaggccttccgcgtgtggcctggctccagtccggccccattcttcttcaaggcatgtcgtttggcggccaggacatccgatctgtccacctcataccagctgacacctgagtaggggtgacggtgcaggatccatgtatccccgattttgttgtggacctgcaagactgggatggaatgcttctttgcacaacacatgcagtacaggagcatcttggaagcgtctgaagagtcttgcgtactgagcgtgagacatttacaggtcagttctcacattggtgaaaggcattcggcccatcccccgctcacctagaggcagctgcagtctccnnnnnnnnnntgaatgctcctatgcacaagacatgcagtacaggagcatcttggaagcgtgtgaggagtcttgcgtactgagcgtgagacatccacaggtctgctctcacattggtgaaaggcatttcgcccatctcccgctcacctagaggcagctgcagtctccagggtcttgtgtccatgccagcacccaggacgacaacctggcgaggaccagggccttgcttcccactttccagcagagtcagcaggcgttgatcaaaccaccaggtcctcagggccatgggccccaccttgaacttccggcccgacccctctggggccgcctgtgtgaggttgtggtgcgcatgtaacacgttggacggagtgggtggcatacagagctggtgcactccacggctcttactctctgcttgcctgggcgcgagagcgcgcgcgctcgagaggacctggcccagccagggatgccgcgagctcatccctgatgattggatcatcttcttccgtctccaatgcccgggatgctgcgaggcggagcagggttgatgagggtaacctgtccgatcatcgcacggaaaaacctccgatggagcccacagcatactcagccaatgaagcaccctcttcctccgcnnnnnnnnnnggcagggttgatgagggtatcctgtccgatcatcacacgggaaacctccgatggagcccacagcatgctcagccaatgaagcaccctcttcctccgcgctcaccagcaatgagacgactggagaagcttataatggagttgaggttcccgtaaggttgcgcccgaaagatgttccctaccctggacccgagcaccttgaaggtccatatgacgaggttcgcagcggcgatgccggcgagcaaaaaactacgtctagacatgacaagacactctacatcgcctacaaattatgcaacgaaatgcttgagcattgcatcgtagcggaccccgattcgggaagaagcgctgtctggaggagaagaatcacactgcaaatgaccccgtgtacagtttcgtattgacgcagcttgtgccaagagtataggttgggatannnnnnnnnnacgaatgaccccgtgtacagtttcttattgacacagcttgtgccaagagtataggttgggatagcaatgcggggctcattaccgtggaaactatttgtgggcattttcttggccttaccttcgtctgctgaaggtcagccaagggaatggctggggtaacaattgtgagtaaacaaactcggactcccatctgatcttgctcggctgctcctcagtctgaagaccatgcactaactccatttgcgttgggatgacaagtgattctggaagacatcaatcgcatgcttctgggaggccatgacgcacagcaccagtcgctggatcagacttggagtggtcttacagaagacaagggtgtataccccgggagcaaatgtcattgtggtcaccaataacccctcttcacaatctgaatagcgcgaagctgccattcaaatatcacaatcaacgccgccaaaaggctagattgataaaataccacgtgccatctggtaccgtgccctggactacgtcgcaagttgcagctgagctgcgctctcagttctgccttgtgcatcccccaaaggcctcgccctctcagtacccaatttggggtggataccaggatggcagtggggaggtgttcaaccggagcaggaannnnnnnnnncaattccatatgcattgggatgacaagtggttcaggaagacatcaattgcatgcttctgggaggccatgacgcattgcgccagtcgctggatcagattttgagtggtcttacagaggacaaggatatatacccagggagcaaatgtcattgtagtcaccagtaaaccctcttcacaatttgaatagcgcaaagctgccattcgaacatcacaatcaacgccgccaaaaagctagtttgatataattaccacgtgccatctggtaccgtgccctggnnnnnnnnnnggctgcgctctcggttttgccttgtgcaccccccaaaggcctcgccctcttaatacccaatttagggtgggtatcaggatgacagtggggaggtgttcaaccggagcaggaaaatgcacagtgcaagagtcccttatttgcttgcacctgttaacgaccccaaggcacgctggtgcagaattccaagttcactggaaggtaagcatcaagggaagctcacaagaacactgcacaacctctccaagggtcaccccacagcctcgcctcagcttcactttttgacaagctagctcgttgttgatccacatgtgcaaacaggactgagctcggcatcgttgtcagcgccttcaccagcgtatgccttgcttcgctggtttgcagagatcatgggaataggacgcgcacatgcttaccgtgaaaacccacaaggatgactaccaggacctgggaagcatgttccctaggaatctgcactgctgcacccgtcggacgggtcgggcacgatctttctcccatgcgtcagcgagcggaaactggagcttcctggccatgatcgaaagcattccgcaagatagtccgcgcttttgtggcaccgccggacacttccgtaccaggaccaagtccgaccacttggctcggacaactctgcaaagatttcaaataggggtccgcatggcctagatttggcatgggaggtggttgactgccggtacagttacggggcagttgcctccggcatcccgcgatccctgtccatttaacccgtggcagtcgctcgaatctcgtcgtacagtggtggtgcacgatcagggccataaattcctgtccgaaagttgaaatcgtagcaattcccaactcccttccacatcgaccgtcaattagacctcaacaatggtgtctcgtgccnnnnnnnnnnatcctgtccgaaagttgaaatcgtagcaaatcccaactccccttccacatcgaacgttaattagacctcaacaatggtgtctcgtgccagcttcctcgcgttcatcgcgatcaccctcgtggcagcaccatgcgcgcttgccatcacggacactgatatcctgaactttgccctcaacctcgagtacctggaggcttctttctactcgtacgctgcccgaggtaggtttctgtgggtttttgggagtatctgatggtgcatgagtcgcccgcagtggccagctccatggagggggaagatggcctggtggtgctctggtactgatccttcggtacagcttcctctagagccacgcgtgattgtaaaaattccttgccgattatccatgatgagggatgccaaaactcctgcctcgnnnnnnnnnnaagcttcctctagagccacgcatgattgtaaaattccttgccgattatcaatgatgagggatgccaaaactcctgcctcggctgccgtgaagtaccgactcgtgttcaatccgggatccttacgcaggcgttggcctcgactcggatnnnnnnnnnnatgaagtaccgactcgtgttcactccgtggcccttacgcaggcgttggcctcgactcggatctcaccggcggcggtcccgaggtcattggcggagagaaggccaacctgaccgagaagggtgcgcagctggaagttcatgggcgatgtgatgcctatgcgtctaccgatgctctgtcggttcattgctcaaggcgccaggcattctgcgatttcgtgagctacctcacgactatgaagtggaggcacgagaagcgatcacccaaagttgcccaccttttcttatttcacaggccagttcttcgctgaggctctggcagtcgatgagatcaaccacgtcaggctgctgaggtgcgttggtgtcctgggcttcagtacgagtttcttagcagatggtcgactgactggtagtgaaattgcatgacatgagatgtgagagggttgggtgttgtttcannnnnnnnnnatacgactatgaaatggaggcatgagaggcgatcacccaaagttgcccacctttccttatttcacaggccagttcttcgctgaggnnnnnnnnnnttttcttagcagaaggtcgactgactggtagtgaaattggatgacgtgagatgtgagagggttgggtgttgtttcatgagcaattcgagttcagtgaggataaggtcctcagatgatgtcatcctactcccttactttatgacaggagtgtgctgggagacgcagccgtgcccatccccgccatcgatctgggccctgcctttgccgccgctgccaacgccgccctcaacctgacgtgagtttgccatttggcatggcgctgcgaaggactggcggtccgtgaacaaagggttttggctacatcctgcaacccacacgtgtacgcgtataccttcaccgctgcgctgtgatgctcatacccctcccactgccccatcatcgccgcagcctggacccccctttcaccccctatgccaacgacctcttcttctaccacggcgccttcatcttcgaggacgtgggtgtgaccgcctacctgggcgctctgccctccatctccgacaccacctacgtccccaccgccgccggtattgccgcagtggaggcctaccacgccggcgcggttcgcgctttcctgctgggcgacatcgacacggtcacgccttacggtgtgcccgtgtccaccatcgtggacgccatcgccgctctgcgtgagacggttcagggcgagcccgtggatgcctttgacctgggcggctcagagagtgcgcccctgttcgtccccgcctccgccaacacctcggtcgccttttcccgcgatcccagccaaatcctggcggtggtgtacctgggtggcactgacaagggcggcttcttccccgaggggctgaacggcaatatcaagtgaatgtgggagtgaggttgtatggtgtactacggctgccggcgcctggcttgcccccatgtcacatacattcatttctccttgcacgtgcaaccccgactgatctccttatcaagcctgcggtgtgacagcctgcgagttgttcaatggatgtctaccgtcctctctgttcagagtgtggaacaagcacgttttctggcggtatgtcaccagccacgattcattcccatcatatttttggccatgccttcctctctaaaggtttaaagggggtttccatttatctgctaataatatcttctgcaaatatcttcacacgaaattctaggacagtgcagggttgatggagtttagggagggggacacaactcacatgagaatggtgggatcttgggcagtaatctcaacttgcaagcactgcaaagtcagccttgtgcgaggatgcacagacgccatgcaggagaatgcactcgagacgaaggctcacgcctcgtcatcaccgactgtcaatgcctctacgaaaatcacgttctnnnnnnnnnntggcaatatcaagtgaatgtgggaatgaggttgtatggtgtaccaccgctgccgacgcgtggcttaacccccaagtcacatacattcattcctccttgcacgtgcgacccggactgatctcctcatcaagccctcggtgtgacagcctccgagttgttcaatggatgtctaccgtcctcgctgttcagagtgtggaacaagcacgttttgtggcggtatgtcaccagccacgattcattccaattatatttttggccatgccttcctctctaaaggttaaagggggattccattcatctgctaataatatcctcttctgcaagtatcttcacacgaaattctggggaagtgcagggttgatggaatttaggaagggggacacaactcaaatgagaatggttggatcttgggcagtgatttcaacttgcaagcactacaaagtcagccttgtgcgaggatgcacacacgccatgcaggagaatgcacttgagacggaagctcacgccttgtcatcaccggctgtcaatgcctctacgaaaatcacgttctgcccctcctccagccccgcctcggccaggctgggccactggccgccctggggcggcaaaagggtgcgccgtgggtactgcagcaccaagttataccgctcgggcagcgcggccgccccgctggcctccgcccactccagcagcggctgcagtgagccgtccaagaaaaaccggcgcgtatgccgtgatccgtcgccgaggcgcagcaggcaggtggcgcaccccgccgcgcctcgcccgggttcggccgggagtcgggcgaggagcccggcggcggcttgggtcctggcctgccgccgccgcagctcagcctctgctgcagcagcctccgccgcggcagcggtctgttgacgaagagtgtggcgtcgggagggatgtttgcatgccccggagcctccgagtctgaataccttgttgggtccccaggagcgagatgctcaccccacgtaacaactctgcgccctccgcctgccttgccaccctcgccctccctccccatctacaggacgcgcgccccccc

SEQ ID NO: 36099 - DNA, 61 bp, Chlorella protothecoides
catcaacaccaagctggtggaggccggctctgagattgtctccatctaccaccgcaggtgg

SEQ ID NO: 36100 - DNA, 61 bp, Chlorella protothecoides
agcttgggaaaggcaattggctggggatggggctccaccatcctggctccccttcaggcac

SEQ ID NO: 36101 - DNA, 61 bp, Chlorella protothecoides
ctgcaccggtgcgggcacctgtagcggctttactcttacatgcgccacccagatggattcc

SEQ ID NO: 36102 - DNA, 61 bp, Chlorella protothecoides
ctcggtcaagatcccggtgtatggcagacccgcgcccacatcttgtgttcgcagggatcgt

SEQ ID NO: 36103 - DNA, 118 bp, Chlorella protothecoides
tccaggtccgccatggcggccgcctccaccgggcctgcgaggggatggtgaagcttttcatggggggtgacacgtgctcctgcatgctgccactccagcagaccccggcaagccggtc

SEQ ID NO: 36104 - DNA, 110 bp, Chlorella protothecoides
acactgtggaacttcccatcctccacacactcatgccaacgggcttgcacgcagcatacttgagtgcttcatactggtcggggccgaggtggcgcgtgaaggggtccccc

SEQ ID NO: 36105 - DNA, 61 bp, Chlorella protothecoides
gcagtggtgcgccgcctagcggctgtggggggactcgaggatgctacatcatgcgatcccc

SEQ ID NO: 36106 - DNA, 1751 bp, Chlorella protothecoides
caggcgggcttgcccccagggccgcggctgatgggagtcgaggccgacagactggagatggactatccagacctcttccgggactaccacatcacggccaaggacatcagcttgttgttgtagggtggtgtggtaaagcggcgggcggtcggtggcaggacagcttctcgaacggctcacagctgattcttcttctttcacccagcaatctgaggtgccatgcagccgccaaggactggagaagagatattgaccaggtgcgcagtatgcagctgaggatcaatgccgcgcctacagactactttgggcatctgagcaaggggtgaagaggagccgtgatctgctggcagaccccttgccagctcgagatcctgctcaagtacgggcacctgcagcatgactgggacaggcaccaccgcctctgcacgggcaccgaccacccagagctctgccgggcgctggtccgggtgcatgacttgcgcccgccctgggacccggcgctggcacagcaggaagcgatatacatatccaaggtgtgaacatcgttcattgctatcgttccattacacattgctcatctttcttattacacctggccacgcttttgtggcaagacaagctctcaacagtggtgacttacaggatggtattcaatttgaagaggtactacatggttgggagggaacagactcagtgtgtaatgcaaaggatgcgaatttagttgagagtaattttgtacggcagagagtagcctccagcattggtcccagccaccacttcaagataactcaagtatgggatcacactggcttggaatgactggtcccatacttgcgggtttgtctgatcagacaaccagtgtgaacccgatcctaccatccagcctttatctgtaaagaacccaacgttgtagaagtttggtagatccccaggggcggtgatggtgagggttacgtcggtgcctgataaaacggctgttcccgaaactgtggccagcgatggcgggggtgggggaattgccggaggcggaggtggttgggaggctgaaatgcatcttgcgctgggcacgctgtatatgttgcagataatgagggtgggcgtgtcgcctgagcatacccctgatgtcggagcgactgcgttactctcacagccgggttcctcaggctgagttcctgcttcgcaggtggcggtgggcacccctgacacggtacagattactacgacgggggtgggtttggagcaagtccctgcgttgctcaccaagattggcgagtcaccgcatacgccaatggaggaaggaggtgggggtgggtttgaagttagtgtcatctcttgaaccaataggagattgtgactagcgtccatgaccaagatactgctgtagccgaattcggaggcagcagacaccgtggtgagcaaagtgctctggtaggatgacgacgtcaggaggatgccagtagcaaatggtttgtcaaaccaagaagtccatataaaaatctgtgccgaacagttagtgtacccggcctgcgatatgtcgatgtgcacattggctcccgctgagttcacataattgaaggaaactgtgcctgtcagggtagcgggtggtgggggcggaggagaaggaggtggagggcttgggggcggcggggagggtggactaggcggggagggaggaggagagggaggtggaggacttggcggcgagggtggtggtggactgggtgggggggaaggtggaggacttggaggcg

SEQ ID NO: 36107 - DNA, 62 bp, Chlorella protothecoides
cacatccacacatctttcccccgccacctcactacattcaatcacagtggttccagttcttt

SEQ ID NO: 36108 - DNA, 75 bp, Chlorella protothecoides
tctgcttcctcttctccaccccttccccccctccctctcacccaagctgggctgggcagaggcgtgctcccgcat

SEQ ID NO: 36109 - DNA, 3348 bp, Chlorella protothecoides
  modified_base (446)..(455): a, c, t, g, unknown or other
  modified_base (992)..(1001): a, c, t, g, unknown or other
  modified_base (1567)..(1576): a, c, t, g, unknown or other
  modified_base (2012)..(2021): a, c, t, g, unknown or other
  modified_base (2254)..(2263): a, c, t, g, unknown or other
  modified_base (2331)..(2340): a, c, t, g, unknown or other
  modified_base (2405)..(2414): a, c, t, g, unknown or other
  modified_base (2963)..(2972): a, c, t, g, unknown or other
ggtggcgagatccaattgcttcacccaatctcctcaacctcgaactatgtgacagttttccttatatgttggcatccctcctcgtcctggttaatgccatgctggcttgttccgcaagcgctccgctcccggagctttcccgccactgcaccaccgcatgcaaaggccagcgcaagcccgaaagcagctagattcaacacgagtcacgtaaaaatcaaagccatgtgtgtctgtagacttagatcctctgccaccctctgaattgttgggaccgggccctctggcaccccgacaaatgcagcctgagcccagcatccaagatcatattttccgggttccacctctattatgagacagggctcacgaaattcagcaatggaaagctttccgatacgaatagtttgagatagcgaggaaccactgagaaggggacttgtcacctttgnnnnnnnnnnctgcgagacagcaatgctgtcggtcggggctgtttacaggcatacaaacaatttaaagcagaagtaggatatggaaggtaagcagttcgtaatagctacgtacttgtaaccacaatgctaaagccctcgatggcatatgcgaaggaaggggggcgtccgggtggccgcgaatattcccctcgccgctgcgaccagagcatagatagggggagcacgcaataaagtacgcacaaactgctcctcagcgagcagaaggctccttcttcccgcgcagtccacattgctgcatcgttttggtgctgaagaaatcccatcttggcccacacgttttcgggcaagatgatgctgcaagtgcgggcatccctttggagcacgatgctcctcctgttgagccttgctgtgctctcaagggtaacttgaggtggagtttggggcgtgcaagacttttagaggttgggccaccttgtagttgatgccaaatctggattgtgacgtgccgtacgtcgttcccctcacgctcagggcgcatgcacgacnnnnnnnnnnagaacgtttcactgacactagactctgtaacgccttctagtcttcaagatatattggcgccaacttgtagacgtaaaaaccttgcatgggtgtgtgcggcaatatggcgtcgcatgggcaacgttctcccatgagcgtagttctcctcgtgctcagccttagtgtgctctcgagggtaagtcagatgaccgtttttggtatgtccatttcttctagaagcggatgcttcgcgtcactgaccacgtccggagggtgacgtccgccacccctccctcctcctcccagggcgcttgctcgacgaagttcttcccgctccccactgtcatgtgagttctgatcatgtgtttctggctatttccatcgagacgtgtaattgtcgtggcttgtcctcggagggtccggatgctgatgtgcgccggttagatgcgcctttgggacggatattatccgggccactgtagctggatccataccccttcccatacaccgcacacacacacactcacaaacaagaatcctctcctctcacagttatggtccccatgtctacatgctggaggtcagcnnnnnnnnnngtgagttgtacctggcaggattggcaagtcttttgtgcagatgtgctcccgggggggggcggagcctgcctgacgatgagattcttctcctgcgtgaagctggcacgggtgggtgtccggacgccggaagctgctccctagacctcgtcgtgcactccttcgtcctctaataggtacgggccccacgtctacatgctggaggccagcagcgcggacaccctctgcaggtgcgtgctgagtccgatacgttctgcttatggagtgcatgtccaaagcaatgacatggcttaagttgctggcagcctcacagtgccgattcctttgtcaagcaccacagggagatgggctatgccagggcgggttcggtcagggagacaaccctccatatcctcggtctttccgtcagtgccatcaagatgagcccctttgaggtcannnnnnnnnnttggagcttgggcatgacttcaaattgcatatccaagccaaagcacttgcctacgtccagccacatcttgacagagccctccccaatccaagcaccgcagatgggtggggtacagcaagtctggcgctatcaaagagaccaccctccacatccttggcctgcccgtcagcgccatcaccatgaagccctttgagatcaacaaggatcggtcggccaggatccttgtggccgtnnnnnnnnnnattgctggcagcctcctcacagtgccgattcctttgccaagcaccacagggagatgggctatgccagnnnnnnnnnncgccctcttcagaactttggcagaaatgttataacgagggaagctgcgagagatcacatttacannnnnnnnnntcggttgttctcgcagcagcttccaatgacgcagccacgacgcggcaactctgggcaactctgagagggggagaacgtcgtccgggtcatcgccgacctgccctcttcagaactccggcaggaatgtgataccgagggaagctgcgagagatcacatttacatccaaggatcagccaatacaaggatgatcaccctcccaatgaatatcgccgccatcgtctcgtagtaaagacattctctctgggccgagggcgtgcggcaagatgccgtcgccacgacgaacaccactctggagcaagatgctccttctcttgagccttggggtgctgtcaagggtacgtgcagccgatagtctgcccatttcttctactgtatgaggaggggagagtgcgcgcggtacttgcgttgtccgaagatggtctcccgcttgcctttctcactctcaggccgcctgcacgacgaagtttttctcgctcctggctgtcaggtgagtcaagtcagggtgtctatggcttcgatgtgtcgagaccagctcctggagggtgcgnnnnnnnnnncttgtccgaagatggtgtcccgcttgcctttctcacgctcaggccgcctgcacgacgaagttcttctcgctcccggctgtcaggtgagtcaaggcagggtgtctatggcttcaatgtgtcgagaccagctcctggagggtgcggagcccactgtcttttcccccgccaagtccggagtccggactcggggagctgcgctctcagatctcgctacacacctcccctgcataacagatacggaccccatgtctacatgctggaaacccaaagcgcagatgatatctgcaggtgcgcgctgggtggagcttgggcatgacttcgaattgcatatccaagccaaatcacgtgcctacgtccagccacatcttgacagagc

SEQ ID NO: 36110 - DNA, 69 bp, Chlorella protothecoides
acccaggcaagggactgacggtgccctgggctacccctttgacggggtgatggtatgtgacgctgggtg

SEQ ID NO: 36111 - DNA, 61 bp, Chlorella protothecoides
gatggcggtcttgcccacgcccggctccccaatcagcaccgggttgttcttggtgcggcgg

SEQ ID NO: 36112 - DNA, 79 bp, Chlorella protothecoides
caggaggggtggcggtggctcacaaggagccttacgtcgacgctcctcttcacctgttgcagcgggtgctctgcggggc

SEQ ID NO: 36113 - DNA, 66 bp, Chlorella protothecoides
tttctcgacaaaacttcctggccaagacaccccccttccttcctcgcaacagattacaggatgact

SEQ ID NO: 36114 - DNA, 576 bp, Chlorella protothecoides
  modified_base (117)..(335): a, c, t, g, unknown or other
gttcctcatcctctgctaaaccccttgagcttaagttctactaataggatcttgccagcgtctgatgactgatcggtcactcacggcgccttgatcagcctggcattgagccagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaggggctggtatggagagttaggaggatcgcaggtatttcaggccgaccccccacagggattggggagatgagtctcaaaaggcgtctggtggatcagcagcagctggcagctcagcgtgacggggttcacttggtccgccaccccgcgcgatggccaccattaaaaaagacgcagcgagcaggcggactctggtgtgatgctatcactcgcttgcatagcgccggctgtgtatgcgg

SEQ ID NO: 36115 - DNA, 71 bp, Chlorella protothecoides
tccccctggcactgaccctcctccgctctccccccccgggtcccgtgtacaggcgagtacattgccgtgga

SEQ ID NO: 36116 - DNA, 25272 bp, Chlorella protothecoides
  modified_base (1008)..(1017): a, c, t, g, unknown or other
  modified_base (2265)..(2336): a, c, t, g, unknown or other
  modified_base (4296)..(4305): a, c, t, g, unknown or other
  modified_base (5221)..(5230): a, c, t, g, unknown or other
  modified_base (5462)..(5471): a, c, t, g, unknown or other
  modified_base (5759)..(5768): a, c, t, g, unknown or other
  modified_base (5901)..(5910): a, c, t, g, unknown or other
  modified_base (6072)..(6081): a, c, t, g, unknown or other
  modified_base (6617)..(6626): a, c, t, g, unknown or other
  modified_base (7422)..(7431): a, c, t, g, unknown or other
  modified_base (8698)..(8707): a, c, t, g, unknown or other
  modified_base (8921)..(8930): a, c, t, g, unknown or other
  modified_base (9167)..(9176): a, c, t, g, unknown or other
  modified_base (11831)..(11892): a, c, t, g, unknown or other
  modified_base (12718)..(12727): a, c, t, g, unknown or other
  modified_base (13498)..(13507): a, c, t, g, unknown or other
  modified_base (14348)..(14357): a, c, t, g, unknown or other
  modified_base (14624)..(14633): a, c, t, g, unknown or other
  modified_base (16190)..(16199): a, c, t, g, unknown or other
  modified_base (17135)..(17144): a, c, t, g, unknown or other
  modified_base (18448)..(18457): a, c, t, g, unknown or other
  modified_base (19504)..(19513): a, c, t, g, unknown or other
  modified_base (22515)..(22524): a, c, t, g, unknown or other
  modified_base (22624)..(22870): a, c, t, g, unknown or other
  modified_base (24278)..(24287): a, c, t, g, unknown or other
  modified_base (24604)..(24613): a, c, t, g, unknown or other
  modified_base (25089)..(25098): a, c, t, g, unknown or other
ccagggaccggcctcgcctcgcccccgcacggccgcctccctccaaatccctccctccccctggaccccttccccccctccgacggcggcccaccccccgaccgtccacaccacccggcgacgctgacgctgatctacaagcgcggcgacgacctgcgccaggaccagctggtggtgcagatgatctcgctcatggacacgctgctgcggcgcgagcacctggacctgcgcgtcacgcgctacgcggtgctgcccacctcctcccgcgacggcctcatccagttcgtccccgccgtgcccctggcgcgcctgctggccacccaccgctccatccaccgctacctggcgcaggccgcgcccgacgccacgggcccctacggcctgcagcccggcgtcctcgccaactttgtcaagtcctgcgccgcggcctgcgtcatgacctacatcctgggcgtgggcgaccgccacctggacaacctgctgctcgcgcgtgacggccgcctcttccacatcgacttcgggttcatcctggggcgcgaccccaagcccttccccccgcccatgaagctgtgccgcgagatggtggacgcgctgggcggcgccgacagcgagcactaccgccgcttcgccagccacgcctgcgaggccttcaacgtcctgcgcaagtcggcgggcctgctcacggggctgctccgcctcatggccggctcgcgcctgccggacatcgctgccgaccccgacgccgcgctgctgaaggtgcaggagaagctgcgcctggacctgggggacgaggaggccgcccgctacatgcgccagctcctggccgactccgcttccgctctcatgcccgccatcatggagaccacccaccgctgggcccagtactggcggtgaggtgggagggcatgacggttggacaagggggtggggggtccatggcccgccttccatgaatcaaacggacatcggaggcctgccgctggacggccgtcccctgcaaccccgccnnnnnnnnnnagggggtccatggcccgccttccatgaattgaacagacatcgggggcttgcgctggacggccgtcccctgcaaccccgcccgagaccctgtgacgccccttcctgggcagcagcgagccggtcaggggcgactgtacacccagcgcagtgtgtcggtggggttgaggagaggggcacgagggcagccggggggactgcaccgagagttcaagtgagaggcaagggggtcaggtcagggcgacgccgggctgcaagtatcaggcgggcgcgccctgcgcggcgacgccatcctcccgtgcgccggcggcctgggcggtgcgcaggaggccggccgcctcggaccgcccgttggcggtggccaggcccagcgctgtgttgccgttgaggtcccgcacgccggggtccaccccctcctggcgcagcaggtggcgcagcagcgccgactgaccttcactggcgcaggcgaccagggggatgccggggatgtagttgaacctgcatttggtggtgggtgggggggaaggaatgagagggtatcgggatgatgcagggaacgggcaggggatggggtgaaccccagagccgggcactactggctccctgaaaccacgctccagcttccccagctcactttgcaggtatttcatcctcttcgaggaggtcgggaaggacgaggggtcggtcgcaccagtcagccagtgtgatttgtcgggcaatatgtttctgaagagatgtggaggggtgtctgtgatggggaaggccttggatcgggtcacaggaaccacaagcgattccttcacaggcaggaagaatcggccggttgagaatataatccacatcagcccacctgctgaatgggggagagcgcgcgtgtgggcgctgcagggccctgctcgggagctatggctccatgctgatcatctcctaccgacgaggcggagggtgctccctcatcccgactcagaagatcccgtaagggctcgtcgacagacaccctcagccgtttctgagagtcccgctccggtgtgcagcttggtcgggtgcgggcgttcctgggctcctcccggggcctggtagtgctgctgctgctgtggtcgtccccctgccccgcgccgacgccctcctccagactcatcgagacttcatgggctcctcggtgtcgagtggagattggtcgccgatccaggcatgggatgtatgatgtgctggtgtcaatcgcgcttctcgttgccaccgtacctgtcgcgnnnnnnnnnnnnnnnnnnnnnnnnnnnnnnnnnnnnnnnnnnnnnnnnnnnnnnnnnnnnnnnnnnnnnnnncccggacagcacggacagcacggtcgaaatacgtgttaagaaccttcagacacctcccgatgctggcagcaggctggttaaactcgcttgagaattacacacctttgattggaaattatcaagcactcctgcaggtgcgaattcccgcggaaccgtggccatccgcctgtcgtgcgatcgccacaccccgacttcgcagggaaccccaacccacctcactgcgcgatggggagggcgatcctcccgtccctgatcctgctggggtgcctggcctgcctcgtacccggcgcgcggtccagcatcatggccgtggacctggggtcggagttcatgaaggtggccctggtgcagcccggccgcacccccatcagcatcgtgatcaacgagatcagcaagcgcaagacccccgcactggtgggattcgtgggccgggacaggctggtgggcgaggaggcggcggggctggccacgcgccaccccaccgcctttgtcgccaacctgccggccctgttgggccgctcccccgacgacctggcgctggccgcgctggcggcccagggcctccccctcccccgcctggtccctgccgccaaccgcaccggcgccctggccctggacttcggcgaggcggggcatgtcacgcccgaggagctggccgcttcgctgctgcagtatgcggccggcatcgcgcgcgcggcctccgccacgggcaccgcgccgcgcgacctggtgctccttgcccccgctcactacggcccgcgtcggcgccaggccctgctggacgccgcggcagcggccggtctcaacgtcctgggcctggtcagccccgccgcggccgccgcgctgcagtacggcatcgaccgcaccgccaccttcgcctcgggcgggccgcagcacgtcctgctctatgacctagggtctggggggctggaggtggctctggtcaggttctccacctaccctgaccgcaaggtgtctgggttcagagtggggttgcctggctagccggggggggggagggggctgatgaaagggggttggggtgggaggaggctggcctgcatgtggaaaagctggtgtgaggtcctgacaggggagttgggattggaggtaatgcagatgtgccttcagcagtgccatgccagagcggaacccaggcctcggacccctcccagcaccactgcccgtccctctgttcatcccggctacttcatgcaccgacagggcgcccccgccagccaggtggagatcatggacatggcctgggacgagggcgccggcacccagctgctggagtccctcctgctgcgccacttcatggcgcaggcgggcgaggcgctgggcgaggcgggcaccgacctcgccgcctcgccccgagccgttgccaagctgcgcgccggggtcaagcgcgcgctgcgcgtgctgagcgccaatctggaggccccgctgtccgtggaggagctgcacgccggccgcgacttcaggtcctcgatctcccgcgaggccctggaacggctggcgggcgactactgggctcgcgtcacgcgcccagcgctggacctgctggcccgcaacggcgtggcggccgccgacctggcggctgtggagctgctgggcggcggctcccgcatccccagggtcaaggccgagctgtcccaggccctgggcgggcgcgcgctggacgtgtgagagctctttgtgattggttgggcgtgagagggtgggacatggcaggggagtcgtgcgcaataatctcgtgggaggagggagggtgggcctggctggcgcctgggagggagacagaggcggcccagcaagacggaggtgggcttcggttccctgaactgcctaccgcaaagcagcgccagggctgccatgccccgtcaatgtcgcccaccgtcagccacgcctgctggcagtcacgaaaaacacgctcaaccagcaagcccgactcccccannnnnnnnnntgcctgggagggagacagaggaggcccagcaagagggaggggggctttggttccctgaactgcctaccgcaaagcggcgccagggctgccatgccccgacaatgtcgcccaccgtcagccacgcctggtggcagtcacggaaaccacgctcaaccagcaagcccgactcccccactccctcctctccgcatctcgcaggcacctggatgccgacgaggcggtggtcctgggggcggggctggtggccgccaaccgtagcacccagttccgcgtgcggccctttggcctggtggacaaggtgccgtacggcgtgagctacgcgctcgatgacgacacagagggtgcggggggtggggtggtgggtgccgcgctggtattgtgaggaggttgcagtattagaagagggtgaccgagctctgtggcccagcacttgcgcccactgagctgagcccaccaaccccaccctcctcccgatgcagtcaagcccctggtgccggcgatgaagcgcgtgcccagccgccgcgccgtcaacctcctggcccaggcagccgaggggcgggacgcggtggggctgcgcctctttctttccggccctgcgtccgaggggcaggcccgggagttgggcgcctggcgcgtggagggccttcgcgccgcgctggcggcgcacgacaacgtgacgcgcgtggccttccacgcccgcgtcgacgacggcggctgcttccatgtggacggcgccgacttcaccgtctcccgcctcgagtacgtggaggcgaagggcaccctggctggggcgccggggacgaacgccaccaatggtaccgcagcgagcaacgtcacccacggcgggggcgcagaggccggtgtcctttcgggcggcgacacgaacggcacgctcgcgggtgcaccagactccaannnnnnnnnngcgcagcgagcgacgtcaccggaggcgggggcgcagaggccgctgtcctttcgggcggcgacacgagcggcacgctcgcgggtgcaccagactccaacgccacgaccgccggcgagggggtcatcgacgccacgagcgcagggacctcgagcgcaaacggcaccctcgcacgagtgccgcgggtgcgaacctcgcgcctcccactgaacgtgacgggcgggctggcccaccnnnnnnnnnntgccacgagcgcaggaacctcgagcgcaaacggcaccctcacacgagtgccgcgggtgcgcacctcgcgcctctcactgaacgtgacgggcgggctggcccaccccggcttgaccccggagcagctggcggggtcgcgtgcggtgctggcccgtctcgccgcccgcgacacggccaagcgcgccgccgcgcaggcgaagaacgacctggaggcctacgtgctggaggctgccagctgggtgcgtggtggcgtctgggggggtcggagggggggctgggaggatggatnnnnnnnnnncctggaggccgccggctgggtgtgtggtgccgtctgggaggggtcggagggggggctgggaggatggatggatggatgtgccccggggacgtgggctggggttccgtggcatactcccctggtggaaaatgtnnnnnnnnnntgccccggggacgtggggtggggctccgtggcatactcccctggtggaaaatgtggatgtcgcagtgctggcgaggcgttgtaatgcatcatgcaccacccctcccccctcttgaacagtataccgcacctctcactctcaagcctccacacacacgcaccnnnnnnnnnngctgctggcgaggcgttggtatgcatcacgcaccacccctccgccttcttgaacagtagaccgcacccctcactctcaagcctccacacacacgcaccgcaatccatgcagtctgcggaagacgaggacgtcaaggcggtggcgagagccggagagctggcgaccctgggccaagcactggaggaggcggaggactggctgtatggtgagggcgatgccgctggctctgaggagtacgtcgccaagctagaagccctgaaggcgctgggtgacgggctgaggacgcgaggcagggagcgctccgccaggcctcaggtgggtgggagtggggtttggtgtggggcaaacgtgggagggggggtgcatggacgctcacagcgcgttgattctgttggtggagaccgcaccgccccttcattcaaccctggcggtctcatcaatcatccccctacaacccctttgccaccccttcttccctcgacaggctgtggcagaggccaggaatatgctggaggtgctgagccccatcgtggagnnnnnnnnnnaaagggggtggttggtgtggggcaaacgtgggaggaggggtgcatgggcgctcacagcgcgttgaagctgttggtggacaccgcaccgccccttcattcaaccctggcggtctcatgaatcgcccccctacaacccctctgccaccccttcctccctcgacaggctgtggccgaggccaggaaaatgctggaggtgctgagccccatcgtggaggggtgggcagccgccaagccatggctgccagagtacgaagtgggcttggccaaagaaaaggtgagagggctggtgggtggtgacatggctggcaagtggctcgaatgccatccagagtttcatccaagatggcaggagcagtgacacaggtcctggctgcccaggcttctccagtctcgtgcgggcatgccagcaagcaatcagccaatgcccagctagcgatcagccaatgcccagcgagcgatcagccaatgcccagctagcgaccagcgcccccctcaaccctgcctgcagcttgcggagctgcagaagtggctgacccaggtggaggccgtccaggccaagaagaaggcgacagacgagccggctttcacctcggcggaggtcaatctgcgactcaaggtcgcggcagaggtgggtggacagtgttgtcactagcgcagttggggtcttacaacagtgcgtccaggatgtagctcgcacatcggcgggtcgcagtcaggaagcttggcaagctcagtactcatcccaaagtcttccactccccaactctccaatgcagtcggtcagcatgctagatannnnnnnnnnaaagctcagtactcaacccaaaatcttccactccccaaccctccaatgcagtcggtcagcatgctagataggcggccggcgccgcccacgccaaagccgacgacggatgccactgccgatggggcaaagaaaaaggcagcaaagaagggaacggggacaaacggcaaagcgaagccatctcagggccctggggagccggaggcggaggtgcaagcgccggaggagccagcagagggcatggaaaccgtgaaaaccgaactgtgaacagaaatgcacacgccggctgtaagttggcgcctctggtgcgttcacacagggtcctagaggaatgctgcagcactgctggtcagtgggctatgaccggcaggccatcgcaacgctacctcctcccgccccgcttcttcttgttcttgcccttgggcccctgcttgttgggctgccccagcggcctgctcccagtcgccggggcggcagcaggggctgaggagggacctgggcgcccactgccactggcctgcatcagggtgagcaggaggagcagctgctgggaaagttgcaggaacaggtggatatagaacagggcagtaatcagtgatagaaagcttgcctgctgtctggagagggctgcttgcccggcgcgctgggttggggtgggataggctttcaagctgcgtacacggtcgtgcacagacctcagccactctataactcgttgctgtcgtagcaggacggccgtgcatcctaatagaagtggggccagcccaacaccggagctggctggctggagctgcttggacacgcgactcctgggcgcgatacgatggccgtaggggctgtgcaagcgtgctctgtggacttcatcactccaccccattcagagaatgtggagaagggcagggatgacaagcacggaaccgtactaaggggtgaccgtcttggtgtttggcggcaacgaatactcttcaatatcacccaaatggaagatgatcggattgcatagcaacacacggagttgctggtgcctcatcatgtacttgctctgaacaacgtcgtgggaagacgatcggtatcctgggcgcgataactctggctggggacacatcgccccccgatgtgctttggttgttcatgcgctttaacacccactgacaagttgcaaccttcaataaacgaattaaagattgtgctctcgtcgttcacttagaaagcttgagagctggcagtgcgactttcgactttccagcacaccatttcatcttgtggctcnnnnnnnnnngaataaacgaattgaagatagtgctctcgttgttcacttggaaagcttgagagctgggagtgcgactttcgacttttccagcacaccatttcatcttgtggctcgcccaaacaatgaaccattgaatgggagaggaagccctgctttatgcacctctgagttatcacgatgtatacttgtacccagaagacgccagtctggttttgggtgctcnnnnnnnnnnccaatgaatcattgaatgggagaggaagccctgcttcatgcacctctgagttaccacgatgtatacttgtacgcagaagacgccagtctggttttgggtgctcactggtggaatgatcaggtgtgtgcagtgcttttgcacctatcagaattttggaaccaacactatctccgatgaagagacctcagctaacatgcaaagtcaccactggcccttccctcatcgctcctgcaggtnnnnnnnnnngtttgcacctatcataattttggaaccagcactaactccgatgaagagatctcagctaacatgcagagtcactactggcccttccctcatcgctcctgcaggtgatagccttcgcgtttgagtggctgaagtttcaagtaccctgtccctcgccaatcttggccatacctgcagctgcctgcttcctactgctgcattcaggtatggcactggaggaattccgatccttgtcactcaatctatatattatctccagagcagattctggccacccttcaaacatgtctgcccctgcaacttctacatatacaactgctcaacctcctttgcactgccgcagatgcacagaccgtacgggagcagctggagcagatgcaggtgggtctgagcaaccattgcctgagcacgtcgttccttgacgcgcacgtacttccaggtcaatcccagccagggcccaagcttgatctccatggtatgcaagacacttcatccccgcaatccctgcttgccaggtgcacgcagcctcgggcctgctgctggcggtcaacgacagcccaagcctagaaagcgcgggcgggggcacccactggtccctgttggcggtggcgctggaccaggggtccgcctggcacgtcgattcgctgggcggggccaacaggcgagtcgcccaggccctcacccggaaactggccgcaggactggacaggtgagctgagggttgaacgcgttgcggaatggtaagcacccaggccggcatctgtcgaccggctcgctcggtgcccctcctggcgctactcttaccccatgcgccatgcttcccggctcaggcaccttgccctgcatcctgcgccggccgcgccgcagcagaccaatgggtacgactgcggagcatgcactgtgtcagcagcgcaggcgctctggcgctgcccagtggccgattggcgcccgcccctgcgatgtctccagcgagctgcaggggcgcaggcaatgcgccgggaggtggcggcctgggtgcgcctggcagttggaggcacactggagaaggaatgaggcggaggctcttgacatggccagagatcaggcctcgggctgtagttccagtacaacctcacagggcgctggagcgccatggacaattcgctgcgctggtcgtcctctgtgtcgtcatgccgccctgcgtttggcggggtgaatggcttgaaagtatgtgagacaacagagctgcaccgcgcaaatcatccaccacttgaccagagtgctcaccgttctgaatcaagtgcttgggccctacgccaatcccacccactgcgcctggaagtcggcggcgggcacgacggccgaggcggccgccgcatgcccacctccacccagggcggccgccagcccgctcacgtccacacctccccgcgatcgcaggctcagcttcaggctgtgtcccgccatgccctcttcgcggtacgccaccacgcccacgggcaggaagggcgcggcgcggctccctgccgcggcggccagggcgttgcccagcacgctgcgcacgctgcgcccctcaccgtccccgtcgtccagcacggtggccaggccctgggcagcgcccagcggcccatctgcggggcccagccgcacggggatggcccccgccagcgcggcctgcaccctttcctcttgcgccgccaggcgtgcctcgccggcgcggcgcacctcctccgggtcgagtgccagcaggtcggaccacaggccccggttgaggtttgggtcgtactccatgcccgccgccgcgaggccggcgtggaagacgcgactgccgggcagcttccacgtccacaggtctgcgtcctggacaaactcgtacacggcagtcaccctaggtggcaggtcctgcagtgcatggggagtgcatgggggtaataagggggtcagggcgaatgcttcaatggcgagattgctgggaagattgtcggggaaggggctggcttgtgcaatctgcaaagcaggaagcatgggggacatggcctcctctccacaccaggcgctgcataccagcggctggaagtagtcgtgggagatcatggcgccgctgcggtgcatgtcaaacaggatctcaacgccctccagcccccggatctcgggtcgcgccaggtccgcggcggcggtcttgtgatggtccagcacgatcacccgcttggggtgctgagcggccagggcgtcgacgaaacccggtggtccggagaagtcgagcaggtacacgaggtcgtcagactgcgcccaaatatcacatgggtactgttggaatcatctggtgccgagttgaaggtccaggacccaagcaatggctcccccacccgcagatcaccttgatgcccaggctcgagggcgcgagaggcttaaaggtggtgtgtggcacccacaccaccggtacattgcacttggaatagtactgctgcagtgctagtgctgcaaaaacgccatcatggcatgggtaatggtacaggcaatggatgcgggaggctgggaggtcgcgccccagtattcgcgcagccattgggcgagctcctgggaggcaggacgaacgcgatcaggctaatttgttgatcattgctaggggtgatgattagtatgcatcggccgagttgtgctgtggttgggatcgggggnnnnnnnnnnnnnnnnnnnnnnnnnnnnnnnnnnnnnnnnnnnnnnnnnnnnnnnnnnnnnngacataaactgcgacgtcgacgatcagcgcgcgctaacctccagaggtcaagagcgttaaaacagccgcgaaacatcagcaccagatggtcctttcgtttatggtagcatttaagaacatgtttgtgtgcacttgctggggacctgctccgtgataccagctgagagatggccaccctgaccgccgtggatgtcagcagcaatggcctggccgcagttgctgccctcctgacggtcctggccggcctaatattccttttgtacaggcagaaggggcctgtcaggcctgcagcttctgtggcggccccccctcccgcagccaacggagtgaagacggggagccacgttgaggaggagctgcccgccgaccgggtgctcatcctgtacggcacccagaccggcaccgcggagcgcttcgccaagtcccttcgcttccagttggaggcccggtacggcggatcgggcaagaagttcgtggcccttgacactgaggggtaccctgccgccaagcacctccaccatgagtcctgcgtgctcctgctcatggccacctacggcgacggcgagcccaccgactctgccgccgagttctatgactgggctgtggagaccgcggagtctggcgacgaccctgagctcctcaaggtggggctggtatgtgaggaggcttggaatgtgtgtggtggagattgctggagtgtctgggctctgggtgtggcagcgtacaaaggctctgggaagtgtgtttcccgggggttggaggtggggtgtgggtgtgttaaacgttggagtcaggatcggtcaggatgctggaaactgcaaaacannnnnnnnnngggctctgggaagtgtgtttccccaggggtgggggtggggtgtgggtgtggaaaatgttggggtcagaatcggtcaggatgctggaaactgcaaaacagagagctacttggtggatctccttccgctgttagtatgacgggattcctgctgcgcaaacatcggcggccgcccatcactcagcgccaccccccccactatcaagtcccagccgaggaaccagtccctcagcgccgcacccacgccctcctccatccaccacctccgcagtccgtgacctacggcgtcttcggcctgggcaaccggcagtacgagcacttttgcgcggtggggcagcgcctgcatggcgtcatggcggacctgggggccacgcccctgctggaccccggcctgggcgacgacgacgacgacatcgacgacgacttcgacgagtggaccctggccctctttgccgcactggacgcgcgcggcgacctgggtgccggggccgcgggcggcgcgggcggcgccgacgccatccccgcctttgccgtcgagacggcgccggccggtgcagcgcccgccgacgccgacgcccagcgctgccggcagggccggggcacggcggcgcacgaccccttcctcgcctccgtgctggaggtgcgcgagctgcacgccgcgctttccacccgctcctgcgtccacgtcgagctggacctggccgggtcgggcatcatgtatgcgccaggggaccacgtcgccgtctttccacgcaacgacgacgccgtcgtggnnnnnnnnnnaccgcgctttccacacgctcctgcgtccatgtcgagctggacctggccgggtcgggcatcgcctacgcgccaggggaccacgtcgccatctttccacgcaacgacgacgccgtcgtggccgaggccgcgcggctgttgggtgctgagcccgactcctgcttcacgctcggcgccgcgccgggcggccccgtccctcccttcactggtgcggccgagggcgggttggcaaggagtgctttcttctgggcaagcgctgggacgaagagtggccgtgtgcgccggaggattccaggccattggccatggatgcccgctgggcgggctgtttcaaggtggtgtggccggcacccaaacccctcttaaacctctaaaccctcatcgcccccctcatcccagggcccatcacgctgcgggaggcgctggccgcccacgtggacctgctgggcctgcccagcaaggccgcgctttccaccctggcggcgtttgccaaggacaagacggaggccgcgcgcctggcgcgcctggcggcgccggagggccgggacgagtaccacgccgaggtggtggccccccggcgcagcctgctggaggtcatgcgggagcacgcctctgcccagcccagcctgggtgagagggaggttggggggaaggggtggagaagaggaagcagagggtaattgaggagaggtttcatgggcgcgggaacacaccgacgggacgtcagctttgagctattgaatgctacctcgtatccaaccccgtccatccctgttgcggctgcgacaaagtggtctagcgacctgtcccgtggctaggtcgcccctgagccctctgtctttcnnnnnnnnnncctggtgcggccgagggcgggttgggaaggagtgcttccttctgggcaagcgctgggacggagagtgaccgtgtgcgccggaggaccccaggccattggccatggatgcccactgggcgggctgtttcaaggtggtgtggcccgcacccgaacccctcttaaatctctaaaccctcatcgcccgcctcatcccagggcccatcacactgcgggaggcgctggctgcccacgtggatctgctgggcctgcccagcaaggccgcgcttnnnnnnnnnngttgaggagaggtttcgtgggcgcgggaacacaccgacgggccgtcagctttgagcttttgaatgctacctcgtatccagccccgtcatccctgttgcggctgcaacaacgtggtctggcgacctgtcccgtagctaggtcgcccctgagccctctgtctttccagggcagaacaggcaacccacctcccccaaattacaacctccaggcgcattctttgcctcggtggcagacacgctgcagccccggtactactccatctcctcgtcgccccgcgcccgccctgccgcgctttccataacctgcgtggtggtggacgaggagctccccggcggccgccgccaccgcggcgtggcctcctcgtatctggcgcgcctgcgcccgggcgaccgcctgcccgtgttcgtgcggcgctccgccttccgcctgcccgccgaccccgccacgcccatcgtcatgatcgggccggggacgggcctggcgcccttccgcggtttcctccaggaccgccaggcagtgctggaggcgcggtccgggagcgggggagcgtccacagcttttggtccggccacgctcttcttcggctgccgccagcccgaccaggacttcatttatcgcgaggagctggagggctgggcggccagcggcgcgctgagtgtgctgcacaccgccttctcgcgcgccgggccgcgcaaggagtacgtgcagcaccacatcgaggcggcggccgaagcggtgtgggacgcgctgcaggcgcggagcggctgcctctacatctgcggcgacgccaagggcatgtgccacgacgtgcagctggcgctggccgcgctggcaggccgggcgctgggcgccggcgaggaggcgggggccgactggctcaagcgcctggcggcagaggggcgcttcatgcgcgacgtgtggtaggccaatcccataaaaagaggtgggcgaggcctgaagcaaggcacctgctcccgagaggaagagcgatgcgatggggccttggattgtaagggtgcctcactggccccgtcgccgctgttcctcccccaacacactcccccaatctgagactgcgtttgcttatgtatgcctgtgcttcctgtgggcgacctcattttgtaccagaacttgccacgctgtcccccctcgtgccggcactcagagggattgcagtggcagcacaaaggccatcacaagggtgatttgacttgtgcagcaaggcatggggtttgcaagctgcgagagcagcaagcttggcaatcacatgcgcacctcactcctcgtcatcgtcatcgtcatcgtcggcgagctgatactcctgtgtggggcagtacatgtgcgaggctgggctgtggtgacggaggtggagctcatcagtggcaagtgctgcccatggagcatcaagcacccatggcacatcaccaggcacgtccgtggcacctccttggagcaccaccctgtgcctctcaatccactggctgcaatgcaccctctgcactccagccaccttgtgccccactcccctcatgcccactcaccatggcgacgtcccannnnnnnnnnacagtacatgtgcgagtctgagctgtggcgactgaggtggagctcgtcagtggcaaacactgccaatggagcatcaagcacccatgacacatcaccaggcacgtccgtggcacctccttggagcaccatcctgtgccctctcaatccactggctgcaatgcacactctgcactccagccaccttgtaccccactccgctcatgcccactcaccatggcgacgtcccaccgactgcctggcgcggcggccgacacgtacttgacaaacttgaggagctccgtctcctcatcgcgcagcaccaggctcaggcaattggcggcgggggagatgttgagcacgcccgactccgactcccccgccgcatcccccggcgagcggtacacctcggccgtctccgcggcgccggcgccgccctccccctcatcgtcggccagcatgtaggcctcgtagccgcccacctcgcccccctcccaggcctcgccggccccggggccggagcccagcatgcacagcacggcgtccaggcagggcgccgccgccagcacgccgtggtgggccaccgtgtagtccatgccgcgccggaaacggcgcacctcgccacgcgcggtgcacgggcgcagtgtggtcatctaagcggggggggtggggtttcaggaaaagcagggggaggtgaggaggagctgggaattggcgagcagttcgagaggaatggatacctgttatgcaaactggaccggctcaggaaagactgcaaatttgactctcagggggcggcatggcaacctggcatacacggcgtcgttgaatctgggcacccagcaaccgatctggcctgttgctggcacgctgagacatgcactgcatgccacaccccgatatatcgcctcctcttcaccatcgcgctctccattgcacccctcccatcaacccctcagnnnnnnnnnnctcgaggggaatggatacctgttatgcaaactggatcggctcaggaaggactgcaaattcgactctcaaggggcggcatggcaacctggcatacaaggcgtcattgaacctgggcacccagcagccgatctggcctattgctggcacgctgagacatgcactgcatggccacaccccgatatatcgccgcctctccaccatctcactttccattgcacccctcccatcaacccctcagccactgactcatgcgaatactcaagggtcgagctctccaggccagttccacaccttttcgacgaggtgcgcaaaagcggagctggtgaggagctcctcccgcacccgctccagtatgggccccgggtccgagccggcctccggcgtgcaggttggctcgccactgtaccgcaggtaccgctgcttgaaggccggccccacggcctcccagcttgggcccaggcccaccgtgtaggatgccggcggggggccctcccccagcccgtcccgttcatccgccgcctggcaggctgccatcgccgcccgcgccagctccggtttgaggaaggcctgcagctgcaccgacccctcctcccggaagcgagcggccaccttgggccaggtggcctccgccaggtagacggggttgacgtagcgggccagcacctcgagctccgcctcgggcaggggccccgctgtggctgctgcgtcgctgcccccaggctgggcgccgggcatgagctggaagtcccgggtccgggggtctgactgcagctgcaactggcgcagcgtcgccgagtcggcgccctcggggggagtgtcccggtggaaccagccctgggcgggagcgggggagggcattgctgtccacaccgatccgtgtatttgggtgatggagtgcgagggtacctgagcagagccacatgctcaggtggaagatgaccacaccttcacaccagccaccccgccgacaaacctggatgctcatccggggctggtccacagtaaagttctcctggatggagtggaaactgacgcctggctgcaccgcaaacatggccatggtgttccagagggggagcacgctggcgctcgggaagacggcgggctgagacttgagctctgcttacggttgaggggggaggggaggaagtggttgagcaggagctacccgcaatgcagcatggtgtagtcatgtttctgatccatggcagaagtgtaagccagagccctgggtatgaaggcacttcctccacggatgccaagctcgagactcaccccaatccctcagagcacccggcgatgannnnnnnnnnctcatgtttccgatccatggcaaaagtgtgagccagagccctgggtatgaaggcacttactccacggatgccaacctcgagactgaccccaatccctcagagcacccggcgatgaccaccccgccaaggtgtgcaccccactgcgcacacacacgaagcattgcagccctacctgggtcctgggggtagagctccagcaggccgccattctctgccttccagggccgctccgggtctgtgaggtagatgatgaaggacaccgcccgagtgccgatgacatcgtcgtggcagagcaggtggccgccccgggcgtgcacattgcaggcgcagtcggtgcggtccgacagctccccgcaccccgtcaccgcggagacaaaggcgcggaagtcggggctgtagagcgcgtcgcgcagagcccgcaccgtggggagcttggccgcgctttccgcgtccaggccgtccaggttggcgaggtcgcctgctggaggttgaggagggagggggatgagcgtgtggacccaggtatccatgccccaatccccacggccgtgatgcaaacgcgctggagcaaggtgaaggcaagcgattcccaactggcctgtctggaacatgttgaacaggtccgtctccttgtacgtcgcctggacgttggagatgatctcctcgcgcaccgctgccagggcatcgtgctcgcagatgtcggtgatgacgcagtgtgggtatggctgggctgccttgtacgctgctgccagcgcctcccgcgactccgtccccgtgacactgggtcggatgatgtcgacggcatggcctgctgtcttggccttcttgggcactggctccgagtctgtggagtcatgtgtgtcattgaataaataaataataaaggaagtgcatgcggttgctttccatagaggggcatgcaaccttctcacaggccaggtcgtcgccatcgaccaaatcgacaggagctcaccagacgtcatggttgtatggtgtatgtgcgagaatttatatgaggtaagtttataccacttctgacggatcaannnnnnnnnntaattaataagaaaggacgtgcatgcggttgctttacatagaggggcatgaaaccttctcacaggcgaggtcgtcgccatcgaccaaatcgacagaagctcaccagaagtcatgtttgtatagtttatatgcgagaatttatatgtggtaagtttataccacttctgacggatcaaattcggtcactgctagtatttgctctggccatgcacgtagacatcatgcagagctgcgcgcgcgcgccagacagcattcctacttgaaaccttgtgcgatcgtggcgcagcatgcggggtttgacagtacggctttcccggcagcttgtccacaggaagtgtccgagtccagcaataacgcctacgaaggagccatcgcgagagcgcgccagccttggcacgaggcgtgatcactatctggtggcgaggtgcattgtctgacactggtcccttgccttcgatcatgtcctctatctgattgctttatagagtgaccccttcagatcgcacatggagaactcgggcgtcacgcaccagtacggcgcaatctccttggcccagaggggaggagcggtgagcgggctttggcctgggagcatgaatgttgcgtccacaggaagagcaacatgcgattcattctctttgaaccctcctttacgtggatctccactccttccacacaaacacacaggcatctggcgccctgaaggcctccagcgctgggctgtcgtggaagcggtccagtggagggaaggcggtggacgtccctctcgctggtgagcctgatcgtttgatggtgctgttgtgtgtggagtgctgaaccgtgtgcggggcggggcattgttttggatatgcatccgtggatccaaggcttccctgacatgggtaactgtaatttcctttcaagggtgggaacctttcacccccctgccaaggatcaggttgcctcactctcctggaatggtgctgccttcattgacaccagctcattcaacccactgctaccccccagctccccacactcacaccgcctccccacacaacacccagatatcaagaccctggcctggtcccggggccagaagcacagcatgctcagcgtgcagcgcgtggacggctcgttcctgggcttcactggcttccgcgacggcgacgccgcgaccctggcctccgcactttcccggcccgtgcccgagcaggcgcaggccacgctggggcacaactggggcgacgcggcggccgacggcgcgggcctgaccttcagcgtcgggggcgggccggccttccgcctgcccctcaccgacgtggtccaggcccaagctgtgcgcgaggaggtgatgctggagttccccgccgacgacgcggcggcgggggagcacgtggacgcgctgaccgaggtctccttctacctgcccaaggcgccggcgccggcggccgccgaggctggggaagcaggcggggacgaagtcacagaggccccctccgccgcgcgagcgctgctccaggcggtgctgccctacaccgacgcgggggcggccacgggcgacgccattacctccttcgaccaggtggcggtcatcgtgccgcgcggccgcttcgacgtggagatgtacgcctcctccctcaagctgctgggccaggcccaggacttccgcgtggcctacgacaccatcctccgcatcttcgtcctgcccaagaccaacgtgccccagaccctggtggtcatctccctagacccgcccatcaggcaagaggggcttggggtgtgggtgtgagagggggaaggtggagagggtttgcggggggtaccggggctgctggtgggaagggggcaggagaatcctctgcatggctcctcaccaccctaaaactctccccccctccccaccccaccaccctgtacaggaagggtcagaccttttacccgcacatcctgtgccagttccccagcgacgagcaggccaccctggagctggacatcaccgacgaggcgctggcggccaagaacgaaaagaacggcgggaagctgcagcgaagctattcgggccctgccaccgacgtctttgcgcgcgtgctgcgggggctgtcgggctccaagctcacgcgcccgggcgccttccgcgacgcggagggctcgggctttgccgtcaagtgctcgtacaaggtgggtcgtgggttgggtatgcggcacaggggttgcagtggcaaaaggctgtgcatggggcttctggtgtgcaccgtgcggcggcgacgatccgccatgaccaagcgcgccctggtcagggcagacctgcgagcacatactcacccgccccaccccatgctgcacgcaggcggacgacggatacctgtacccgctggagcgcgccttcttctacgtccagaaaccgcccctgctcctcgtcttcgacgacgtggacgccgtcgagttcctgcgccccgcccagggtgggcaggccgtggcgtggcgccgtatgcggctgatggggcatgctcgctgtctctgcgaagggttgtatgctgggcacctcccagcacgccgcgtgaaatacggaaagccctttgcaaaacatatccgtgtggtcatgactctgcgtgtgcccgtacacaggcatcccctgccccacacttcattcaaacgcaggcgtgacggcggccaagacctttgacctgagcgtccggctgcgcaacagccaggactacctgttccggggcatcccgcgcggcgagtggaccaacctcttcgagtttatccaggccaagcagctgcgcatcgagaacttcaaggaggcgcagcaggggcctggagccaccgcggtgtcctatgccgccctgggcggtggtgagctgcgcgtgtggtggcgggccagcttgccctgtagcaatactatgtggggcaacacagctccacgcgaagcttggaagggcaggtgggccaattttctctggtcccaatatgttccccctccctcaccatttcccctaacaacgcacgcaatgccaggnnnnnnnnnntgcgtgaaacacggagagcccctcgcaaaacatatccgtgtggtcgtgactctgcgtgtgcccgtacataggcatcccctgccccacacttcattcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttgggagggcaggtgggccaattttttctggtcccaacatgttacccctccctcacaatttcccctaacaacgcacgcaatgccaggtctgggggaggaaggcggtgatctggaggaggacgaggacgaagaggacgaggactttgaggctggggtggagagcgagagctcggatggggaggacgaggacgaggagggccagccgattgtggtcccggaagacgacgaggaggtgcgcgggcgccggtgtgagggggcgagactgggcgtgatatacgatcatggccatcggcgtggtgatcgggtgtggatcagggcgaatagtgggttccggggcgggtttgtgtcgcggatgcaatcccgcgcgggggccgatcgccccgggacggtccagctgcccctcagcgcctgcacagcaacggagggcatgtgcccgtgatcgggggccccctctcactgtgtgggacatcccctgcatcggcccgtcctcctcacaattcaaatcgtcagcccggcatgctcgccgtctgtcactccgccttgggttcttttcgcacctttactccgccagcccgccccagtcgcaccgtagttgcgtttccccgcctcagctcccgctcatcaccccgctccctcctcatgggcaagcaggacgagaagcccgcaaagaaggtcaaggccgccgaggatgccccggccaagaagaccaaagctcagtccaaggctgaaggtatgctgggatcaaaatgcgagttcgtgtgggacagggtcggccacccatcggtggtcgggaagctcacttgcacccatgccccgggatccggggccctgttcccttcgcatccctacctcccaccctagcctccctcccgctccaccacgcaggcggtgtgaagaaggctcgcaagaagaaggacaagaatgcgcccaagcgcggcatgtctgccttcatgttcttctcccaggaccagagggagtcggtgaaggccgacaaccccggcatcgcctttggcgaagtaggcaaggtgctgggccagcgatggaaggagctgtcagaggcggacaagaagccgtacgaagagaaggccgccaaggacaaggtgcagcgatatggggttgggagtgttgcgagggcggcaggtcctccttgcggggctcacctggcttcctgggtccctctctggggctggtgatggcgatgcttgtggtcaagcacgctccactgcgctcaacccgggctgcttcgactgcacaggagcggtatgagaaggagaagtcgagctacgagggcggagcaaagcaggaggacacccctgccgcagaggccggcggcgacgatgatgatgacgactccgagtgatgctcaagcgtcggtcacgctcccccttcattgatgagtctctgnnnnnnnnnncgatgaggactccgagtgatgctcaagcgtcgatcacgctcccccttcattgatgagtctctgccgtgtgccctgcttttttgcttgtcctgacttgatcccgctgcctttcaccatgaccgggtgcgaccctgcaggggtgtaatgctcggccccctgccttttctgggtggcaaatgatcagcaaagcatggcgaggcgtcgtattcttcatcgggggccaaggttgggcatgccgtggatgacagctgagtctctcaggagagcagattactcgtggcacccccttcagaggtcctggtgtgctgacctgatcnnnnnnnnnncgagtctctcaggagagcaggctactcgtggcaccctcttcagaggtcctggtgtgctgacctgatctcaggatgttcctggtcctggggctgctcctcccccggctccccctccccccccacttgctgctgctgctgctgctgccgggccctcagcaccggcaggtccatctcgtctgcgcacagctctccataccagtccatggccgcaccccacacctcctcgctcaggtagtctcgccgccggatgcactggatggtgagctgccctgccgcgtcgactgctgtggtccctgccgcgctcccaaaccctgcacatgagaggatggggtattgggaacaggtgtcatcgtgctgggctggtcggcggtggagcacacacgagaggcatggtgctgcgcggcccctgaacgcggagtgtgcctgaccctccccacagaaagcccagctgctgatctttgtgccctctggcaggnnnnnnnnnntgagaggcatgccgctgcgcagcccctgaacgcggagtgtgcctggcccctcccacaggaatctcagctgctgatctttgtgccctctggcaggagcgatgcacgtggtgggcgccccatcacgtgcaggcattcgcccccttccaccctcccatcggcgtcgctcgcgagcac

SEQ ID NO: 36117 - DNA, 61 bp, Chlorella protothecoides
agcatgggatcgctggtgtggaggcgatgcaagcacagtcattgcccaggctgttgctctg

SEQ ID NO: 36118 - DNA, 104 bp, Chlorella protothecoides
acatcatactaccagtcatgcaacacatatccatgcactgatgaggtttatggcacgtcgcatcgggagcagctcccgtgctgccgcgaggaggcaggtgccgg

SEQ ID NO: 36119 - DNA, 61 bp, Chlorella protothecoides
agcttattctgccacagattctacataatcatgtgagtacgctcagagcgaagggtgcagc

SEQ ID NO: 36120 - DNA, 69 bp, Chlorella protothecoides
cattgcatgccagcggagctggccgtcatcccagggccgcagcgtgccgcggcagccgagaggcgcacc

SEQ ID NO: 36121 - DNA, 64 bp, Chlorella protothecoides
ccgctctgctcatgcatgtgatccctgctcagcccatgcacgccctgtccctgcccctcccagg

SEQ ID NO: 36122 - DNA, 731 bp, Chlorella protothecoides
  modified_base (358)..(394): a, c, t, g, unknown or other
  modified_base (602)..(659): a, c, t, g, unknown or other
ccccccccctgcacagattctgaagaagcatcacaagcggacgggcctcctgctgcgggcgccccacctgaccaacatgctgggccagcctttctgctccgtggaggtgggcaatgcctacttctgatgccgatggggaggggggaaggttgggtggggtgctgggagggtggcagggcccactgcagccagccctgcctactgcttaacctgctggtcatggtcccccttgccgcgctccgcctgtgtccgacggtaccacctgggactgtggcgcctggagcgaatcaagtgccgccctgcaccttcagagcatgatcacccctccttcacccccccccccacccccacccacacnnnnnnnnnnnnnnnnnnnnnnnnnnnnnnnnnnnnnccacacacacacactgctaggtcacggtgctcatggtgagcagcgccgagcagctggtgagctctctggcgcgggtgctgggggaggccgagggcgccaccagcgtggccgacgccgaggttcatcacggctccagcctgtcggccgacagccacgtgtgcggcagcagcgcgggcggccttgcggcgcccggcgacggcccgggctnnnnnnnnnnnnnnnnnnnnnnnnnnnnnnnnnnnnnnnnnnnnnnnnnnnnnnnnnngcacaagcggcggcgcgagcccgcgcgcatgggggagggcgccatgagcgaggggtcggcgggggggggcgc

SEQ ID NO: 36123 - DNA, 70 bp, Chlorella protothecoides
gtacttatgggtgtgtttcagatatgcaggcggcaggagggggtcagatctgtcgagttgaggtgtcgga

SEQ ID NO: 36124 - DNA, 72 bp, Chlorella protothecoides
ttgatcaagtgcaaccagaattgctttggatgatcccacaacatcccgttgcgccacgatccctcgcttcga

SEQ ID NO: 36125 - DNA, 17134 bp, Chlorella protothecoides
  modified_base (669)..(678): a, c, t, g, unknown or other
  modified_base (1618)..(1627): a, c, t, g, unknown or other
  modified_base (2231)..(2240): a, c, t, g, unknown or other
  modified_base (2530)..(2539): a, c, t, g, unknown or other
  modified_base (3462)..(3471): a, c, t, g, unknown or other
  modified_base (3711)..(3720): a, c, t, g, unknown or other
  modified_base (4096)..(4105): a, c, t, g, unknown or other
  modified_base (4411)..(4467): a, c, t, g, unknown or other
  modified_base (4913)..(4922): a, c, t, g, unknown or other
  modified_base (6262)..(6271): a, c, t, g, unknown or other
  modified_base (6977)..(6986): a, c, t, g, unknown or other
  modified_base (7326)..(7335): a, c, t, g, unknown or other
  modified_base (7941)..(7950): a, c, t, g, unknown or other
  modified_base (9877)..(9886): a, c, t, g, unknown or other
  modified_base (10316)..(10325): a, c, t, g, unknown or other
  modified_base (16728)..(16737): a, c, t, g, unknown or other
gcaggtccacgcgcagcgcggcgcccagcacgcccagcgccgcggcctggcgcgcgcccggcgccgcgtcggcgcgcgcacccagcagcagggcgccggcgggggaggggggctgggagggcggcgggcacgaggccgggaaggggaccgcgaggacaaaggggtcggccacatccaccactggcaagccggccctgggagggggggggcagaggcttgctttcggcaggggtgggcgaggaagggcgcgagggttgcgccaagcaccctttggtggatgaaggggcggcatgccgcggtacggtgccaggcacgggcccaagcaggtcggcggcccctaaggtacaccacagcacccatgcccgccaaggctacccctcacccccctcaccccccgatcgatagatgctcactttttactgacgaggatggggcgacgttgctggatggccatccatgccagtgtttcgtcggggctgtacagcccgagctggggcaggccaggctgcaaaaagttgccgtaggtgactagtacaggggagtcgtccccgcgcggctgcatgagcagcgcgatactggaggggagggaaaaggaattagatgaggctcggcatgaaggtcaggccagccgaacgagcgggtgtcgcatggaaccccggcgcaggatannnnnnnnnntggaaaaggatttaaatgaggctcggcatgaaggtcaggccagcccaacgagagggtgtcgcatggaaccccggcgcaggatagagtgccacccacaaggtagtcactcccgacactgccggagcagcgaggatccatactgaccggagggacagggcttcgggcagggctttgatgacttcatctcttgtactcgcaaggatctcgttctgtgtaaagcaggtgcacagcgccgcggccaggagattcggggaggaccccacctggggctccgttctcaccatgggcggtctgggaggagtgtgctcctctcttacttacattagaagtgtctttaacacaccgcccgcttgggattgggcgcaggtgctgccccctggccccgtctgtgactcatgaagggtacaggggctcgcgagacaaggaggactcgtatgtgaacacatgatttgtccccggctcctccaccgagctgtgctgtggagtctgggcggcgatttggccctcctgccacgacaccttcggccctttggactggaggtataccggggtgagaagagccaatatgccgttcacacgctacgttgagattgggcgcgtggccctcatcaactacggcccggagtatggcaagctggtggtcatcagcgacgtggtagaccagaacagggtgcgttgggggacaagaggcaggagaagggagtggacatattggcgcgggttaaggggtgctcaggagctggactgcggtgtggagaggcgcgtggcgggctcatggccgtagcatgggcgtctgccttgggcccctgcggacaggactggattcgccgaggccagacttttacctctccaagtagaatagctaggagtcacggcctcttgtggcccacaatgtggcatttcgggccacccgaggtcatggtgccggtgcggtggtggnnnnnnnnnntggctcatggccggagcatgggcgtgtgccttggacccctgcggacaggactggatcgccgaggccagacttttacctctccaagcagaatagctaggaattacggcttcttgtggctcacaatgtggcattctgggcctcccgaggtcatggtgccggtgcggtggtggctgcgcccccgaccccctcactcccccctaccgacacaggcactggtcgaccggccggacgagatccgccgcgtcgtcaacttcaagcgcctggtgctgaccgacttcaagatcgacatcccccgcctggccaagaagtccgtgctgaccaaggccctggaggaggccgatgtctttgccaagttcagcaacagcagctggggcaggaagatcgccaagcgcgaggccaaggccaacctgaccgacttcgagcgccacaccgcgctggtcgcaaaggtgacccgcagcaagaaggtgagcgcggcggcaggtggcaggggatggcgtgggtgggcctgggcagtatgccacggcctggcttatggcgtcagattgatcgagggaatgatcctcgccagggagatctgctggggtctgttgaatgaatctatcannnnnnnnnnagggcagtatgccaaggcctggcttgtggcgtcagattgatcgagggaatgatccacaccagggaggtctgctggggtctgttgaatgaatctatcaacagttgacagctgtgagggcagttggaaggttcgttttgatgcctgtcctccccttgtccgccattgtgggtgtccacaccacctctgcatggcgtggctgtggcacaccgtcggtcagttcagtatgctccaggcccacaccaccggtgctcacccgttccccttgttccccttccatcacaggtgcgcannnnnnnnnntgtgcctgtcctcccccctgtccgccgttgtgggtgtccacaccacctctgcatggagtggctgtggcacaccgacggtcaattcagtatgctccaggcccacaccaccgatgctcacccgttcccttgttccccttccatcacaggtgcgcaccgcctttaacgccctgaagaaggctgccaagaactgagcctgtggctgtgctcttccccccgccgcccccttctctgtaaagcctgtccaatctccgtcactgctcgaggtccaggcagggtttgtacacgctctggtgtgctgtgggcgcagggtgttctcacgggctgtcgcatcactcattcctgctcacagcctggcgtgcgctgggcagctgtatggagcatggggtgtgggtcggtgcaggttctccaccaacccccacaccctcgcccctgtcacggctggggcgaagagacacgcccctctcccctcgggcgtcactcggcgtcgtgcaaccgtgtgggcccctggcccaggagggagtcccccaggacccacccctgcgcctccgcctgccgctggaagtcagggaaggcggcctgcatggcccgcaggccggcggcctcgccctcccccgggtgcgcctccagccaggccgcctgccacagcgcgcgcagcgcgtcgtgcgcccctgcgcgctgcctgagcaccacccagcaccgccccgagtgacgggtgagcaggtaggcctctgccgagtaggtcgcgcagagggccgccaggtcgcgcccggcccccgccgcgagcgcctcgcccagcgtgcagcccagcgcgacgtcgcccggcggcagcgccagcgcgctctcccctcgattcacctcgcggacggcgggcacgcgccctgcgcggatgtgtgcggcgaccagcgctgcggcgcgcttcctgnnnnnnnnnntggcgggcacacgcccctcgcaaatgtgcgcggcgaccagcgctgcggcgcgcttcctgttgggccaagggaaggccaggcgggagagggccgcggcgcgcagcgtgacgtgcgcagcctggatgccggcccaggccagcaccacaccgggcgtggcgtgcgcgctttccagagcgcgcagcagggctacgctggcgccgaggcccacgagctgggcgcccacgccccagacctcctccnnnnnnnnnnacccaggccagcacgacaccgggcgtggcgtgcgcgctttccagggcgcgcagcagggccacgctggcgcccaggcccaccagctgggcgcccacgccccagacctcctcccgcgcggacacgtcgcccacgttgttcttggccgcgaagtgggtctgatggagggcgagggggggcgggggtggggcatgggtgacgaggggtcggaggaagaaggtgtgggggtgacgagctggtgcgacaaggccagggagagtgtgcgaggaaaacgggggcccgatcgagcacagggagaacgggcagtaagacgcatgccagggtccctgggctgccacattcacccgacaacctccctcgcctgtatcacgcggaagcnnnnnnnnnntgacaagctggtgcgacaaggccggggagagtgtgcgaggaaaaggggggcccgatcgggcacagggagaacgggcaccaagacgcgtgccagggtcccccggctcacccgccaacctccctcgcctgtatcacgcggaagcaggggtggcccaggccatggcccacggccgtcgccaggttgccaccgccagccagcagcacaaagtggcctgtggagttggggggaattagggggagacggggctgcagcatctcgcccagcagtgactcgagggggcggaatgagggacggcagggccccccnnnnnnnnnnnnnnnnnnnnnnnnnnnnnnnnnnnnnnnnnnnnnnnnnnnnnnnnncccctccagcaaacccccccctttgggctcgtgtcaccctgccaaatggtgcacaccctcactccccacccaccagggtaggcctgtgtcgcaatctccagggccaggcccagcgtggtcaccgcctcggccgccaggcgccaccgccgtgggtcctcgtcgaacacggaggcgaagcgggcgctgacggcgaagcggcccagcgccccgatgccgtccttgctgatccactttattgcggcggaggcccccgcggcgcccccgggccccgcatcgatgcccacggcctgtgggcttggtggaacggtggtcagcgttgagagggagaaggggtggaggtggtcacccctgcaaagaaaactgggcactcaggcgcccaagtggactgagcgcacggtgcactagggcagcggggcaccacccgcatggctcccgacctggagcannnnnnnnnncaggggactgagcgcacggtgcactagggcagtgggccaccacccgcatggctcccgacctggagcatgctggtggtggccagggcatgtgacatgacgcccgtcacatgcgtgggcagggtccacagctggtactccaggtagtcgggggtgacgctgtctggccagtccttgggaaggaagagacccgcgaggaaggagcgggccgggccgaggggccccgccgactcccctgaccatgcctccttctggccggtgcccaggcccggctcgcccacctccctcacctccccatcctcgcccacgcccaggcgctgaatgcgctgggggcccacctcaatgaagctgagggtgctgggagcagattggggggtgggaggggaggaggtggcaccggcgcggagggaggggaaccgcagcttgtgcccatgcaccgccgtgggcccctcaggccggagatcatgcccggcgaatgcccgcctcgaggggggtccggtctgcatgagactaaatattgtgcattgtgaaaggcgtgggggcctgagtcgacatcaatctgcccgcagggtgtcatgcatgagaatgtatcggagaatcgggcatgaggctccattttacagtgtgcctgcgtgctcagattcccagcatctgccgcatcagaatctttctcagcccgctcagtggcaacgagttatcttcatgtggcgggccagaccacacatctgcattcccagacgtaccctctgttcaaaaatagcactggcgctgtcattttgcccagtgagaaacccctgctcctcaacaaccactgccagggtgcagcccgtgctgcatggggtcatcctgcatcaggcatttctagagcctcttcaagccgtccgcttggtcgtttaatgtttgaaaggtagcagagccgatacatagagactttgggagggactgtcaacatgcaaattgcaatgattcaccgcctggcggcagcataaccaggccccattgccgcaaccctcgctgccactgccgccgcccgcgcctgcgccgccgccagagcttcctctgtcgacggcctggaggcacccaggttgggttgactcgcactcttcacaaagtctatgcggcccgtggcctgcctctgagccgcccttcgctgctcctcagctgctgcggcggcccgttgggcttcgaggtagtcgtcggggtgcagggctgacgggtccaggacctgcatgggaagaggggcacttcgtgaggctttggacatgcagcccgattggtgtcaggatgggtgtgcatcctacacagtggacaaagcgtggcccacgagcctggtctacacttannnnnnnnnntgtgaggctttggaaatacagcctgattggtgtcaggatgggtgtgcatcatacactgtggacacagcgtggcccacgagcctggtctacacttatgcaccatctgcaaaagcgtccgcatatggtctccccttgcccttcccctgtcccttcctgaagaagcaataatgacatggacagtggccaagcatcgtcagcccttcacacctctggtgcaaagcaggtgccatactgctggatgtcatagtgctcgatcatcttgcggaaaaactcaggattgcggtagcccctgcacagtgcttacgaccagcgtaatggtcaagggtgccacacatatggtggacgattcgcactgtagagctgcacccccctcgtcatacatacatgcggggtcaaggctttgcacgctcagatgaggagcttcccctcatgaagccgcaaatgccacctcatctcaaacacctgcttttccgaatctcttcagtcacgctccgcccctgagtttcctggatgtggatccaggtggcaatcttcctttgcagctcgacgctcggctcgcctggaggggcggctcgcagctccgggggaaggctgctgctcaggccttcggtttcttcgagatcagggccagatgcagcgccattactcctctcagccgctctgccctgcgccatataggtttctgggggctcttcgccctcctcgnnnnnnnnnnccgcatctctgggggaaggctgctgctcaggccttcgggtaatatgggatcagggccagatgcagcgccatcactcctctcagccgctctgccctgagccatgtaggtttctgggggctcttcgccctcctcggtctccattggatcgttggaggattgagtgcgttcctgtggggttgcttggtgcccgcctcctgcacgcgcgccgtccactgagctccctgggggatggcacggtgtgtgcagggactctgaaggtccatgaccatggggcctccaacaccggctccagggagcaatgcctaccaaaccttgccaccatggcaccagcacactgcannnnnnnnnnagtgtgtgcagggactctgaaggtctatgaccatgaggcctccaacaccggctccagggagcagtgcacaccacaccttgccaccatggcaccagcacactgcattgcacgtcaggaacaaccagacttaccgtgggatggggaccgactatcctcatcgctgtctgcgtaggcaccaagcagtccacctagctccgacatcctcgcgcgtccgagagaaaagtcgaagcgggcactggtgcgaggacagaacaggaaagggagtggttgtctctacttcttactagacgtgtctgtgcctgcagccaaggctctgcagaaggatctgcgtcaaggcgcgagctctgagtttgcgcgccctgagaggagcccgggggcacacatatcaagatgcgcttcgtgaagacgagcttgcgctaacgacttcgcaaaatagtcttgagtctcacattacaatgaatctgttatgagtcgtggcaagcgggagaggttggatcttggacgaggtcgaggcgccagttccccaggtacaggtcctcctcagtttttggttcagtttttgattcgcacgcatgcggatgagagaactttctcactcattctgcnnnnnnnnnnggtttttgtttcagtttttaattcgcacgcatacggatgagagaactttctcactcattctgcagctccagatgtctccgatgataatcctctggcctcggcaatggcggggtacgcttcggaggaggaggaagcgccatgcaacctagacgctgaggtcacccagtttgtcaccaagctgcatgctgacggccttctgccggccggtgagcttccatctggactcctaccgctgggggaccaaggctacactgcatcggcacgaggcacgcaatccttgccaagacaacagcccactgcagaagagctggatgggttctctcacatacccaccgcatgcattgaggcatccggcgcctacttggaacagatccccaaggtgagctggctcgattgcgagatgggttttagctctgagcctggctccccactgtgtccagacagtggtctgccaacccatgcgcgcacccccaacgggcagcaatccacccccatgcaatattgctttgccaactgatggcatcttaacaccagcaaacggtgcctctccctctcaacggcaggtgtgtcgcctggccattgagagccagaccctgtcggccctgcttgccctttttgcgaggctggagcaggaggcacccgggacggtcggctggcgagcggtggccggcgtgctgacccaagccctccatgaagtggagaagcagacggcagaagccgcagacgagcttcgcgctgcgagtctcgacgaaatgacacttgctgtccctgccaaaggcattccacgggagcagagcctgccatctgttttgtccacgggtgcgatggcggagggatcgccagcccctccatcccaatctgtgccgccagcggtggcggatgaggctgatgacatggacctagagtcgtcctccactgaagggggagaggatggggaggtgccgcccctgccaccaggtgtgagagaggttgaggaggggatgcacttgggcaataagggactcaatcttcatgtcaaagccgggcagggtacacacaagacaggacaacagtacttttagagagccaggatatgaactggactctgcaaaagcggcctcctcgctatgcgcacgcagggtatgaattgcgatatcagttagggcattgagctgccaatccagacagagaacaccgggatcaccattcctatcaccttcttcccgccctgcagccccccagatagactacgagctgtttgggctgccaaaacccccagaaccagcggccccagaatcaaagacagggagtgccccccatcccagatctgagggcaaagagaggaagcggaggaaggggaatgcggtgcccgtcgccgcgacctccaagctcaggcactcggcccagctggccaaatggcaggctgtgcagcagtctgccatgcaggcggaggaggcggcggcgggggcgagggacagcgaggcgcagcgtgcacagcaggccgaggagtggcggctgagccagctgcgcagcggggcctccgacggcaacgccaactttgcggtgagtggaaagcggcgccctgtctgctgctgtgtatttggtgtgggagttggggccctgcggacgggcgtggcactctgtcattgtggtgggactgcctgcgtgggggtttggagggggtcccaatgcctctcccagcatcgccatctgctcccggccccaatctgggattctgtctgggaacggaccctccacatccctgcacagccggtggtgggcgactggcggagcagactcacggcaagaaagaagaaggaggaaagagcagagaagagggcacgcagagctgcgtcgagggaagatcacgtggaagagggtgctccaccaagcctcccccccggctggcaagcggtggcggaccccagcactggagccacctactatnnnnnnnnnngcggcaagaagaaagaaggaggaaagagctgagaagagggcgcgcagagctgcgtcgagggaggatcacgtggaagagggtgctccgccaagcctccccccgggctggcaagcggtagcggaccccagcactggagccacctactatgccaacttggagacacgggtgagggttgaggttgggggttggcaatctgaggatcctcttccccatgctgaagctggacaccctgcaggagagggggtagtgaccccagacaagtgtagggtggctcggggtgctgtgtggcgtctgggcatgggaggtgacctatggaagtgcccatgtcgactagagtgccgtacttgactaccagcgccggagtcactcggactggggaatcatttggaagtgtgctgagctgcgactggcttctctggcaactcactgnnnnnnnnnntttgactaccagcgccggagtcacccggactggggaatcattaagaagtgtgctgggctgcgactggcttctctggcaactcactgtgctcctccatgtgctttgcatccggaatcaccttgagccggccagacctctggctgcatcccgttgccatcacatatcttgcagcagcagggacctctgggtggcctcgcatgggcatgtgagaacaagcatgggcatgggctcagttgctcctatcctttcacaatcccccctattctgcaggaaacgcagtggacagcgccagagggctgagagctggtcgaaaacctccctggtagacagtgttatggctggtgaagtcgctgtaagattccagctccatcgagcatgctcatgtgcaaccagtgcaagcccaagaccagaccgtcaaggtggtgggcggctgcccgcacggcatcccagggttactggtgttcgctcgaatggaaggaacaggccgtgcctcctggcaagacagtgcccctctgccagccgtcagctcagcagcagggctgcctcccccggtcgcagcgtctcgcggggcagatgaggtaccaggtgccgggcgccggtgagaaggcgcaggcgctccgccgccacggccgccgcctcgcgcttggccctgcgggcggcctcctctgcggcagccaggtcctctgcctgcacgggattagggtgacgagggagttagatcttgacgcctatgctgtggcaagccctcatgtctggggcataggagccggcgggtgcctgatctgggcagcgacatgtctcgcgatcctcccaggcaatccccacctgcgtcgctcggcccccgccgcgccgggtcgccaggacggagccgacctgccgcgtgcgctccacctccctctggcgccgctccgcctgtgccgccttttccaccttctcctcctctgcgagtggtttaggaagtgggcctggggcatgaagcgtgtagagcaggggcgctcccacttgctgcaacaggaatttgcaacccaccgcgtgctgcatcggtctgggcactgcacaacctggtgcatcgcagctggctcagcattcgaaccccgctggtcaagcgccccaccccaggcctcaccggccaggcgctcgatgaggcggtccgcgtactcgcgctcctcccgctcgcgggccgcgctggcagcgcgggcctcctcgctgatcgcctggttggccgcgctcgccgccgcggcggccgccgccctcgcctgtctctcccgctcctcgcgctgcgccgcccgggccgctacgcgctccgcgtgcagcgcggccagcgcggcctcgtgcgcctcttttgcgcgctgggcacgctgtgctgccgccgacagctcggccacggcgctggggaaggggtgggccacgaggtgcgtcgggcaagggtggtgaccccacatgtcagcaggccaatagacagccgtgataccatgaagcagccctgcgcttcccacgcccacgcatatagtacactgaagaacccgggcacgagacccatggcgcacctatcgtgctggcgggcatgacccgcccttgctgccgcctcctgctcgtgagcatcgcggcgcagctggatgtatgccaatgcctttctttcctcctccgcctccagctggcagcgtctgggaggcaaagcatgggtggttggaggggtgtgtcgcctgcctggggattatgggacttgcatacacagcccatgtgacgctgtcgatgcacagtggggcagctgcgcaagccttccctcgccaccaagcacggccaagattgcatccaccacgcaccgctgcgactcggcggcggcctgggacacgctttcggccgctgcttgctggctggcagcccgacgcgcctgctgagcatcccgggcggctgccttggcctcctctgcctcgcgcaggaccctggcaagcagcgcggcatcctgcgccttctcctcctgggaaggaacggaaatcgaatgggtgagagggcctcagagactgccatttcaccatcatttccaatatccaataacacgcgtaaagccaagcactggatgccagccatgcagcatgtacagtgctgggcagctgctatagtaaatgaactcggacgggtcaagacctctgccccacacactagtctgcagtaaatgcccttacacaaagatcttggggtcaaccgctcacggcttagaaaatcccaacccacctcggcaatgcgtcgcaaattctgctggtgaagctccaaggaccttcgtgcctgctccgcctctaaagcttttgttgcctctttggctgccgcagcctcgcgagcaagacgcgcggcttgcagttgagcggctgctgcttcagctgcagccgccgctttagcttcctgctcctgcttgctcagggtgctcttctcctggagctgctgagcccgtacccagttcacctgggcgcaaggatggagaatcatattacaactctcctgtgcaggcatacaatgtttgtgagcgacgcccatgcatatggttttgggggaattgagctcttggcgtcgcaggggcgcacgccaataggggtcgccctgcctgctttacagagcttcaaccatgaatcaggcccaaaaaccctactcaaacccatcccacgcacctctgctgccatgagcttggagcgaaggtccctcaactcgatgctctgagccaacagcatggccctctgggatgcagccagatgtaactttcgcttctcatccttgtcttcagagtcagactggctgacgggctgaggagcttccaagtctaagagatctttctcacccgaggcatgggcagccattcgctccaccagcttgttctccagccgggcgttctcagtcttgagcttattggcctctacataccgactgagctcccgcctgtatctctcctgtttgaggaccatcctggctcttggctgttgaacctgcaggtcgaggcgatctcgacctaaaacgatattcgaactggggtctgcaaagcaagtgctgcccttgaagagtttcgtggacacagactacgctgacgcagtgccggacatgcgaggagtgttgactcctcgagcgtcggccgcttgcaatggacggtaagtatacctattgtgagatttgtctcatgttgtatcaccagaccgggtgtgtgtttggggtactgggtacttcttggtctgtggttgaatatatgaacatcgcgcccaatcggttctcgaggggacacgcatgaattataacacagcggatctgcggaaggctcagagtccttgcaacgcgttaatccaagcgtgtataggataaatcaattcacatattccgtgctcgctgatgttgacctgctgatatccggtctctgaggatggttacggggggggagtatggcgcagggtacgcgagccggtaagtcagtagcagtgaatggaataacatccttccctagtagtacattgaagtgttattatccgtcgatacccctccctccaacaggccgggcttgacagctcgacaaccattgtttggcgccccatcagaccaagtccaggtttcggttgagccctcgctggattgggacgatgagattgagcagcttagagcaggggtgggacgtttgaaacaggtgaggacctgcttgtgtcgtttgggagccgctttgtgttggtttgagcagacaccaatctctgtgcatagtgtctcgacttcccatatgggcgcacaacatgctcccaggtgtcatctgcgattcaagaggaaaacacgctcacaaaacaagtcatggatggactagtgagctggtgctatggagagggaatgaggagaccagggtcatgtgcagatatatgccagtcagctgctgtattcatagtaaagcagtgaaaaagtaagccctctccgcctagttattgggcaccaagatatcaaacagctcatatgtcctcctcatcttgcaggaaagtgccatggagacatcacggcaatccctgaaacaggcatccaaaaggctaagaagagctatggtccagagtcaatccaaccatgtcctgtatgtttttcttttcgcaatcgcagtattctttgccctctacttctggaacaagctttacaagctgttgaggtggattttgtaagctatcagtcaccgactaaagagaaggagtttcaaagtgatcgtggcatgccatgggcctgactgtgagagagacccctggctctatagtgccacctggaaacgtcaagaggctcctcctgcaataagaatcggtaaatatcactgaactattctgtggcaagctccaagaggcttgtaaactggcaaatggggtgactggaaagaccaatgcagcaagctctctcaagagtttctgccctgccccccgagccccctgatctgccacgtagggagcgccaaagcgatcgtttcgacggagggacctaagcatgcgccgttcagcacagtcgatggctttcagtcaggacctaattatcttgcgcgaccctcctcgagtcaagtctggcctttggtaaaggcgaggcgcatggaacatcaccacccatcccctctgtgagcgacagcacagacttctccgccaccgctccatcgtaacgtgaacagaagctgggtaagggccttggagaagaggagactcggccaggatgaggagtgagtgacgtggtgggttgccgtccgacatcatcccccgaaagcactcgtgttccccgcctgcaccacaccccctcaaccccggccgcccctcctcccagtcctcatcaagggaggtgtgtggaagaacacagaggatgagatcctcaaggccgcggtcatgaagtatggcctaaaccagtgggcccgcatctcgtcactgctcacccggaagtcggccaagcagtgcaaggccaggtggtacgagtggctggaccccgccatcaagaagacggaatggacgcgggaggaggacgagaagctgctgcacctggccaagctcatgcctacgcagtggcgcaccatagcccccatcgtgggcaggacgccggtgcagtgcctggagcgatacgagaagctcctgtacgttgctcgattttgctatgagctgctttccttttagggggagggggtttgagccgacagggtctctgttggaattggtctggctgatgcaatggggctcaggaagagccctgcagcttcatgaactgattgacgggtgaaagctggccgctgatacatggtgtcagcagcaacttgatcttgaaaaccttcacttttggcttgatttactcaccgtacctttacccaccctgccttgccagggacatggcggctgggaaggagacgtacgaccccacggacgacccccggcgcctccgccccggcgagatcgatcctaacccggagtcaaagcctgcccgccccgaccccatcgacatggacgaggacgagaaggagatgctgtcggaggcgcgggccaggtgcgtgcttggcctctggccccacgtcgcgtgttgggaatgagggcggcgtagatagcagcgtttgacgggagagccaatgaagcccccactctggtgttagcccttgttccgcagcttgccgacggggttccgacacactgcgtcgttctcaatgctgctggaatgatgtatttgggggggggtcggccatttatggtccacagcacccgtcacattctctcccaccatggacatacagattagcaaataccaaggggaagaaggcaaagcgcaaagcgcgcgagaagcagctggaggaggcgcggcgcctggcaacgctgcagaagaagcgcgaactcaaggtggggggcgttgtctcctgtgggccgaagaggcggtggaggcgctctatgcctggtctttgctgctgggtttaacaacaggaagagactcgctcaggctgcaaatcccctccctcaataccacatctccaggctgccggcattgaggtgcgggagcggacgcggcgcgggggcgccatcgactactccaaggaggtgccctttgagcggcgagccgccgccggcttcttcgacacgcgcggtgaggacctgcaaagaggagaacctgggagacctgggcagggagatgacgccggagaggtcgcactgcagcctggctgtcggggcttggctttgaatgcagggggcggctcagtcgcaggcactgtacagcaaaggcgtgcaccagccggctcgtccgcggttcccaccgtggcccacctgttccgcatgaacacctacggtgtgcgcacccctctgccgtgcgaatgtgtttccttcagtaagccaaaccctccccctggaacacccacccgttcccccgcaaaaacctcccctttctgcgcagaggaggcgannnnnnnnnnctcagcaagccccaccctcccccttgaatacccacccgttcccccgcacaaacctcccctttctgcgcagaggaggcgacgcggacctcggaaatgcaggaggacttccggcccatcacagtggacgagctggaggggcgcaagcgcaaggacatcgagaaggagctgatcaaggccgacctggccaaggcgcgtgtggccgagcgcgccaacgccccggcggccctggcgcgcgcgctggcggccaacgaggcctccgcgggcccggttcggcgcgggaagctcatgctccccgcgccggccgtgaccgacgaggagctggaggcgctggcgcgcggcgggtacgccgcggccgaccgcgacgctgacgtggcggcgggcggcagcgccgccacgc

SEQ ID NO: 36126 - DNA, 61 bp, Chlorella protothecoides
gcccaacactggcgctcccaggcttcccacacctgccccgggccgcaatcagcaacagcag

SEQ ID NO: 36127 - DNA, 61 bp, Chlorella protothecoides
ttcacgatggggacacatgccaacaactccccctccgtaacacactcggggagatcgcgcg

SEQ ID NO: 36128 - DNA, 386 bp, Chlorella protothecoides
  modified_base (83)..(323): a, c, t, g, unknown or other
cgacgcgatcagcattgtgcgacggcgggcaaggaatctgttggcccgagaccctgtcccaagggtgcatgcaccggcacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacaggcatgccaccacgattaggatggtgctcaaccgggagtccgccatggcgtgcacgct

SEQ ID NO: 36129 - DNA, 61 bp, Chlorella protothecoides
tcccctgccaggctccagttggaggcggggtcggggtccgcagcgtccactttccgcgtgc

SEQ ID NO: 36130 - DNA, 65 bp, Chlorella protothecoides
cacggtgagcggcgtggaggaagttcttttacttcgggtgtgtgtgtgtgtgtgtgtgtgtgtgt

SEQ ID NO: 36131 - DNA, 122 bp, Chlorella protothecoides
atggcatctgcactgtcaactgtcgtgaggtacacatgggctcctagactgcggggggtcgcaccaagtgcgaaaagttgggaatgcgtgaggaacagaccagagatcataggccgacacga

SEQ ID NO: 36132 - DNA, 167 bp, Chlorella protothecoides
catgcagcagcacctctgaaagaggaaaggcggaaaggtgatcaggatttggttcgtttgttcctaccgtgaggaggtgaagtggcacgcagcacgctcgagggttgggcagccgcctcaagcacacatcccagtccgaagggagcaccccacccaccccgccacct

SEQ ID NO: 36133 - DNA, 74 bp, Chlorella protothecoides
ggggggggtgtgggggggggggggggggggaccaaagtggagggcgcggagcacaggtcggtgctacagagcac

SEQ ID NO: 36134 - DNA, 79 bp, Chlorella protothecoides
tggccgactgcggcccatttccctctttttccacacagagcccagatccttacctctcgcgcctgttccctgctcctaa

SEQ ID NO: 36135 - DNA, 109 bp, Chlorella protothecoides
tggagatcttttccagccgagtccacgagtatccctgcttgggcttgtccatcaggacaaggtccagggatcgtcgcctccgccccgcagaccacccggcatcaccctc

SEQ ID NO: 36136 - DNA, 114 bp, Chlorella protothecoides
agattcgtcccgctccctggagccgcgaatctccagtcttgggaacagatggccagtgcgtcgttctttgcagggcgttggggatgcctgggatctttatatttcgaatcccct

SEQ ID NO: 36137 - DNA, 61 bp, Chlorella protothecoides
ggggcctgaccccggtggcggcattctttctttcttcttttttcaaacgcggcgcaggagc

SEQ ID NO: 36138 - DNA, 7912 bp, Chlorella protothecoides
  modified_base (906)..(915): a, c, t, g, unknown or other
  modified_base (996)..(1005): a, c, t, g, unknown or other
  modified_base (1843)..(1852): a, c, t, g, unknown or other
  modified_base (2156)..(2165): a, c, t, g, unknown or other
  modified_base (2358)..(2367): a, c, t, g, unknown or other
  modified_base (3061)..(3070): a, c, t, g, unknown or other
  modified_base (3153)..(3162): a, c, t, g, unknown or other
  modified_base (4076)..(4085): a, c, t, g, unknown or other
  modified_base (4879)..(4888): a, c, t, g, unknown or other
tggtctgggatgcatcatcatttggaagcgacatattgcagcgtgtaatgcatcgctcaacatgaacgccgacccaatccatcaccatatcccaggagactgaggatggggaagattacacaaccgcctgcaaggccagcacataatagaatggagtgcgcatcgctgatcaggaagcacgttgaagcctgtcggtttcggtttggcacgggtgaggtctgtacatgggtttgtcatgtcagcagtagcagggaatgccccaggcctgaccatttgccagctgtgagtatgtaggcgggcttgaagcggtctgaaggagaggagtgggagggggaggaaaggtgagcgcgctgtctcaccagcggagagggctgtgccagcgatgggccagggtgatcaccctgttcctgatgcaacgcccaggagcactgcctgcaagccatgtagctcctagggccatgcaccagggcagcgcctcaccttggtgtactgcccgtcgttgcaggtctgggggtaggggctgacgcagcagctgtccctgacggggccgaagcacgcgaagggctggaaggtgatgacggagggcatgggggtaaaggcggagcccgtggatgcgccggccatgccgctggcggacgcggcgccgttgccactggcagacgcgccggcgttgctgccggccgacccccccgagctgggggtgctgccctgggagccggtggtcacggtggcggtggcagaggtgtccgcagacgctgcacgtgtgtggttcggggggtggggaagagcttgctgcagctcaggaatcgcccaaagctgggtgtatgaatagacaagaatttcagccctcggcagaacaaccgcaggtcgtgccatgcataccacgatgctacatgacgcgcaccnnnnnnnnnnatgcatgccacgatgctacatgacacgcacctgtgcagccggagacggtcgccagggcctttgccagggcagtggcggtgnnnnnnnnnngttgctgcagctcagaaatcgcccgaagccgggtgtgtgaatagacaagaaggtcagccctcggcagaacaaccgcaggccgtgccgtgcataccacgatgctacatgacgcgcacctgtgcagccggagacggtggccagggcctttgccagggcagtggcggtgacggacgcctgggtggatggggggttatgggcagagggttggaagaaaagtgtggatgaccaaacgccagcctgtaactgtgtgcaagcagtggtgtcgcaatcacagggcccctcctgtccaagatgcaccagttgagcacttcatgatctggcagtccccgacctcatatgcttcccaaaagacaatatccgcaatccaacccccacaccccttcacacgcaccacagcctccgagacagccgaggcctggctggtgccaccgttgctggcggatgcggaagagtcagacaccgccttggcgatggcgctcttggtctcggtggcgatggactgcgccgcggccttcacagcgctactgccgccgcagcatgatgcctgggcgacggctgaggccatggcggtggcgacggcctcagcgatggcggtggctgtaatgggaaaggcatggtggggtttggagtgagtggttgagttagtgtcgggactgggcagcaccggtcacaggaacatggctcacatcactgtgatcatccaagaatacagccacacagaggggcaaagatcacccattgcgcacctgtggccgtggcagaggcagacgcgctgctaccctgtccagaggtgatcgccgaagcagaggtggaggcaacggccttggcactcgcctgnnnnnnnnnngcaatatatggtggtggagtgatggtgtccttcttcaaatgggcaccaccatcacctctgtcattcgcaagttgaattcggcgcatgagccctcgcgctcaggccatgcatctctttcggcagcatggtagctcatattcagatggagtaattccttggcgccctgtccctgtggcattccctttccaattttaatgatacctcctcagacattcccgagtcttgggtgctttcatctcccattctgcaagtttgacagcaacgtgaaatgaataccatgtgtggtcatcttggtgattgttcnnnnnnnnnnagtcgtgggtgcttccatctcccattttgcaagtttgacagcaacgtgaaatgagtaccatgtgtggtcatcttggtgattgttcagttcaactgcagcgtagttggcggcctggggagccactgtggtatgcttgcagagtgacagcctcccctagtgtcctcatagcaagctgagctagcagcagtgctgnnnnnnnnnngttgcagagtgacagcctcccctagaggcgtcatagcaagctgagctagcagcagtgctggttgtgtacaagagcaatgaaaggtagctattagtagcaatggctttgagtggaccaccggtacacccacgagtggcttgcggaggacgccatgctgtgctttcatgctgtccaagaaactggataacacagaccccgaatgcgggagaggaccgacgtaccacaccgcaggggcccacagaggtccttcatctccagtattgaagcatcgacatatagattcgtcggtagagtccctaccacggcaaggaaatccacctctgtcgcgcgacaatggccggactggtacagcaggtgccctccgtgaggatgcggagcctctccttcaggtcgaacgtcagccagtcccaagtacaaatgcagtcggtgaggcgaggccggtgggaatagagactcaggaaggaggaccggtgtcagtgcctgccgataagcagcgaagcagtgccacgcctggcctacctcgcaggtcgccgcgccgcggttggctagagctgcagcagccccattgatcatcgaaaacagagtcgcggtatggcacatgggctgcgcccgtacctctaggcttggacgtgatttctcagaggttgggtgcctcatccgtcttactagccagtcattggtcctgtttctcctnnnnnnnnnngcatctgggtttggttttgttgttgtgggtgcaagctgcctcatactcacgggcacctcatgtcttgtgcccatgcttatttnnnnnnnnnncacctccatgcttgggcatgatttctcagaggttgggtgcctcatccctcctactagccagtcattggtcctgtttctcctgcacacagatccgtttcactcggatggggcggaagaaattgccgttctaccgtatcattgctattgacagccgtacacggcgtgatggacggcctctggaggtaatcatctgagtttgattttgttgttttgggtgaaagctgcctcatactcacgagcacctcatgtcttgtgcccatgcttatttgggatgtggatggcgggttgtctcccctgccagtgctgccccgagtgggtggcggcgacatatctcctacactcccaaaacacattgctcctcctccttccaccctccttccctcagttcctgggatggtacaaccctttgagcaaggagaccagcctgaacgccccgtctatcaagaagtggctggaggtgggcgcgcaacccagcgataccgtggcagcactgctcaagaaggccatggtgctggactcataattgcacgaatggacttggggagagggcggagcgcaagccgcgtgtctacttggagtgtaggtccatctctatggcggcctcactacaagggttccccctcacatggacccatccgggaacgcatccagcgctttcttgtccccttccacaaagtacttcagtgctgccttcatccgctccgtcttctccggatggtagttcatgtgcatctgtaaagcaagaagtttgggcgcaatattcgcttggatggggctgggaaatgtcctctacgacgagtataacatcatgggagttcccaatcaggaactccatctcagtgcaagtagcaatgccaggtcctgcgcagcttctccccacatcgcactgccacatggcaaatgtgctggccccnnnnnnnnnnggtagcaatgccagatcctgtgcagcttctccccacattgcactgccacatggcaaatgtgctggcccccactgacagcctcccttctcgacctccttgactcaccatgacggggagtttctgctggtccagtggcagcttccgcacatacttgaacagcgtcttggagttgatgaagaggtagatgtccatcaccctcacgctaacttggggagaggtgtactcgccgtgcgccagattgaagatctcttggttgtacacgctctggtcccactgccgctcggtgttgacgcgcttggcaatgcgctgcatcaggcggatggtgcgggcgttggccttcaaccagaacaggctggggagggatggttttggagcggggaggtggttgagtaataggagatgggtgtgtgggctggagcgcttcagctgtactgtggctgttgatgccagggcaggactaccgcgaggccaaataaagctctggagaaagacaccatgtgcacaaacaatgtataatgtgtgcactgccggcaagcaggcaggggcaatgcatggaaattcgatgtcatgtggtgatttttgggagccacttgtagtggactgagacagcatgcacaccacaaccacctgacaagccttgtgccttgccctgctcacccagaattaagagccatgtgcttgtggccctgcgcataccgtgaccagcccatagaagcatcatccacctgtgcggaaagggtggaagcccattacctttgttccttgatatgcatcctcagctcaccagctgaatnnnnnnnnnncggaagcccattgcctttgtaccctgatatgcatcctcagctcaccagctgaatgataggaaatctggcgcagggccaggggcagtgacatgtgaagactcacccccctcccggttacccttctcaccccatagatctcgccgtaggcggtgctcgcatcgtagccgtcactcatgccctccacatccgagtcgcggaccaagaagtcaaaggggttctggaccgtgatgatgtccacatcgctgtgtcaagaaggaatgaagcgcaggttgggggtacaggagccagctcatgtttgggagcgcacaccaaccctgcgatatagctcgagtatgccatcgcaggcggacaataaagcaaacagccagtccatgcacggacagcaaaaggagtctcctcagacactatgtctattcaagtggtgggcgatcgcaatggacctcaaataacgctaccagcacatcctcttattattatccccgccagcccgacaggcactagtttaccgcactcaacccacttgcactttgcggccagaacagtacctgagcagtacatcccatcccagctgcaaaaactcctcaagaatctcgaacttcatcgcagagatggcatggttgtccccggtattggcctgcgtccccggaatctgccaagcgaaagaggcatgactggggtttctgtgctgtcctgaaatcaaggtgcatattgtggtatcatgcacctcaggcatctggtaactacccgaataagctgcagtgtgacaaaattccgtccccagagcgatcccacaacccaggggatacaatccgagcaagtgcccctcgcgctcaccaccacaggtcggtagtaatgattgatccccttctccttgcaataatcccggagctgctcatctattgccaccaccatccagttcttgaatgggaggcgttgtaggctctgtgagtggtggatgaggatgtgaagagggagccgaatgttggtgtcttgtcgggtgcacgggttgcaaggagccagccggccagacgccgtcaacctcactgcaatctcagcagcctgctccactcacctggatccaaagcgtcagagactcgctgtgaatcaggttcatgttggagatggcgatcatgacctctccagtgggagccacctcgcgcagcaccctctccagctcattggctggcttggagcccaggctgcgagccactcttgagcgcatcaaaccgcccgttgccaccgcaccaccatggttgtacagatacacgcgctcagcacccatgaatccgaggcaaatgcctgcgaagagcgccaccgtcagcagggcagagcgggaccggacgtccgacgctttgtgcttgccctgagagtcgtcctccatggtacacagtatgctgggcggaagaggacgactaactcaggtttaaggatgagctttgcaaaacaaaacgcctggaagagagcggagaatagaccaaggccaccccttgccgagtgtatcggcttggaaattcgggcaccctctcaactggagcagacgaaatgtatcgcgagattcaaccgtcatgagcttagcggccgtcaggacgggcagtggttgcaagcatcgcagaggcgagatgcagcacccttcccccccggcgatggtaaagcatgcgcgcgcgaagttcgtcctacgagagggcgcccaggcatcacgccacggatcgcaacgacaaggcagggctcgatcccgaaacatagcagtatgcactcgatggagatcggaaggcgtgaaaggctggacaacgctctgctaacctgcagtgtccttgaggtcagggtatgagcaccccgattcaagagaaccccagcaagcaaaaggtgcggggcctgcggatggtaaatgcacgcagtaccccactggaatgagaaatcacgtggggcatgagggatcaatcttggttcaggaccccactctcaaacccatcacctccagggtgagcagggttgtgagagggaccggttgaagttcgtggcccggggctgcctggaggagagcggctgggtcgacgtcgtccaggagctttgtcgcggtgagcggaaggtggttcacagacccatcgggcatggtgaccagcgctgccatgtcagtttcaagacacgaggtgccatggatcacctgcctctcgggacaccgcctcctcccctcccccaccccaatcccggcagcccacctgcgcaccgacccctcctttccgcttgggagcctcgcggaggccgtgcgccctgcagcccgcgccgcggtccccgatcacgtcaaggccacggtgctgaaggtcgtgcgtgccagcatctgccccaccgacgactcctagccccagcgacaaaccgcttctcctcggtccatctgcacggggaggtccagcgtgcagctggtgcacctcgtggccgcaacacgcccctgggttcacggagcgtccccccacccgggcccttcaacatgcacgtggtgctggaggaccagggcgtcagctgggtgccagctgacggccagcaggtgctcctggatgcgggggctggctgcctgcacaccgtggaggggcggctggtggcctccatccggctccccggggcgcaccccgacgtctccggcgccccggccacggccagccccgtgtcgacctccacctcccctgaccggccgggcggtcgggcctggtccccgcctgggggctcccccccgccgtcccagagcccccggactggcgcgaggggcccgcccgccgcacacacgcgcgcgctgtcgcgcgaggacagcctggccagcagcgccacgctgcgcacgggtctggtgtcggcgggcccccccgtgcgcggcatgctggcctcgctggacgggacgctgagcgcactgaggcgcggcgggcgccagctggagatcatcgaccacaccacgggtaacatgtttgtggaggcgccgggggccagcagccgtgggcagcagcaggggtgagcgggctgtggggtggggggtggggggtg

SEQ ID NO: 36139 - DNA, 67 bp, Chlorella protothecoides
cctctttgagccggagtcggcggtggaccggttgtgactcacaggatgtccagcaacttgcggtgta

SEQ ID NO: 36140 - DNA, 77 bp, Chlorella protothecoides
agaagctggagaaggttcctccgctcccgcagatcctgggtgagggagggccagcgatggcctagtggccagaatgt

SEQ ID NO: 36141 - DNA, 897 bp, Chlorella protothecoides
  modified_base (98)..(261): a, c, t, g, unknown or other
  modified_base (424)..(467): a, c, t, g, unknown or other
  modified_base (778)..(787): a, c, t, g, unknown or other
gccgtgggagggcgaggcggccgacgagccgtggatcgcctgcgacgcctgcgacgactggttccatggcgactgcgtgtcgctgtccgcggaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcggcgggtcagggcgtgtcggcggcggccgcgcccacgccacacggcgggaccggcagcctgaagcggcgggaggcgccggtgtccccgggaggggaggtcgtcaagcggcccaggggccggccccccaaggcgcggggtgacgcggcgggggggggcnnnnnnnnnnnnnnnnnnnnnnnnnnnnnnnnnnnnnnnnnnnngcgcgtcggcgccggtcccgatgcagggagctgcccctgatctggccccggtcatcaccggcgcccaggctgttacgcaggcggctcccgtcacaacctcgagaaaggcatcgggaagcgcgcttcacgaacctgaccctgctgtcgtcccggcagtcgagcaggcgcagggtcggcgccggggacaggtcgcagcaccaccggcgacagaggcggcggggcccgagatctcttgccccgtctgccgcctgccggactatggcaggcccctgctgggctgcgatgcctgccagatgtggttccactacgannnnnnnnnncgcgcaggcggctcccgtcataacctcgagaaaggcatcgggaagcgcgttgcgcgaacctgaccctgctgtcgtctcgacagtcgagcaggcgcagggtcggcgccggg

SEQ ID NO: 36142 - DNA, 66 bp, Chlorella protothecoides
gcgctgcgcgctcctgacgagtgtgtcctttattcgcccccccgcgaatcagggacctgctcatgc

SEQ ID NO: 36143 - DNA, 63 bp, Chlorella protothecoides
cctcaggtcggccgcgcagctgctgcagcccgcgatccacccagacaggtcctccatcctgga

SEQ ID NO: 36144 - DNA, 61 bp, Chlorella protothecoides
tgccacccacaacatcatggcgagtggctgggacgctagatctttgcttgatgcttcatga

SEQ ID NO: 36145 - DNA, 71 bp, Chlorella protothecoides
ctgaggcaatcatcctccccgccctcaacacccccccataaaaaaatcacctgcagcgcggcctccgtgca

SEQ ID NO: 36146 - DNA, 72 bp, Chlorella protothecoides
gagaatgacagagccagccagcgggaggggtagatgggccaaacgagcctccgcaccaagaagaccggctgc

SEQ ID NO: 36147 - DNA, 82 bp, Chlorella protothecoides
ctcatagagagcagctgccgcacaatttatggctatcgttccccaatttgaaccattgtacaaggatcgaggtgcttgacca

SEQ ID NO: 36148 - DNA, 129 bp, Chlorella protothecoides
gccgtctcggccgatgcaccagaattcaccccgccaggtccctgccccggctgcagtgacgcaggcgccgatcgactcatgcctccggagcccaccaggccctcccagaagtcgtcggtctctgcagga

SEQ ID NO: 36149 - DNA, 119 bp, Chlorella protothecoides
gggtgcagcagggggaggagcgccgtgctctccacgccgtacaccttgtgccctggtggagtaagggggggatgtggggggggggtgttgcctcctgggggcgctgtgctggggatgtc

SEQ ID NO: 36150 - DNA, 9970 bp, Chlorella protothecoides
  modified_base (668)..(677): a, c, t, g, unknown or other
  modified_base (921)..(930): a, c, t, g, unknown or other
  modified_base (1724)..(1733): a, c, t, g, unknown or other
  modified_base (1898)..(1907): a, c, t, g, unknown or other
  modified_base (2115)..(2124): a, c, t, g, unknown or other
  modified_base (2705)..(2714): a, c, t, g, unknown or other
  modified_base (3222)..(3231): a, c, t, g, unknown or other
  modified_base (3613)..(3622): a, c, t, g, unknown or other
  modified_base (3857)..(3866): a, c, t, g, unknown or other
  modified_base (6279)..(6288): a, c, t, g, unknown or other
  modified_base (6596)..(6605): a, c, t, g, unknown or other
  modified_base (6665)..(6674): a, c, t, g, unknown or other
  modified_base (6756)..(6765): a, c, t, g, unknown or other
  modified_base (8096)..(8105): a, c, t, g, unknown or other
  modified_base (8244)..(8253): a, c, t, g, unknown or other
  modified_base (8611)..(8620): a, c, t, g, unknown or other
  modified_base (9563)..(9572): a, c, t, g, unknown or other
cgcggcggccgcggcggcgcctgccgccgcgcgcaccgccccccagtccagtccggccgggcccgccctgccctgcaccggcagcagggtggccgccatgcgggcggccaggcgcgccgcctccgcctgccgcgccggcttggcaaagacgccgcggtcgcaggcggacagcaggagggcctgcacatcggcgactcggtcccccagcacgccggccacgccggcctgccccgtccccagcgccagctgcgtcagcgccaccgcctcggcgcgcacgaactcgctgcgcgcgccgctgcagccccggagcagacccgggagcagatgcggggccagagtgggcacgcgccccagcaggttggcaaagaaagcgcggtccagccgcgtccgcctgctggccagcacgtcccgggctgccgcctgcgccgactccagcgccgcgaccgcccgcgcgccgtcgccgacgctgtgctggcccgcggcggcgcgctgcaggaagatgtacacggcgcgcgccgcgctttccaccacggggtcggcgctgcgggaggcgaggtacagcgacctcttgagcgccgccgccaggtcctctggctcgaaggccgacacgcctggagagcgagggaggtggggtttggggggaggggagagtgggattatgtcggtgnnnnnnnnnntgccgctgccaggtcctcaggctcgaaggctgacacgcctggagagccagggaggggtttgggggaggggagagtgggattatgtcggtgcaccaatgctgggagggctgggagaagcggcggcttgtttgccatctccggctgcgcccacctcccgcatctgcaatgaatgcgcccatcgacagatactctgaaacaggggtgctgcgccggcacaactccttaccggctgccccaggcttgnnnnnnnnnngggcttgtttgccatctccggctgcgccctcctcccgcatctgcaatggatgcgcccatcgacagatactctgaacaggggtgctgcgccgtcacaactccttaccggctgccccaggcttggtcttcaccagcttggagttgatgaggccggccagtctctgggacaggacttgggacccactgggcttggccgccacagccagggcgttcagcatgggcaccgcggcagtgggcaccagcggcgacgcaggtgactgcgcaggggtgccaggaggagaaccgaggtcaggatgtggcgacacaggagccacgtccctgggagcctgcctgaccagtgaacggcctgttccaccttccccgtctccctagacaccaaacccatcctggacaacaaagggaggatgcctgtcaccgcaccctcttcaggaagtactccaacagcgtgacgacccgaagcttgaactggtccagctgctctgcagctgccttggcgttcccccccttgccgttctttatcgtggcaaagtaggctgccagcttggcgtccatgcggaacatctcggcgtcagtcgcgcccagcccgtcgtcactgtcgttgccctgtccgctgggagaggcagcgcctgcttgtgatggaggaagttgttggtgaggggaaggggctgccaactgggcggtgatgccttgcgcgcaagccatgagaggtgcgtggaatcgctgcgccagtgggaatgaggaacccccaatcccaaacaccgtcaccaatgctcaccggcttcggcatcaacttcnnnnnnnnnnccgctgcgccagtgggaatgaggaaccgacaatccaacacaccgtctccaatgctcaccggcttcggcatcaacttcttcatcagagctggaggcggcctcggcctcactctcctcgcccccctcttcggcctcactcccctcctcctcctcctcctcctcctcnnnnnnnnnncctcgtcgtcctcctgttcgctcccctctccctcacccagcacctcctccgggccgcccgccaagctggccagcacacgcaacaggtcttgcaggcctgggaagaaggggggtacgagcttgagcagccgcctcgcacaggaggtggccgaccacgacagggactctgcccttgccccggccaggcaccagcaacgtccatggtctcnnnnnnnnnntccacgcacaggaggtggccgatcacggtagggactctgcacttgcctcggccaggcaccagcaacgtccatggtctccacaccagtggctcacacagacacaccccttccctccctgcaccatcccccaacccacctgtggtcgtcaggtctgtggcaaagacgcggaagacggactcggcggcgttgcgcagcggcgcggagggcagcggcgagcacggtcgggccagcaggctcagcaccacgtccaccagcgtgtcgtgccaggcgggggctgcgtcgccgttgaccccggctcggggcccgtcaacctcggcgccggcctggcacagcgccctgtccaccacgtcggccaggtccggcccaaccccggggtcgaccacgctggggtccgcccactcgtacaactgcaggagcaatgccaggtgcgtcagcgccgccacgcgaccccgcccgcccgcgtcggccgacgccgcggccctggacaacgcctcgcgcaggggccgcgtggaggaaagcgcgcccgcacccaccgacgccaggcgcgcacggccggagctcagcgccccctccacccaggnnnnnnnnnntggccctggacagcgcctcgcgcaggggctgcgtggaggaaagcgcgcccgcacccacgcgcgccaggcgcgcgtggccggagctcagcgccccctccacccaggccaccaggtcggcgagaggggggctgggcgccgcggaccccggcgcgacggggcgcttggccaggaagtcggccagcgcgatcaggcgggcggcggccaggggccgcagggctgcacccctggcgccggccgccctcagggtctgcatggtggggtcctccatgccgggcttcgcagcggccttggcctgggatagggtggggagtgtgagactcggtgaggtgggcggacttgcgcagcagatgtttccatccccgtcagcggcgcctgagaggtgtgtcatgcctcctccctgcgcctcgccttccggacgggggtcgagactcggcacgacctccaacacctccctcaccctgctgccacgtgtgggctggggcgtcggggcctcctggccaggctccannnnnnnnnntcgcctcgccttccggaccggggtcgagactcggcccgacccccaaaccttccctcaccctgctaccacgtgtgggccggggcgtcggggcctcctggccaggctccaggaaagccagggcagccagcagcctgaagactgcctgccgcgactcctccgtcgcgctctcctgcttcaccgccgcccacagcgactccagggccgccgtggcggcggctggggcctcgaggggaggagccccctcctccccggcctcctcgtcatcgagggtcagggcgccgcatgcgctggagatgacagccacctgccgctccaccagctcagcgagcttggcggcatccagactctgtcgggggttgagcgtggccgcggtaagcggagnnnnnnnnnnaagctgggcggcgtccagactctgttgggggttgagcgtggccgcggtaagcggaggaaagggtgcggtttgggagatcggccctttccagctccgctgagggcccaggcagtgccatggagggggtagaaggcagacctgcccctgcatcatacatcctccctgctgtccagtcccctccagcaatcaccatctccatgctgagggacccatgcacattcacagtcctcaaccnnnnnnnnnnaccctgctgtcgagtcccctccagcaatccccatctccttgctgggggacccatgcacattcacagtcctcaacctgcactcaagccccgaacaccaaaccttcccccccacactcgccccacctgcaccccagtgatggcattggccttgccgcccggcgcggcggcgccggcgctcttggcgccggccctcaccctgtcccagagcgacccgcccgcccgctggagcgccagggagacggccagcgcgagatccgcgtcgtcgccggagagcgcggcgacgagcgcgagctcgcacctgtgcgcggaggcgtgcaggtaggccttgcgctgcgagacgttggtggaaaggaagcgcaggaagggtggtgacagcacggtggccacgttgtccgccctgtgcatgtttttggtgagttggtgggggggcactgagtggtgtgtagtgcactgggaaggaggacagtggggaggaaggcttcttgagcatgcaatttggaagaagtgtaccaggatacagcatggactatgtactgggacggatgagtggtgcagccaactcctccgggcttggatccaggatgccgcccggctgccagcccaacacgggccccccgtcgcagctcacgtgaggtggggcaggaggcgcaggaagagggtgatggagaggtacttgcgagcatgggagcccgaccccaccagctccggctccacgacccgcatccagagggcctccagcgcagcgtcggcgatcacagacccctcccccgggcacaggaaggccaacagggtcgtccacaggctgtgcagcgcggggtggttggccgtggtgaaggtgagcaggggaaccagcgtggtgaggtgcggcgcggcgaagaaagcggcgctcgcggcggctgtggcggcgcccgtctggtaaccgggggcggggcgcggggcgccggagggcagcagggggctggcttcgacgacggcggcgggcaggatcggccacagacccagggcaatcaccagcatctgtgaggaggggtggtggaacatcgggggtgggcaagagaggaagggatcacggggctggactgtactcgattcatttctcggccgccagaggacagacaaagtttggacgagtgccatgctccccaggcatatgcaaccccagcctattcaccacaagccatcacctctggggtggattggtcgatggacgcactcagggcggcagacagcggggcgcaggccgagagcagtgccgacacgctctcctccgtctccgacgcaacgaggtcgaggatgacggtggctgcacaggcacagggggaatgggtgaacagcagcacacagggattccagtgtcccattctggcatgtggtcttctgcttccccacataaacagccttttgattggaagcgctcgcatagctggcctcgcacctgcggcctcgcggaggaaggatttgagcacccccgcatccagcagctggtcgatcatctccgctttgcacgctgtgctggcgggaacgcgagcctgaacaatggctccaatgccaaaggtgcgccccagaaggtagtcccgcgtctcggcgccctggcgaagtagatggaaagaagcatgaccgcttgtaaaacctccaacctgaccaactataaattccactgcatggcatgtttgtcggccatcatccactccgctcaccttggaggcagagggcgcctccagataggaggccaggaggagcacagcatcatctgcagtcatgcccggcagcctcttcagcaggagggtcagggcaagggcaaagccctggcgggcgcccgcattgcccgaggccagaccctttaccaaccgcttcagcgtgtagccctgcatggaaggtaggcgacaggctgtcgttgagcaccgcgagatgcaggggagcggcgaggagacagggtccagcatccggcatacaatattgcattcatcctcctccatccatccgcatcatctcaccgtggtgggggagtaggcagccaccactgcttcgccatcttcacgctttccagccttgggggcgctgctttgtgtcttgagcacggcgtccaccaggtctgagctagcccggaattgcacctcctgtattgaagaatggcaggggaacatgcacgggattttgcaagggagcgggagcacgttctagtccttgctggatccacaaagctctcttctcaccgcctccaaagacgccaggttccagaagtgcgcaagaatctgcacggacggtggtgggcagaggaatggcagggcaggtccccaacggtatgctgtgagcaaaacagagccaaatgcgtatgtagaaatggcaaatttgacctatatgctccattcactgtcatataacgtgcgattccaccccctcacgcgccttatcnnnnnnnnnncatgtagaagtgacaaaattgacctatatgctacaatcactgtcatatacagtgcgattccaccccctcacgcgccttatcatccttgtcgagcttcccgacctcctctcggtgggcaggcactgtggccgccatggcgagaagtcgagacctcacaatgttatatatatcggtgcttcaaatttactttctgaggtgttccgagggtggttctcgccgcatactcctgtagggagtgcccacagtgcgaccttcacaatgtcgcgcgcgcgcatgcacacaccagcctgctcgagtcccgccacccnnnnnnnnnngacagtgttatatatatcggtgcttcgactttactttctgaggtgttccgagggtggttnnnnnnnnnnttcaaggacatagtatttgagacctgctcagacgcatccttggctcctagcgcccctcgcatggtcatgattcaggacgagnnnnnnnnnnacgaagtgtcgcgggctcgtcccgagcagtcgtgccatcagggaagtccacatggctaagttctcaaggccacgatattcgagacctgatcagacgcattcttggttcctagtgcccctcgcatggtcatgattcaggacgaggagtctgtgacggtgtcatgctccgaccacccaccacaagcctggtactcggagccatgcatgctagggataggtaagcgactgggtgggtatgtttcacacagctgctatggatgtcttcctgtcagccgtctgtaccagcattttaagtcctgcctatccccatggtcggatcccctccactccctgcgtccctgcagacgaggccggtaggggcccggtgctcggcccaatggtgtacgctgccgccttctgtccctgctccacggacctcacctcaaagtagggccgcgcagggaagcgcaacgcctgcgcgcaggagctgctcgatggaggccagcttgactgtggacattccttcgcacctgggaatgcgggtgccgcccatatcagcgccgtgcgaagttgaccacccagaacgtccagcggcggcaccctcaaaaatccactttcccccctcacccactgcagggcctttgccgacagcaagactctgaccgaggctcggcgggaggcactcctggcccagctccaggcggacccggggatcgggttccgcgccgagtccctcagcgcggcgttcatctccgggcgcatgctggcgcgggaccggcacagcctgaacgagctggccaacgacagcaccacccgcctgatagccggcgtggtggcggccggtgtcaacctgacgcacgcctacatcgacaccgtgggagatgcagacaagcacagggtgagtgacgctcagtgggaggggtggctgcgactgtgcctgggagcggggttttggtcggtgccagccccttggcccctcctgccctgcttctgcctgtcccccaacccacacactctccctcaccccccttgcaacacacagtcccggctgctggcccagttccccgccatacacttcactgtgtgccccaaggcggactcgctctaccccatcgtgtctgccgcgagcatcgtggccaaggtgaccagggaccgccagctcagcgcatacacctgcccggagggcccctccagcagggaccgggagtacggctgtgggtaccccggtgaggtggggtgattgaggggggccacagctgccgcgacacagcctgctgccctcagtgtgggggacatattacagcacatgtggctgagcggggaggtgcaaacctctgccctgcgaggcaccannnnnnnnnnaaggggtggctgtgactgtgcctgggagcagggttttggtcggtgccggccccctggcccctcctgccctgcttctgcctgttccccatcccccacactctccctcacccccccttgcaacacacagtcccggctgctnnnnnnnnnntcgcgaactacagaggaacaatacctgcccattcactctcctcccctcctcccccccccctcaaaaggcgacgccgtcaccaagtcctggctagagagcaatcttcaccgcgtcttcggcttccccagccttgtccgcttcagctgggccacctgtacgcccctgctggaggccgcggcggtgcccgtggcctgggagtgcgaggcggacgacggcgccgagggccagcagacgctgggctggcgggcaggcgccaaacgcaaggccgcgggcccacgccacgccttctttcacatgcgcaggctggcgctggtgggcggcaagaactttgtgcggggcgcgagcctgcacgcctgannnnnnnnnnccacatgcgcaggctggcgccggtgggcggcgggacgtttgtgcggggcgcgagcctgcacgcctgagatgccgctggggggagacactcggctgtgcgggactgtccagattgtacacacccgggaagttctctgaccttttacatcacggcagcagagcaattgccagggggcctaggcaggacgacgctcggatcacacagccaggctgggtccaggggcggccacacgggctcgtcaagggatgacagggtgccgtgcctctgagcgacagcgcacaaccctcaggggagacgagtcgccacgatgctcggcactcgcttcgctcccccccccgcctcgggacccccacctcccgacagcacggtgtcaccccccccccacccctagccggcatgcgagaattgggtgtgggagggcacgtccgcccccgcggccgagctccgtggcagcagctcgcactggccgtagtgctgcagcagggcgtcggccaggaccagggccaccatggcctccaccatgggcacggcgcgggggacgacgcaggggtcgtgccggccccgcgccgccagctggatgtcctccccgctgcggttcacggtgtcctggcgcgcggtgatggtggccgtgggcttgaaggccaggcgcaggaccacgtcctcgccgttgctgatgccgccctgcacgccgccggagcggttggtgcgcgtgcgaacggagccgtcgggggccatgtagaaggcgtcgttgtgctcggagcccagcatgcgcgagccggagaagccgctcccgatctcaaagccctgggttgagcgggggttgagggggtggggggtggggtaggggccaggcgggagggtgaggctgcgaagcaaccggaggtgcatgatggcagggagtccgaggctgggagcaggcgacgcggggcgacgcgcctgggcnnnnnnnnnngctgcggagcaaccgaaggtgcatgatgccagggagtccgaggctggaagcaggcgacgcggggcgacgcgcctgggcgccgatgaacacaggtttgatggcaggagggcgcagtggacccctgccccgcgcggcaagggcgctgaagggcccatggccactggtcccatcggccccctgccccacaacttctaggatgcctgcatgcacccccccaccccccacccccttctcccactcctcccagccgcccctcgcgcgcaccttggaggcggggagcgacatgagcgccgccgccagctcagcctccagcttgccgaacaccggctggcccaggcccttggggcagcgccggaccacgcacgtgacctccccgccgcacgactcgccgcgtgtcc

SEQ ID NO: 36151 - DNA, 61 bp, Chlorella protothecoides
tccctccagacagaccctccgctccctccataaagaccctccgctccctccagacagaccc

SEQ ID NO: 36152 - DNA, 66 bp, Chlorella protothecoides
ggcggtggtgaggggcttggtggcgggggggaggggcttggggggggggggggggggggggggggg

SEQ ID NO: 36153 - DNA, 77 bp, Chlorella protothecoides
tagcgcgcgccccattgcttacgtcaccatttcaccacaagctggactttccccataactcttgatctatggcatct

SEQ ID NO: 36154 - DNA, 151 bp, Chlorella protothecoides
tgctgaagccaggctctgcgctggggtcgggtgccatgcccgcctgcgatcgaggcgaccctcatttccgggcacagggtgtccaaatcagcgagcgcagacgccatgacggcatctgccaccacagccacgttgcatgatgcttgcagca

SEQ ID NO: 36155 - DNA, 79 bp, Chlorella protothecoides
cgtggagcggctgtaggctggccggtccctcgcagatgggagctcattggccctagccagttgaagggctgctggggag

SEQ ID NO: 36156 - DNA, 61 bp, Chlorella protothecoides
acccaaattgccaccatacgacaatatgttctccatcgcatgctcgatccgggtgcaaccc

SEQ ID NO: 36157 - DNA, 74 bp, Chlorella protothecoides
gctgaattaactactccacaggcactgaagcgagtattttgtgtagcgtgatgggaaggcccctcccttgccta

SEQ ID NO: 36158 - DNA, 66 bp, Chlorella protothecoides
tgggagttggaacaacgccgcagggcaacaggggtttgggggggcagcctgcggagagtttccccc

SEQ ID NO: 36159 - DNA, 77 bp, Chlorella protothecoides
tgagtccaagcaacaggtgtgccatgccagggctcgttgcttacaccgcagttcaagcgctcagtcacagggcgggt

SEQ ID NO: 36160 - DNA, 61 bp, Chlorella protothecoides
ccacggcgctgcagtgggaacaggcgaggcaagcattgtggccatgccctctctcctcagg

SEQ ID NO: 36161 - DNA, 91 bp, Chlorella protothecoides
ggtgaactcactgctcccaatcctcgccttggctgtgagggcctggtgggggtggcgcgcgggctgggggacggctgcgccgacgcgagca

SEQ ID NO: 36162 - DNA, 116 bp, Chlorella protothecoides
gggtggcggcggcgatctcggcgtatcgacggcgcggcggcagggcggggccgcctcggatacccgacggcaacccgctggccgaggcgtggcgagaagattttggggcggggaag

SEQ ID NO: 36163 - DNA, 61 bp, Chlorella protothecoides
gccctcctcccgcgctgccctcagccactgcgcctgtggaggtgggggagggcaggaggaa

SEQ ID NO: 36164 - DNA, 71 bp, Chlorella protothecoides
cacggctatcgtgctgactcatgagcggaagggcagcatcacgtgcttcctcatgcaccgcacctggacca

SEQ ID NO: 36165 - DNA, 61 bp, Chlorella protothecoides
ggcctggagctgcacgtgaaggggagccagcggccgagacggtttgcctcttcttactcga

SEQ ID NO: 36166 - DNA, 164 bp, Chlorella protothecoides
cagcttggcatccgtcttgcagatgacaaaacgcacgagccgcttcggcgccgtagtcctgcgaggatttttttgccatggtcttacggatgtggagctggatcagcagcagtgtgaaggtcctgcgcgacgagtgtgccgcattcaccacccatatacagcac

SEQ ID NO: 36167 - DNA, 80 bp, Chlorella protothecoides
caacgaaatatccaccccatgcttcatcagacgcgggcggcatcaaacacataggcatggaggccccgcctgctccccag

SEQ ID NO: 36168 - DNA, 121 bp, Chlorella protothecoides
ttgcggggaacaggtgaccggtgagcggccgatcacgatcagcactggctcatgcaggcgcgagacgctgcagcctccccattgtgagggcagtagccgcttctcggccatcaaacgcacc

SEQ ID NO: 36169 - DNA, 75 bp, Chlorella protothecoides
atggggcgatgcatgcattcaaggtaaagtgttttgatgtcacgagagactctttggagggttggggtgcgattg

SEQ ID NO: 36170 - DNA, 71 bp, Chlorella protothecoides
aacagcagtccccgcaggacctggtgctgctgcaatcggaacgcctggaacgcccgctggcgccatggtgg

SEQ ID NO: 36171 - DNA, 76 bp, Chlorella protothecoides
ctgtaggtctgtggtgtcgtggagaacaaggggggagtcggatgaatgagatcaggtgatggtctgcgggtctccc

SEQ ID NO: 36172 - DNA, 2324 bp, Chlorella protothecoides
  modified_base (83)..(200): a, c, t, g, unknown or other
  modified_base (897)..(1097): a, c, t, g, unknown or other
cagccaatgcaacggcggcaccgatgcaaccctcagctacgcccatgcatacgtggctcgtccattgcagcgactggcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcaacaacacctttgaggactgtataatggagcgagtgtgagggtctctgcaatggcataatgcgcagcatggattcattcccaactcagatacgaagccatgcagcactgattcaacggcatcaccctattcccaccacaactgcatcactatgacctccacacctggggtgcttctccaagggtgatggcagcggtgtcacggtagcactcattgggcaattccagggagtccagggaaggcattgtcagggcatatgcatggctgcaccatgcgccctgctgcagagtccgccatgcgcggtgatcacacggcgcaagcgggcatgttttgcgcgactgcagcatccctcagggcaaaaagcgtcgccatcagctgctcaaatcctcctgctggtcggtgtcaggtgctccagcacctgctcagaggcagtgggctcacatcaccctccggcagcaagcgggatgctcaatgcggcccgtgcacagagcatgtacaagtataatgaagcgaggtaggctcatgataggagcagccacgatcctgccagcgcaggaacgcgggttgcccacacaaagggatggtcatgcgttcgaccatgtgtatcgttggactcgacaccctacacagatagagtgctatgataaggcagaaaccaaaagtaataatggcttcttgaccctgattggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcacattgcgtgacccaatctcgaggccatctcccctcgcctccgagggtgccgccacgaaccccgctggtgggaggagcactgatcactgatcatccacctctgatcggcatcactcggattctgaatgaccttgatcaggtttgcgcaccatcgcagaggatgtatcgatgtcattgtgcattgagcctcatgactctcctgcctccgcatcaaggtgctgaggagtctgtgcacagtggacgaggtcgtgacctatcacctgctcaaggggtagctgacaccttgcccagagtcatgaatcaacagtcatcctcacgcaaccctcttggctgatttccaatgcacctgaacatgcaaacgtcgagaactcactgcacccctccaatgctgtgcagcactgccaaacgtctgaggcagggacacttgccgggcgatacccctgtaatgccaacctgagcctcccaaggaatcacacagcgatgctgagaaccgagatcgatcctgttgggccagtcaccctgcccccgcctggtcccctgtcgaggacacagctccctacgttgagactggtctcgccgcacagagctgtgcacattgcagtcatccccacatcccgagtccctgatgtcatcctgggcgaggcgcgggcccacgccaccgccttcactggcaacaagcttggtccaaccaaggtgaggcagcagccaggtcggaaggcagggcgccagaggatcctcccgtcaccctagtgccgaccgccgccagccacccaactttgcagaaattcttagagcagatgcagtatcgatgtgtctatggcccgcgagccacgtctgaaaagggcgtgggctgtaagcgtgagggtacctgtcaccctgatcgaggagatgggctgaagcagggctgcaagacgtggttcatcgtcaaggttctgagacaggagcccagcacggtcgaggtccactttctggatgcgccgcataccggcaggcgagtgaaccccgagcttgaccgccacgtggagggctgtccctgggtgtccaagagggcacgccaggtggtcctggaccacttggccaaggaccccctcgcccagaccagcagcctggtgagactcgtgcagcaggacagcctgcagcaggcgggcttgcccctaggggcgcggctgatgggagttgaggccgacagactagagatggattatccagacctcttccgggac

SEQ ID NO: 36173 - DNA, 61 bp, Chlorella protothecoides
gcagggtttggtttggttgggggtttggggtaggtggaaggctgatggaccggggaccagg

SEQ ID NO: 36174 - DNA, 80 bp, Chlorella protothecoides
catgccatccctctccagctggccgtcacatgtccccctctcgagccccgtgaacacagccacgtacctgtgcatgccgt

SEQ ID NO: 36175 - DNA, 61 bp, Chlorella protothecoides
cctctcagactccttctgctctgccttttggctgcaggggccaagggaaattcggtgtgaa

SEQ ID NO: 36176 - DNA, 78 bp, Chlorella protothecoides
gcccaagggtgtcttgttagggagctcgcggagtcgtgctcaaatattgccccttttccaagcccagcgaagggcaga

SEQ ID NO: 36177 - DNA, 75 bp, Chlorella protothecoides
ctcgtgcctgtcctctgactcgtgcctgtaacatccatagcggatgcatggagcctggtccccagtcgcagcaca

SEQ ID NO: 36178 - DNA, 74 bp, Chlorella protothecoides
tgtgatatcgtctacctccacctgactccctctgcctcacctgttttcaacaggctgtgctcctcccccctgga

SEQ ID NO: 36179 - DNA, 77 bp, Chlorella protothecoides
gtgacgcacaattccaagtagccccactgcaatccgtttccacacgctgttctcaggttcaccgtcaacccctcccg

SEQ ID NO: 36180 - DNA, 695 bp, Chlorella protothecoides
  modified_base (339)..(348): a, c, t, g, unknown or other
  modified_base (584)..(593): a, c, t, g, unknown or other
cgacgaggccgcgctgccggggtccgaaggcgcggcggcggccccggccgccccaagcgccgacgacccggatgcgctgtaccgcgcctcggccgcgggcgtggccggcactttcctggtgctgatgaccaacctgagccacgccagcatggtggcggccagcccccacgccgccgcgctgctggcagtgagcctgcccggcctggagacgcaggaggagcacgtgtccggtggtggcgaggagatcgaggccgcggcgagcgtggcccagggcattgctgttcctggcgaggcaaccccgccgacgtcagcagccggcgacgccgacgcggggccgannnnnnnnnncgtccggtggcggcgaggagatccaggccgaggcgagcgtggctcgcgacagtgctgttcctggcgaggcaaccgcgccgacgacagcagccggcgacgccgacgcggggccgagcgtgggcacccccgcccagtctgcatcgacctccccaccacaggaaagcgccctggtcagcttcatgcgcggcgtgtgggcgcggctgctgggcgcgacgctgccactgtggcgcgacggnnnnnnnnnntgctggctgcgcaccccggcctggcggcccccgcggcggcggtgctgcgcaactgcggcgacgtggcggcggcgtccgcgctggctcgccagggcggcgacg

SEQ ID NO: 36181 - DNA, 61 bp, Chlorella protothecoides
catccgggctgcgggagaagctcgcccgggtgggggtgcaggtgcgcagggcccgggcgca

SEQ ID NO: 36182 - DNA, 158 bp, Chlorella protothecoides
ccactggatgcagggtgggtgcctgccactcggcgcgaatgctcttggaccacacggcgcgtgcctatccattagaatggcccaatactggtgaaggaacaattcttatctgcacgtccactcctccaccctcccgcagtgatggagaagtatgtgag

SEQ ID NO: 36183 - DNA, 160 bp, Chlorella protothecoides
cttgtaagagccgaggacatcacagggggcggcaactctcttccatattcagtactgtacacagcagatcctaggtcacgggaagtgctgtcatgcgtggaggcagtacgagtctggtccccctccaggcacagtgcggccacgactccagagcgagatc

SEQ ID NO: 36184 - DNA, 61 bp, Chlorella protothecoides
ccacagggtactgccgccagacagagccataaaaatatgacctccttcccatgtctggagg

SEQ ID NO: 36185 - DNA, 76 bp, Chlorella protothecoides
ttcacccctcaagcatacatatccacaacaacccctgcgccggccaacctggcgcagggcgtcaaactcggcgtcg

SEQ ID NO: 36186 - DNA, 85 bp, Chlorella protothecoides
gacacggtgagtggatgaagtgagaaaggcagggaggagcccgaggggtggctcacgggccgtcgccccgcttcctgccggctgc

SEQ ID NO: 36187 - DNA, 77 bp, Chlorella protothecoides
tctcctcctgcgatgggaagggccgcgaggtcgggaattgactcaccagaggctgaccgaggcgcacatgtgtgggc

SEQ ID NO: 36188 - DNA, 79 bp, Chlorella protothecoides
ggcgtttcggtatcagtctccggcctggactgaacccagagcaggacgcacaccaggtcctcacacctttgcagggaca

SEQ ID NO: 36189 - DNA, 123 bp, Chlorella protothecoides
tttgcgacctgaattgacgactcagggtttccaggcatgcacgtaggaggtaatatgggcgtaagatacggagtaagggcttggaggtgcgttagcgccaacagtgtagggccccaggcccgc

SEQ ID NO: 36190 - DNA, 69 bp, Chlorella protothecoides
cgctgcatcctccctctgctaaccatgatctctttcagcacaaacatgagacgacacagcaccaagacg

SEQ ID NO: 36191 - DNA, 100 bp, Chlorella protothecoides
cctctccaagaagcccaatgcgcagagggtggcaatccggcacggtacggttctcgtccaaaaactccacatcgaggcctcgaagcgagtgatgggtgtg

SEQ ID NO: 36192 - DNA, 76 bp, Chlorella protothecoides
atggtcgccgccgacagcgacgagcagcaccgcgttctggacgtgctccaggcggccctggtcaggtgcgcggagg

SEQ ID NO: 36193 - DNA, 79 bp, Chlorella protothecoides
tccaggcggccctggtcaggtgcgcggagggagaaagggggatgggggaggggtaagcaagtcggggcccgagggtggt

SEQ ID NO: 36194 - DNA, 61 bp, Chlorella protothecoides
gcgacgcacggcggcggggaggaccaggcgtcggtggccccctcccccctgggcgacgtga

SEQ ID NO: 36195 - DNA, 81 bp, Chlorella protothecoides
ggtgacccgggcaggccacgacatcgccccctcatacagcagtcccccccctgtacgccgcttgatcctctgtactctagt

SEQ ID NO: 36196 - DNA, 78 bp, Chlorella protothecoides
cactggagaactgacacgggtgaccaaaatccccagccccattcacgctttcctcacctccagcgtcagcgcccgggc

SEQ ID NO: 36197 - DNA, 100 bp, Chlorella protothecoides
ggccctggtgaagctgttgagataccgcaacgcaaaggtgagcaccaccggctcgttcatgtcgatcactgtctgctcctcggattgctgggggagagaa

SEQ ID NO: 36198 - DNA, 248 bp, Chlorella protothecoides
tgcgggttgggtcttgctgttgccgagcccttgctcatcctccctggcgaccgcccttcatccacatgctcacgacactctgggtgcagcactgcttcgtccccccgctcgacagcgccgcacactccaccctcccccccccgctcgccccctgcatcccagtggcgggttctcgttccccgaggagcccaggcacctggcctgcctccagcccctcgtccgcgcctgcctggagcaggacccgtcca

SEQ ID NO: 36199 - DNA, 75 bp, Chlorella protothecoides
aagcctccggagagggggcccccacaacagcagtgctgggtcacgtggagagctgcatgccgagctgcaccacaa

SEQ ID NO: 36200 - DNA, 75 bp, Chlorella protothecoides
gtgcatggatcctatcttcaatgctgggagagtcccatgctgaccccaaccatgggctgcctccatgagcgcctt

SEQ ID NO: 36201 - DNA, 77 bp, Chlorella protothecoides
ttggcactgcgccgtggattaggcttgccacagggccgtgccagctgcctcaaacgatacaactccccctgatgtcc

SEQ ID NO: 36202 - DNA, 72 bp, Chlorella protothecoides
gttggcggggagcgggtggggtgagagcggcgagcccaagcgtttgggtggatacaccttgatcacagctgc

SEQ ID NO: 36203 - DNA, 168 bp, Chlorella protothecoides
gactgccacgggtgcaaaggcagagacaagcggagggtgggatgtgctgcacttgaaaggaacaaaaggaaacatgcagaatcagggaggggtggatgatggagggaggaggcggcgtaccgaaatggtgtggcacgttgaaccagaggcaagtttcgagcgcgctac

SEQ ID NO: 36204 - DNA, 71 bp, Chlorella protothecoides
tccccctcctccacccagtccccctcctcctcccagtcctcctcctcctcccagtcctcctcctccaccta

SEQ ID NO: 36205 - DNA, 63 bp, Chlorella protothecoides
ccccccccccccccccccccccccgctcccacttgttataaaagctgcccatggcagtgaaca

SEQ ID NO: 36206 - DNA, 61 bp, Chlorella protothecoides
gtgtttcgaagaaagtcctgggtctcatccaatcccatgacgatctccaactgcaagtgag

SEQ ID NO: 36207 - DNA, 8855 bp, Chlorella protothecoides
  modified_base (191)..(200): a, c, t, g, unknown or other
  modified_base (273)..(282): a, c, t, g, unknown or other
  modified_base (530)..(539): a, c, t, g, unknown or other
  modified_base (1134)..(1143): a, c, t, g, unknown or other
  modified_base (2364)..(2373): a, c, t, g, unknown or other
  modified_base (2562)..(2578): a, c, t, g, unknown or other
  modified_base (3217)..(3226): a, c, t, g, unknown or other
  modified_base (3551)..(3560): a, c, t, g, unknown or other
  modified_base (4495)..(4504): a, c, t, g, unknown or other
  modified_base (4799)..(4808): a, c, t, g, unknown or other
  modified_base (5733)..(5742): a, c, t, g, unknown or other
  modified_base (6154)..(6163): a, c, t, g, unknown or other
  modified_base (8481)..(8490): a, c, t, g, unknown or other
  modified_base (8588)..(8613): a, c, t, g, unknown or other
cggggggtgcgcggcgcggcgcgacatccacaccgcgcccattttggttggcgcccgcctggcgcccaccgccgccggccttggccagtgcgacgggcggcggcccgcgccccgcggcgcgtccgttggcgcgcttgggtcgccgcgttgccctgcggtgtgcggagtggcgggggggggcgggggggggnnnnnnnnnnatgcagggcgacttgctcgctgcttgcgtcgttcacatggcgtggtggagggaaactggcacgcgccttcgcnnnnnnnnnngtgcagggcggcttgctcgctgctggtgtcgtgcacatggcatggtggagggaaactggcacgcgccttcgcaggtcaattacccgagatattcctggcagcccctgcaacctcccgcacccccgcccaacctcaccctgcaccaaaaaccgcacaggcatagcaacacatggcctcgcccctagggggccccccccccaaaaaaaaatagtctgtcgctcaccccgcggcatcgcccgcggcctcgnnnnnnnnnnaagatattcctggcggcccttgcaacctcccgcacccgtgcccaacctcaccctgcactaaaaatcgcacaggcatagcaatacatggcctcgccccaagggcccccccccaaaaaaatagtctgttgctcaccccgcggcatcgcccgcggcctcggtctccagctgcgcggcctgcgccgacaggatgtagtcgatttcgtcattgctcatggcctgctccgcgtcgcaggtggcgctgtccaggccccaggtgttgtcgccgcaggcccagtcatccgggatgtcggcgtcagagaggttgaaggggaccttgcgccacttctcgcacacgctgcactggatccacttctggaggtcccgcccgccgggcccctcggcctccggcccatgggagccgccgcgggcgaggtgcccgccctcatcctcactggcttgctcgctgcacgggcgattttgggtgggggcagggtctggggtgggcagttcaggatgtcaggaagacttctgggcccaaaagcttgacgacatagagcccagaatgcactccacaccaccatccccacacaccttgcaaagtcggccagggcacccnnnnnnnnnnaggcagggtctggggtgggcggttcaggacgtcaggaagacattggggcccaaaagcttgacgacacagagcccagaatgcactccacaccaccacgccaacacaccttgcaaagtcggccagggcacccagggcatccagggcgtcgatctctgcgtcctgttcctcggagttcatggttgcgagaggggggctcaggtgctgagggaccacatgtgcttggcctgggtggggaggggcatctggggtgaggagggtccgtgcatcaggagcgccctgggcgcgcgggagtggtcgaaacccatcggccgggcgatgtgccaccgggcagtggggaccggcattcagaagtgtgagggagaacggtacgattcatctcaaagcaggcagcgagtggggggagggtctggggcccgtgctccacgcgccatgccgttcgaacagaagtgtccaagcaggggcgctcagccccccgatcaagcccgaacgttccaccgaaaccaatgacgatgtaagctggcacgaatgaacccagccactgccccagaatccgcgcatcataccccgtcgtggagggataaaactctccgcaacccatgagaacgcacctgcgcgccagtcagcccggaaactagtaccggggtctccagcttggaacttccacaacacccgctgggcgtcaggggtcccaggcagcggtgaaaatactggaccacgatggcaacgcgcgaagctgcgtgcttcccactgcgcacggctctagggatacgccctccccgggtgagcagcgaaagtgatattcgttggtgaaatcttgctggtgatggcatagcgtcgaaaaacttgaccgcgagtttcgtggtctctgtggtaccctgccgtacaacgttcaggtcccatgctgacgcggacctccaccatcaagcatggcagacttgattcgctcgcgacctcgacctcttaaaagtgtgtaaatgcctcttttgaacttccttacacttggtacagcatctatctggcagcttaaagccctatgtgcttcattaatgtccattgccgtccctctgggataaagtcatagtcttgtcgtgtggcctactcaatcgtgatggcatcctgagcgcaagggcgagaggggtcttattccggcatgtgtgggtctgaagttctcatgaagttctcgatggtggatgctgtgcagactgccatgcccaatgcaannnnnnnnnnttgtgtgggtctgaaattctcatgaaattctcgatggtgaatgctgtgcagactgccatgcccaatgcaaggtcacagactttgggtcgccttctggccgacattcttccagcatgagcctcaccgcgagagcagcatactggaacaggaagtcctctttcagacggtagcaccagccgatatcatggnnnnnnnnnnnnnnnnncaggtagtcaaagtagatgtatgagcccttctcccagtcgtcgccaggctggccccccgctgtgggctctgcataacgctgcggtgccccaagggtggaaatgcactactcagtatttcgtcaggacgctcagtcacccgctgtggaggccaacccatctgctctccgcattgtactgtctgtcatccctgggccaccctttcaagcacatactatctcgtacctgaaaccagactccctgccacatgtggtatcgccagtcctgacgatacagctcctgtgcagcaagcagctgagccctggtcccgggaaggtggtggaaagcaaagaagagcgtttcagcgtccaagagcttgtacaattcccgagggtatttccacagtgtgggctgcatagggagggaagagaacttgggacttggagtaatgatgtaggcccttgactcccatgaacatgtcatttgaaggtggcatatttgggccagagctgttctggagaatggcaaaggctttgcgggccttgcaccgctgtcagctgcactatctccaggagtaaaacccccttgggagaggaacaaccagtggagcccccccccggaccaaccaggaggcacctgaatggcgtgtagctgtggatcannnnnnnnnngtgaaggttgcatatttggaccagagctgtcctggagaatagcaaaggctttgcgagcctcgcaccgctgtcaactgcactatctccaggagtaaaacccccttgggagaggaacagccagtggagggcccccccttgaccaaccaggacggcacctgaatggcgtgtagctgtggatcagatgacaggccagcatcccttggtgtattatcactgcaccgctcagaatcctgtgagtgagacatgtgcggtcgtagaggtccttcaatcacaagctgccctggatctgttgttgatgaagacgggcagtgtatcatggctcctnnnnnnnnnnatgagacatgtgcggtcgtaaaggtccttcaagcacaagctgccctggatctgttgtcgatgaagacgggcagtgtatcatggctcctcccatagcgaccaaccatcgagaacagggagtgcaccatccccctccctattcctgaagagtacatccaccctctgttgagcctcccctcacatcggccagcgggctctcggcctgagagtagaggagatctgccttgtcggccagggacaccggtccaagaaggggtggctcggaagccagggcagacgcagcggccaggggtgcaggctgctcctgaagcccggctccaggcttcttgggagagctttcagcttcaagcctctcctggagcactctgtacagcctgtgaaaacctgccttatccagcatgttcaggaatgctcctgcctgcgcctgcctgcttcttggaggtgtagaccctgcctccagcgcaaacaccgagccaaaaggagactgtttggccgtgggtctcaggacggacaggatctgagagaatctgtgaggccattcagtatggcccaggtcacgctagttggcatgagcaagcggggctgagtaaaagtgcatgctccaggatcagtgagcacagcacccacaaaccaaacaggtcctgaaaccaccctcctttgctccatgggcggaaactagccgacacacgtctcatctgcgaggtttgacactgtattggacgcactgatgctcctcaggtaggactccagcttcccttgggtgccatgcagctcctctgcctgcgacatggagtgctcagcagtgagtctcaataggacggcctcctggtgaatgagccagtggctcttggaatgcttggaagacccaaacctctggaagatgtgtacaagctggaccacagtctctgtacttgcacccacaccagacaagttgannnnnnnnnntgagtgctcagcagtgagtctcgataggacggcctcccggtgaatgagccagcggctcttggaacgcttggaagacccaaacctctggaagacgtctacaagctggaccacagtccctgtacttgcacccacaccagacaagttgacgaggcatgcagacgtgcctggcctcacggtgctctttcccaccgtcatccatgctcaccatcagcctccccttgtccatgagagggataacctgctctgcaaactgtagatgggatttgtgacgatttccagtgtcctccaaaaattnnnnnnnnnngcgtgcctggcctcatggtgctctttcccctcatccatgctcaccgtcagcctccccatgtccatgagaggaataacctgctctgcaaactgtagatgggatctgtgacgatttccagtgtcctccaaaaattgcaatgctggcccgcatgtcgcttggaaatggtgatccttcaataagcattccatctccttctccacacttttgatctgtgagggggtgggctcgtgccgcttctattgtgcttaaactggcaggttgacatgttggtccacctcccatgcaccaggttggcagtgtagtagcctccattgtgacacacctcagccttgagtcgatcttctgcgtccttgaaccagctgcgaattgagctgtgaacttgctcgggaggatgctccctcttcaccaccatgccatcggcatagtgcagatctactagagccttcagacgcgtctgtatctccgtccgcactcgacgcacttgtatcgctctgcccatgtgcagtccgtgatccctgatacagtgggaacccactcgattcacctacgaatatcggcgctgccgaggtaacaatgtgcgagagtcccaaaccctttgccacccacccaccaagaggtgagaaggccgaaaccttggacgagcttgtccagctcgatccctgcgctcgccctcgccgtgtctttctgcgcatcggtctccagttggcgcacctgcaatgaggagtgagccaaggggggaccagtactcagcggcaccatgtacagggcagagagaacatgtggggactcgaacagcctctcacgtcattaatatgcctttcgaagttgattagactcaatgtgacatcttttaagacaagatcgactgagtcatagtgagcagcaagtgcgccctttcgtttattggccttcttctttcccatgnnnnnnnnnnactcgaacagcctctcacgtcatttatatgcctttcgaagttgattagactcaatttgacatctttcaagacaagatcgactgaatcatagtgagcagcaagtgcgccttttcgtttattggccttcttctttcccatgtaccgctagctctgaaaacttagaatgaatgttctgaaattaaagcacaaaaaggttgtgaactcctttcgcgggcacatcacggtatttacagaaggcgacatgagttccgtgttcatgacgctcggccgaactttctaccgcggagtgcaaaatgcgctcgacagcctacctcggagatatgcagagcagaacagagaactgcgatattgaactgaccgctaccatatcttgctccagactccagagatgccgtgggtaaggcccttccannnnnnnnnntcagagaactgcgatattgaattgaccgctaccatattttgctccagagtccagagatgccgtgggtaaggcccttccagacggagctctgacgccgcgttcctgtctgcgtgtcggggtgcacttttcgaattccgtggtgtcctgagggcttgccctgcggcccggagccagcgataaccccatgtcgcaaggctccacgggatcggggcaccctccccgacccccctacctgcctgccttccgctcggcccccgcctcgagacagaccagccgggcctcctcgccccgcagcacctacagccaggcgctggcctgccacaagggtgagcgccgtcagatatgaagacaagaatgcatgtagggaactgatcgtgccttgacctacttttacattcgacagtggcctttcctcccatcaacctccctccatgccgcccatgcagccgccccccgcgccttcaagcccgatgccagccccaggccggggctttccaccggcgatgccgtggccctgcagtgtgacgacggcgacaggtttttccgcgtgcacgcagcctctaccagcgtcggcgaggcgctgggccagggtcccgccctgctccggccctgtggccgctgcggccccgccgacgcccacacccacctggaggtggtcctgtccggcgagtggctgggcctgcgatccgccgcggcaggggacaggttcctgcaggcccgcaagcacggcgccgcacgcctcgccttccacagcgccaatctggggacctgggagcagtggcagctgggtcctggggcggccgaggcgctggcccagccctgggagacgtcccagcccctggttctgcagcaccgccgcctgccccaggtccagctgcatgtgaccctggtgcgggtggggacctttttgccgctgagcgtggggggcagcaccaccccccggtcgctggcgcccgtgccggaggccggcatggctgggctggagagggagaaactgcgccgcatctccgacgtcgtcgtgcaggtagcgcagggttggattagatcctcgggcccgggtggccaagtggagtcaggcaggggaaggatgcgaatgacgagtgtgtggctgtgtgtgtctgcttaagtgggttcttgtgtgtgggggcggtggtttaccatgcgcagcaagggtcaagatgaagcggacagtgctggctttccctcacacacagaaagcgggtgacacagcagagtcgctcctcaaagtctgccgccttgcctatcctgcgcgccccaccaagcatgctcgctcaccctttccccacccacaggaatggtttgcctatgtcgaccgcgagaaggctctgaggagcgaggccgagggcaggctcgccgacctgacgcagacaaccgcccacctccgcgcctgggcagtggaaaaggtgactttgtttcgtcaaactgctcgcggggatactttgtcagagtcccctctgctgaagaacaccccttccatgcccgtccgcccacatgaaaacatgtatcgcaccaccttcaccctatcccctgccgatccctgcccaggtggagtcgctgcgcagccaggtggagctggatgtggccgagctcctggaggccgtgcgggcccggtcccgggagctggcagggagccaggccgccgtcgaggccacgcgcggcgctgcgctggccgcgctggcggcacgccggcggcgcgacgcttgcgccgcagcctttgccgcctggagggccgccaccgcggccgagaaccgacggcgggcctgggaggcagccgcggcgaggcgccgcgtcgcgcggctcatgggtctggccgtcgacgcgtggcggctggcctgcgaggacgctgcgcacaccaagcaggttttgctggaggatggcggggctggttgctggcgccaaagggcaggccgcgtgtggagctggcttagacaagccgctgatcctggaattgatcttctctgccttcccatgcacatgcatctccaatagctccctcgctcccgctccccctccccctccagctgctgaggagagccgtggagaagctgtcggccatgcgtctgcgccaggccttccgcgcctgggcgggtgccgtggagctgcggcgggagcagcaggccctcttacgtcgcgctgtagcgcagtcggtggtgagcagcatcggcccggagcccgtgaatttatgggcccagctgtatgccgttccctgttcgttaccgattgcatcccggtggggctgtggattgccatggtgtcagcggtggcaggtgtgaccttacaggtcccttttgtgaatnnnnnnnnnnggcgcagtcggtggtgagcagcatctgcccggagaccgtgaacttatgggccgagctgcatgccgtcccctgttcgttaccgattgcatcccggtggnnnnnnnnnnnnnnnnnnnnnnnnnncttctcaggctggcgggcatgggtggaggagcgcagggaggcggcggcgaaactggagcacgtgcgccgctccgttgacgcaggcgcgctgcgccaggctttccacgcctggcgcggcctggcgcccgagcgagaggccggcctggaggcgctgcgggcacgcacggcggcgacgcggcgcgcagattcgctgcgcgcgtgcatcgcggcctggcgcggcttcgcggaggcggcgcggcgcg

SEQ ID NO: 36208 - DNA, 70 bp, Chlorella protothecoides
aacgacagatgaacatgggtcctgtgaggccctcgagcatgaagacagggagcagccacaggcagctcaa

SEQ ID NO: 36209 - DNA, 84 bp, Chlorella protothecoides
cagcgaagggctggtcagccccacgcggggctcgagacagcacacagcagcctgtcagccaccctgcgccatgcatggtcagct

SEQ ID NO: 36210 - DNA, 69 bp, Chlorella protothecoides
gtggtgggcagtacaggtccctgcctcgtaagctgcgaatcaactctcagaggatgtcaggaggatgcg

SEQ ID NO: 36211 - DNA, 70 bp, Chlorella protothecoides
gggggggatgtcgcagatggaggacttgacgttgttggggatccactccacaaagtagctgctgttcttg

SEQ ID NO: 36212 - DNA, 61 bp, Chlorella protothecoides
tagccgaaacaatgtagctctactggcaggggcaatgcagcagattgcgccctggagaggc

SEQ ID NO: 36213 - DNA, 102 bp, Chlorella protothecoides
gaagccccgcacgtccaccgactctcccggccctgcagggtcggggtgtgcaggcggggtgtcatggcaatggagcagtgcatgtgccgctcagtgacaggc

SEQ ID NO: 36214 - DNA, 1206 bp, Chlorella protothecoides
  modified_base (155)..(164): a, c, t, g, unknown or other
  modified_base (795)..(804): a, c, t, g, unknown or other
gctccacgcggccgggcctgagggcgcggcggggcgacgctggtcgggacccgcgccggggcccaggcccggcgcggcagcgcagggcgtggacagggtggtggtgaagtcggggccaggggtccgtgggcgggtaggcgacccgctcgcggccnnnnnnnnnnggggcgatgctgttcgggacccgcgccggggcccgggcccggcgcggcagcgcagggcgtggacgggggggtggtgaagtcggggtcgggggtacgtgggcgggtaggcgacccgctcgcggccgcagcagagggggccaaggccggcatcgagcgcggcgggtgggaaggggtcggcgccagggcctccgggcacagaggggggaatcaaagggcgtcatgtggggaacggagcatgaaggactgcaagcgaccctgcacgcaacccacaggggcccatgtttggcaacgcagcggccttctccgacgccatccctgccctcctccccgcccggcacaccttgctgcatcggagcgaggcgcccaggagctcgtgcagtgccgcctgggggtggctgcagctcgactccaggaggttgtcaaaggtcgaggcggtgcggtgcccgtcgcccaggtttccatctggagtggttgagagggggtgggcaggcccgtcgagggattgagaagcagaacgccaacttgcggctcccagcccggaacacgccaagccagcccagcacccactaccacaccagatctcgcctgctgacaaaggggcaaaccctcaccgaccatccaaagacgcacnnnnnnnnnnagcacacgccaggccagctcaacacccactaccacaccagaccttgcctgctgacaaagggacaaaccctcaccgaccatccaaagacgcacaaatgaccctgtacctgaggggagctgcagccctgcctccagggcagagtccagctgggacacaaaggtcacggaggcggagcggggccggctgccatgcacaccgccatcaaagggcgaggggcggtgcaggcggccctggtcgccacaactgtccaagagcagcgtacgcagcgtggggctgccgagggaatgggcctcggggctgccgctgcggtccggcaaggccgggagggaggccgaggagacaaaggcgccatcctgagattgcccggaatgctgtgggtgggtggggggatgccgggggggg

SEQ ID NO: 36215 - DNA, 7857 bp, Chlorella protothecoides
  modified_base (1479)..(1488): a, c, t, g, unknown or other
  modified_base (1795)..(1852): a, c, t, g, unknown or other
  modified_base (2727)..(2736): a, c, t, g, unknown or other
  modified_base (3171)..(3180): a, c, t, g, unknown or other
  modified_base (3572)..(3581): a, c, t, g, unknown or other
  modified_base (3952)..(3961): a, c, t, g, unknown or other
  modified_base (4315)..(4324): a, c, t, g, unknown or other
  modified_base (4651)..(4660): a, c, t, g, unknown or other
  modified_base (5381)..(5390): a, c, t, g, unknown or other
  modified_base (5803)..(5812): a, c, t, g, unknown or other
  modified_base (6207)..(6216): a, c, t, g, unknown or other
  modified_base (6707)..(6716): a, c, t, g, unknown or other
  modified_base (7026)..(7035): a, c, t, g, unknown or other
  modified_base (7607)..(7616): a, c, t, g, unknown or other
gccgccgccgccgccggcggcggcggcggcggggggccaggatctggggaccgcagagctccaggcgctgctgcgccaggtgctggcggcggccggcgccggcggaggagggccgcaggcctcgcagcagctcctcctcgccgcgctcctgggcatgcagagcagggagcgcgggagggcgccgctgcaggacggtgcgtcacggggtggggagagaggatgttgcgatgggcttttggttctgtggggggggaggggtaagaaatggctggcatcccaggtacccgtcttgttgggtgaatgctgctgcatggtccttgcacatcgacggtgcgcccatactgggaaccccctttcccctccattctggcagcaggtgggcacccagacttgctgcagatgctgcaaacgacgctggtcggcggtcggcaggggccggccgcgcaggacccaggcgagggtggcccgcaggcctgaggcgtcgagatactcgttataccccccttgactggcagccatgcttgagggccccagggcaccttgtccaggacctcccgcccggcactgggacctgatccagtgctcgaggctgcctcaccccggtgggctgctcgtcttggcagaacaccccacctggcgtgagggcctgggccctggctgcgaaaacaccacgccagcctcaaagctcggcgacccacgcctctggaatgcgcaggcctggcttcgactcaacctcgataccctcggatttttcacggtacggaatgctcccgcagcctttattgttcacgcgcgcatatatgtactgctctcggacctcacctccaattcagttggacacccctcctgcatgaagcatgcagggctccacagcactccatcttgatgtctctgctgatgcacctcactgccagtctcttttgtcggtgttgtatgtagtgtgtacactggtccccccatgacagactctggtgttggaagggcatgtggagcggcatgccccgctgatggagcgcgaagtgcggcggcataaggccgatgtatgattccctcggcatcaacgccgctcattccctgatctacagggatccagacacaccagcgtggcaaccaagacgaatgacctgatcacacaagctgttcaacagcgccaatcagctcgaagcaggcatcgccagcccgtgcgcggctgggagggggtcggggagtcgggatttaaaagagcagagggagtcccatgtcgaagagcactacggaggcagagtccgcctcggctcctgtcctcgccccagaggctctggatcgcgccgcaattgccctccggcggtgagcatgagggcgaggtggattcgggcgccgggagactggcgcaggtgtgtcctgggtgcgctcagcctgatccagcggatgcgaccccgtccctcgcctgccctcgcagatccgtggagggcagcacctctgccttcctgtaccacgccnnnnnnnnnncgtcctgggtgtgctcagcctgatctagcggatgcgatcccgtccctcgcctgcactcgcagatccgtggaaggcagcacctctgccttcctgtaccacgccgtgtgcaccctggtcttctgccgggtctggctctggcacctgaccccccaggcagccgcgctgccgggtgcccagggctttggctggttcttcaggtacctcaccttctgctcattcaccctacaaaccatcctcttcttctcgtcctgcctgtctgagctggtcaaggtgcgtgttgccaggcctgtgatgtggcgtggcgggnnnnnnnnnnnnnnnnnnnnnnnnnnnnnnnnnnnnnnnnnnnnnnnnnnnnnnnnnncgcacttctcctggcgtgttgtccctaccgcgaggctccatggaggaagtgagaccttgaatcccacttctggtcacgcgctctcttaccctctccactacagagccaggaaaccaggacgcggctgcgcgccgccaccaacaacctgggctgcgccctcttccccatcgccaacaccgtcaccctcatgttttacgccgtcgagaatgcgacaaatgtgtgtcggcatgtgaagcgtggggttttctgggtctccggctgcgacgtcgtgtgcattttggggggtgggagcctcgctggcgctgacaggcgcacacaccctacaagcaggcacgctcctgcctactccattccctccctgagtgcccgcgtaatcacctcgacgtctcccctcctgcttacaaccccccccgccccaaccccacccgccccaacccctgccgccctccatccacacgccgcagggcctggtggagcgcggcggcttcaaccgccccgactggctcgacttctcggttcactccgggaacagcctggcggcctggggcgacatcctgctctccccccaccgcgactttgcgccccaggcgcgcagcctggccattgcgctggccctggcctactctgcctggtgcctggtagtgcgcgccgggtacggcaaggtgagcacgtgttgcttctgcggcgccccgcgggctcctgcaggggaggattggctgtgcgggggagaacctggagcaggaaattcaagcacgcccagcgctgcggccaggcggccggccatgacggtatgagcaccttggcacaagtggtgggacttggatgcaaccccctcacccatgacccccccttctcctctgcgcagttcccctacnnnnnnnnnncgggggaaggacctggagcaggaaattcaagcacgccgagcgctgtggccaggcggccggccatgacggtagagcaccttggcacatgtggtgtgatttggatgcaaccccctcacccatggaccccccttctcctctgcgcagttcccctaccccctcctgaacaagctgcccctggcatacggcttctttggcttctgcgtggccggcacctccctagtcctcttcttcttccaggtgggggccgtggcgaggtggagcctgcggcgccggcggtcgcctgcgcgcccggtgccgaccaagaagaccgactgaggggacgaggtgctgctgaggaagctgcaagaagaggcccagggcggtctgggccggcgtaattctggagtgccggcgattggcgtcggtccattgctctgtgcgagatgggccagtgtnnnnnnnnnncaattttggagtgccggcaattggcgtcgttccattgctctgtgcgagatgggccagtgttgttctggtaggcgctcagactgcgcacccgccccggtccctggcgatgcatgatgccaaccaggcggccggcccgactgctgcagcagcctgctcatccacagtcgagctttgccctggcatttccctgcggacctttccacatgccggggccgactgtgccgagcggtgcgaggtggcagtgcagggtcgctgagtcggcacccctcttggcatgccccagcatgtgccagccctggcctcctcctgcctggatccccccactccctcccttcccctcaaggtattgcaactcatactattgacagtgagcctcaggcacactcactccnnnnnnnnnncagcctcctcctgcatggagcccccccactccctcccttcccttcatggtattgcaactcatactgttgacagtgagcctcaggcacactcactccagctccccccggatctcagagcactgcgtccggtcgatgggttcccgcaggcagtggtcgacggcggccacagcgttgatgattgccacgtcacgaccctgctcctccacataaaacttgttcccaaacctgccggccaccttggaccagaagttctgcaggttggtggttgcgggtgggaagcttgaaagtggactttgggtagatccacgaagcactccgccgaccaggcaggccaagacagaggctgagcaggatgggcggcccggcgctgnnnnnnnnnnggatccacgaagcacttcgccgaccaggcaggccaagacataggctgagcaggatgggcggcccggcgcggcaagccctgtcccaccccccaggcccagcattccaagccagattaccaaagacgccctcacccgtgggatgaagctgtcgatgttgatgccgatattgaagttgagcacattgccaaaggtggggtctgcgaccaggaccacggtgttgtcatccaccgaccagtagtccttgatggccaggcctggagggagggcaagggagcgcaaaggtattcgatgtgaggcggtgggcgtgacaagcagggtacccaaaccagatggtttgcacagagggactccctnnnnnnnnnnagaggcggtgggcgtgacgagcagggtacccctaaccagatggtttgcacagagggactccctctcaaacaagtgtgcagggacgccaggcggaccctccctttcacacgccctaccagggcttccgggaatgcacaccctggccaagccatgaagtccatacgctccatacctggggtgtcggggtagttctgagccagcacgcggaatttgattcccgtgtccttttccaggtgctgcagcctgtccctcatgcgcgtctcctgaagtggttgtcagaagactggtgcatgctcaccgtgcagcccgggagtggcggagggtgannnnnnnnnnattgttggaagactggtgcatgctaaccgtgcagcccgggagtggcggagggtgacggcaagtggaaggctgtattggcaacgcagggctgcatcagcaacagcactgcccgttgttacccacctcggtctcggtcaggaagttagcgacgtcgatgagcggggtgatctcgctgccctgaggcaggaggttgggctggttgacgccctccaagcgagcccaggcccctgctcagggtgggggtgcccactgctgagttgccccgccgactactaggcagcagcatggagagattcacccctactcaggagggtggggcctctccatgcacccccaacacccatccactacattcccaggcagcatcgcaggggatcgccacctgcaggcgtacctgaggtcatgcatagactcaggcagagggcaatgggcgcggtcttccaagacttgctgggctggctccccggatcatgcctccccatgccggcccggcatgtggtcgccactagtccgcgccccgcatggcatggccgaggctgctgggcgcatgagcggacaatgctggatgccatgtgaagactcatgaggctgaccaggacttagggaagtgtggagcgccagcgcagggactcaagcttctcctcccggttccctttctggatcttgggtcggaacgtaagcagcctcacaatgtcccgatctggtgctgggacccgtatgnnnnnnnnnncagcgccagcgcagggtctcaagcttctcctcccggatcccttcctagatcttgggtcggaacgtaagcagcctcacgatgtcccgatctggtgctgggacccgtatgcagggccaaggtccacgctcgggattgttacaggagtgtacatgcaggtcgtggggcacgtgtcggccaaaaggcttccagagtggcttctgagcaagccgggaggcagcgaggccagacacgcaggtctgatgccaggcagacatgtcgggcatggtgagtgaggataccacaatgtgccatccacatgcaaccaagatcagaccaattgtgggatcagcgtccatcctgcggccctgatgcctcagatgtcatgcgattgttggcaagccccgcaacatgctcggcacccacagccctcagtnnnnnnnnnnccagccgtcatgcgattgctggctagccctgcaacatgctcggcacccacagccctcagtgcctgcaggtgtggattgtcaagctccaggctctgcatgttctcgtggcaccgctgctcgacctcgtctgccagggcacatgctgcggcaacctggggcgagtacctgggccatgcaggtgtgcatgatggttgagacggggatgcctggccatcagggtgggagcccagtaaggttcaggggcagaaacctctgcatccatgagaggtatctgagcccatgcaagcacgcctcaggaggatggcctgcttgtgatcactctccacctcgcacccgtgggagtcgccgccgcttggagtggcatggatctcggcgaccgcagccctgaagtccannnnnnnnnncggggcagaaacctcggcatccatgagaggtatctgcgcccatgcaggcacgccccaggaggatggcctgcttgtgatcaccctccacctcgcacccctgggagtcgccgccgcttggagtggcacggatctcggcgaccgcagccctgaagtccagcaggaaagcctccacagagccatagagcccctgccagcagcggcgcgccacgcgcggcacgctgggcggggtaatgccgcgcctgcgcttgctcctttgccgctctggccggccgggcgtgacctcgagcagggccagccgggggtcccgtgccagccacaagcccacttcctgcagggaggaaagctcggcatggtagagcgccagcccggccgccaggtcggcctcgttggtcgtggcgtttggcgtctcaggctcaggaagttgcgaagcaggtgcacgaggcatcgcttcctccgacaatccatctgttgggcggctgctgtccgccagnnnnnnnnnnacgtttggcgtctcaggctcaggaaattgcgaagcaggtgcacgaggcattgcttcctccgacattccatctgttgggcggctgctgtccgccagaagcgcctcgtgggccggggcgtctgcggctggttgcgatggtggcgaggaccagccctcttggccagcggggcgtgccagcacaaccccttcccgcatcgacgaccccgggcacagcagctgcacatcgaagaagtcctggacatcatgcggcagggcgtctgcggggccccgcgccgtggctaggatcagcgccggcgtgcccctggccgcgnnnnnnnnnngtcgaagaagtcctggacctcttgtggcagggcgtctgccgggccccgcgccgtggccaggatcagcgccggcgtgcccctggccgcgccctgcacggccacgacgaaggtcgtccacgccggtgaggcgccgagcccctcgccatcgtcgcccacggcccaggcggagaggtcggggaggtggagcagggagggatgctggaggcctgggcgcagcaggggctgcagggccggccctaagccggccgcaaggccctcggcaccgcggctgtcgccggcggtgatcagcgaggggagcgtgagggcgtggacggcgaatcccgcgtcgcggcagaacagctccaaaagacaagcggcgacgtcgccggcgcccccgctgcccgacgtcaccgggccccagaggagcaggcgcatgcaagggggcggcagagagtgtcgaaggtccgtggagctgcaaagagctgacccagaaggtacgaaagggcttcgtcgagtcaagccgtttgggcctgggccattgaagtcccgatccaaactgtctgtcccgccctcgcccgccagcgcagccagcnnnnnnnnnngagagctgacccaaaaggtacgtcaaggcttcgtcgactcaagccgtttgggcctgagccattgaagtcccgatccaaactgtccgtcccgccctcgcccgccagcgcagccagcagctccggcggatcacagtccaggaatggcatcagctcgaccggcagcgcggccgcagcgtgcacagcgcgcagcgcggcgcgcaccgagcgcgccgccgccgccggcaggccctccggcgggccc

SEQ ID NO: 36216 - DNA, 4968 bp, Chlorella protothecoides
  modified_base (1294)..(1303): a, c, t, g, unknown or other
  modified_base (2339)..(2465): a, c, t, g, unknown or other
  modified_base (2767)..(2776): a, c, t, g, unknown or other
  modified_base (2858)..(3065): a, c, t, g, unknown or other
  modified_base (3499)..(3508): a, c, t, g, unknown or other
  modified_base (3661)..(3670): a, c, t, g, unknown or other
gcgtcgtgtcggccggcgcggacgacgcggtgcgcgcctgggacggcgccagcttccgcaacacgctggtcaacttcgcgggcgcgttcaaccgcgcgcggcggccgcgccagctggcgctggcgcgcgacccggacgcgcttttcctcccctccggctcggcggtgctgggctacgacctgcgcagcggcgccgcgctgtgcacgctgcgtggcgggcaccacgaggccgtgcacgcctgcgtctggagcgaggcgggcggcggcacgctatacacgggcggggcggaccggctggtgctgacctggcgcccgagagctgggcgcggtgaggacgaggaggatgcctggagcgagtgagggcatgcagggggaaggttgggatactgctgggtcgtcgagtgcgacccgtcctgggtttcaggatagaactgcacaccaccaggagccctgctcctatgcattcccgcctcgctgcgcacactcgagcgagcatgtcgccggcctgcccccatcctgctcccatgtcaaaacaagtcacggcatgcacgttcccagggaggaaccagggcaatacatatatgggcgttcaaggtgagcctggcgccgaggcggcacctgccaccgcacaggccagcatgcgctcgacgctcgtcatcttctcgcgcggcttccccacggcttcccccgccgccacctcggcggcgtcgatccgggcccagcccgcccagggcaccgcgattgactccggggccaaggctcgctccaggccggccctccgctccggggtcggccagtccgtctgtgctcggaccatgccctccaccgtctgctcggcgtcggccaggttggtgccgatgatgccactggggccccggctcagccagcccacgacgaagaggccggggacggcgggagcgtccgccgccgcgctttccagcacctggcccatccggttgggcaccacaccccgctccgcatcaaagggcagaccggggacggggatggagcggtagccgatgctcttcagcacctgcgagagaatcaagggggggcagatgctgggagacaggccgttgggatggggcggatgagggtacactggtgttggccgcccctggcacatggtgaatgccatgccatggagagggagacttgcagtggaaggctgcaccacttctctccctggcaaggcaaaccccaaacttccctgagcgagtttccgtcattatacccttttaaggcatccaactcttcctcgcatggccaggcaacccaccaggtcggctgggagnnnnnnnnnncacccttccaaggcatccaactcttcctcgcacggccaggcaacccaccaggtcggctgggagcaggactgactcgccggtgggcacagatcgtgcggctcccgacggcgaggcctccaggcgctgcttctcaagttttatgcccgccgcgagcccaccctcttcccgggtctcaacggacgcaggggagctgaggaaatgcaggtgcagggtccggggcctgtggccgggatgtgtcaagggtggcaatgggatcggcgtgctatagggacacgaaagctatacccctgcgcccgcgtgcccgagcatgcgggcccggcaatgtgcatggcccctgccagtggtcccccaccatacacaccacacagcaccttaccccttcctctgcgctgcctctgcctttgtcagcacctccatgacgcgccgctttatcctggacgcctccatctccgccctgcacgccggggtcagcgtgtcgagcgccccgccgtggatctgcacgccgatgcctggcatgctgagcaactccctcagctccttgggggtgaaggacgcctgccgggcatgggtggacaatcgcgagatgagctcgggaggactgggtgctgggtgggggagtacgccggcccggggtgatctggcaacagcacagcttcagggctcatgccccagaaatatccaagattccttcgctccattgccccctcccacctgcacggggcccctgcgcccgatgacatggacgtcggtgacggcgctcctgcgcagcgtacgcagcgcgtgctccgcgatgtccgtcgacgctaggcgctccgggggctgcagcaggacacgcgcgcagtccagggcgacgttgcccagcccgacgactgccacgctttgcacgctgcgcaggtcgattggcaggccagcctgggaggggtggccgttgtaccaccacacgaactcgcgcgccgagtacaccccgggggcggcctgtgaattgagggatggggagaagcagcacgtgagggaaacgccgttttccagtggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccctagtacctcacctccccagggatgccaaggctcctgtctgactcagcgccatatgccaggaccacggcatggtattgccgcctcagctcgtccagctggacctccctgcccaggcggaggttgccgaagaagcgtaggtgtgggctggcgccggccaggtggctaaactgatggatgacgttctgttcgcgcatagtgtgtagaggaatttgtgcaatgaaggagaagcccatacacaattttccatgcacatgtgtgggcatccgtcgctcaccctcaaaggagggcaaaggtgcnnnnnnnnnncaggtgcatgatatcctagatcaggcgaccatactgctttcccacaaaaagagcagaccaatctcatgaccggtcagctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcatagtgtgtagaggaatttatgcaatgaagaagaagcccatccacaatttttcatgcatttgtgtgggcatccatcgctcaccctcaaaggagggcaaaggtgcatgcacgaaacctcttgatgcctgccccgcccctctcctccacatgttccaggaaacaaggtttcaatccacctccgtcccaccttggtgtctgggtgatcaggggccactcccgaccgaacaaggccaaagggacttggcagggcatcaatcaggtccacggtggacccctctggaaaccgcttcagcagctgtgcagaaaatatggaggcagggtgacgcacaaggagcaggtgctgctggtcttgagtgatgtgcttggtgctgggccgagtggaacagaggccaggcctaatggctcaccctgtctgcagtgtagaacccnnnnnnnnnncgtggaacagaggccaggccacatggctcaccctgtctgcagtgtagaaccctgcaggacccgctccaacaatgcagattcgcttgatgtcgcatgcttccgtcccaaaccagcgcgctgccaatctcgacgcgccattatactggcgaagcnnnnnnnnnnatcgcttgatgtcgcatgcttccgttccgaaccagcgcgctgctaatctcgacgcgccattatactggcgaagcgtgcattgtagcatcgccagcccgcctgcgagcgccatctccctccctcacacccctaaaggatgaccatgtccagaagctgagcgaggggcacacagggatctgaggcacgtcgccgcatgcactggaaatgttgtgggtatttaatctgaattttcgtacggggtttagccctcctcctcatactggcatgcacacactgcgcatcgatcacgcgcccaggataattcagcttttcttggaggcgctctggccctttgaacacgggacctcctcgcgacaagggctgcagagggagactcgatcgggccctcagactccaagcaccgcccaagctgtgctgtatctgacgcaaggcatctcctggtgagccctgcccgaccgccgcccacgagtcagccggagtgactggccgatcacagggcaccctccccctttgtgcctgtactccttacactggccccagcctcgtagaggatgagtagtagagcagacagcaaatctggatcgcgtaggaacttcaagaagggtgggtgggggtgtcacctcggcgtcggctcggcccgggacctcagggtccgaacatgggggggggtgcgccagtctcgcacccaccacgccctcgcgcacctccccatgatgccaccaccttgcatacaggcatcgacctcgacgaggcccggcggaagcgagaggacaacatcgtacagttgcggaaggaccggcgggatgagaacctccagaagaagcgcatggtcagcaccgtggctgtgcagaccggggagctagagaccacccgatctacgccgtctggagtccagcagcgggtgcgcgggaggggcgagcccgcctcgtgcactggagtacgggatgtcttcatgtgtgagggggagtgtcaagagtgtgggagtgcctgtggcacggcctgaggggttgcctggcatgtacacaggcactcctcctgaattcagtgcggcaagcgttgggggatggggtaagggcggcactgacatgtggttctggagagggactcctctccatacttggggcgacaccagcctgtaccggccgtgaggctccctgtgttggcatgtcctgacggcccgcagcatcctctcaccctttagccaatatcccatgccccaacaactccctcttccacctaccccctcttccacctccacctcatccctcctcaccccttcccccctccccacccccccc

SEQ ID NO: 36217 - DNA, 61 bp, Chlorella protothecoides
aaccgacttgggacttgtttggcggaggagtgtttgcccgccggtccagcagctctgggcg

SEQ ID NO: 36218 - DNA, 81 bp, Chlorella protothecoides
ttcacgtggaagttccctcgagatccgcgcccgtgaagtgatggggctgccgacggagttggcactccgaccaacaagaac

SEQ ID NO: 36219 - DNA, 61 bp, Chlorella protothecoides
caacagtgccccgattgcggctgtggagggggcaaggacagggcatgtccccgcccagatc

SEQ ID NO: 36220 - DNA, 126 bp, Chlorella protothecoides
gtggacggacggcacgggggagggcatcgccgtcaccaagccccccaccgagcagccccaggcctgggaggtggtcgtcacgcccggcacagacctggagggctggcagtacggcacggtgttcaa

SEQ ID NO: 36221 - DNA, 73 bp, Chlorella protothecoides
cacacatggcccctgggaattggcagcaagcacacaatgggaaaagcccacacagcctactgaggcagacggg

SEQ ID NO: 36222 - DNA, 62 bp, Chlorella protothecoides
aagcccacacagcctactgaggcagacggggtctccagaccatgcccagggtgccacgccgg

SEQ ID NO: 36223 - DNA, 120 bp, Chlorella protothecoides
agaatgggagccagtcaacgctcaggaccacgcaggccctagcaggcccttcaggctggggcgtaggccgtgccgttagaccctggggcatggcccccgccggccaacgagcccgtacga

SEQ ID NO: 36224 - DNA, 66 bp, Chlorella protothecoides
ttggtagggggcggtaatgcatgcctgaatttcccgaggcaggggagcgagtaggtgtggtgtcat

SEQ ID NO: 36225 - DNA, 19437 bp, Chlorella protothecoides
  modified_base (454)..(463): a, c, t, g, unknown or other
  modified_base (653)..(662): a, c, t, g, unknown or other
  modified_base (1097)..(1106): a, c, t, g, unknown or other
  modified_base (2870)..(2879): a, c, t, g, unknown or other
  modified_base (3518)..(3527): a, c, t, g, unknown or other
  modified_base (4320)..(4385): a, c, t, g, unknown or other
  modified_base (4540)..(4549): a, c, t, g, unknown or other
  modified_base (4639)..(4648): a, c, t, g, unknown or other
  modified_base (4748)..(4757): a, c, t, g, unknown or other
  modified_base (9339)..(9348): a, c, t, g, unknown or other
  modified_base (9827)..(9836): a, c, t, g, unknown or other
  modified_base (10390)..(10462): a, c, t, g, unknown or other
  modified_base (10612)..(10621): a, c, t, g, unknown or other
  modified_base (11678)..(11687): a, c, t, g, unknown or other
  modified_base (11899)..(11957): a, c, t, g, unknown or other
  modified_base (12121)..(12130): a, c, t, g, unknown or other
  modified_base (13020)..(13029): a, c, t, g, unknown or other
  modified_base (13454)..(13463): a, c, t, g, unknown or other
  modified_base (13648)..(13657): a, c, t, g, unknown or other
  modified_base (13729)..(13738): a, c, t, g, unknown or other
  modified_base (14063)..(14072): a, c, t, g, unknown or other
  modified_base (14371)..(14380): a, c, t, g, unknown or other
  modified_base (15042)..(15051): a, c, t, g, unknown or other
  modified_base (15496)..(15505): a, c, t, g, unknown or other
  modified_base (17309)..(17318): a, c, t, g, unknown or other
  modified_base (17810)..(17877): a, c, t, g, unknown or other
  modified_base (18011)..(18020): a, c, t, g, unknown or other
  modified_base (18089)..(18098): a, c, t, g, unknown or other
  modified_base (18168)..(18303): a, c, t, g, unknown or other
gccggccgccggggtcgagacgggctggccccagccgtgtcccgccccgctccccaggctgctgctggtggagggcgggaagcgcgcccccgccaccgacccgccgccgctggaggacaccaggtaggtgctgctgatgggggagggggtgctggacccgggccgtgtcgggctggggatgaggaccgtggggccggggcgcggcggcgacgccacgccaccccactgcgccgccagagcggcctgggcggggttgtaggcgggggcgggcgcgccgtgggcgccagggcccagggcggaggggacggggtagccggggggcggcacgggtcggccgttgggcaggcgccccgtggcgcggatgacatcaaattcggggtagaagacgtcctggcggggagttgaaggagagaaaaggggaaggttgtgtgagcaacgcgacggggtgctggcnnnnnnnnnngttgagggagggaaaaggtgaatgttgtgtgagcaacgcgacggggtgctggctgccaagccaagtggctcgacgacgcagcagcccaaccagggcactgcaggcacgctggccgagtgagacgccgcacccacgcagtctcagggagccatgcagagtggcccgccacgtaccagcgggacctccggcnnnnnnnnnngaccagggcactgcaggcacgctggccgagcgaggcgccgcacccacgcagtctcaggaagccacgcagagcggcccgccacgtaccagcgggacctccggccgtggcgccggctttggcggagggctgggcaccgggggagccgccggagcaggcacggtggcagcgggtgcaggcaccggcagcctgtgtggcgccggcgccggctctgccgcggcaggcttgccggcatcctcgccgaacgcctcccaaccgtgcgtctcgtgcgaaggcagtggcgcggctgcggtctgcgggggtgcctcggcaggctccgggacatgctcggtcggcgcgggagggccgccggcgcccacatcgtcgtcgaatgccgcccagggggaagattcctccccatgcacccccgaggcctgggctcccactggcgagaacccnnnnnnnnnntgggacgtgctcggtcggcgcgggagggccgctggcgcccacatcgtcgtcaaatgccgcccagggggaacattcgtccccatgcaccctcgaggcctgggctcccactggcgagaaccccgacatcaggtccaggagactgccgcgctccggtgcagcggcgggcagccgggcttccgcagaactgcgagtgcgcatggcatgtctagtgagctggttgtgggttggtggcccatcaggtgtcggcatggtcacctcgtgcagctccccccgggccaccagcgagatgagccggcaccgtctgaccttgcagtggctggggctggggaggctgcgggggagtggacctcgctcacgctcagcttcggcatgctcaggcccagcacatccgagaggcgtcgctcgatgacgtgggaggcgtcgccgttgctgcggtccgccgagtctggcgaagcggcggcggcgtggccctggagggagggcagggaagggggacactgttggagcacgagctgaagcagagcaccgttgcccatcccgatcagccctctcgcgcctggggccctgggcttgtagcgagcactggcaagcatgccgtctgcaccaggtctaaccaatgctacaacagctacttacgttgccatttgaggtagacaggggggcaggggaccggccagccgacggggtcttgaaaagggctggcttagcctcctgacccagggagggtgcacgctgctgcggcgaggaggccttctttggggggcccctgaatcgctgctcctggaacaccacctggatccactccttgatcttggccgggacccggttggtgggtttgggcagggtagaagcctgccaggtggccaggtactcggcagcaaaggcctgtgcatcggaaagaggtgggcatcgtaaggccctggcagcaggggcgccccaccactccatagtcctgcgctggaccctgaactcccgccgcctcaccccattgccgccctcctccaacgctgctgcctcctcaggggtgaatcgggaaacagagatgcccttcacgcggtgaccgaactcacggctgcacatggggcgaaagttcaaatcaaacaatgagcggatgtgacgtcgggcatgggtcataccgaagtcatacaggccccttgacgaggaatggagtggcgatggccctgccatgcgcccccactcactggacaccgctgcacactgtgcacacaaagatgttgaagctggggagtgcatactgggggccctgtgcgtatcaggagtcgcaacccagtgagatcgaggtgcacggggtatggcgggcagaatatgggccgtaatgcagcagccagtactcaccaggctttcacagttgacacatcgccggttatagggctgtcgaagcagatccttgatctttttctccagcttcgcatcttgtcgggatcccatggtggaggacactgcaggcgcgacaaatttgcacgcacatgcggcagtcggagaagaattcaagaccaagtatcagcgaagcagcaagggagcgctgctggggtgaagggggtgaagacacctgctctacgcgcccggagtcgctgactcgtcaggatcgacggtgtctctcggacggggggacgaataccatgtgtgctcccccccccaccccctcccctctctacaccactcgactcacggtgtatcacacgtagtagcctgcattacacgtgcactccccgagccatcaagcctgggggtagtggtgcaggnnnnnnnnnncccccctcccctctctacaccactcaactaacgatgtatcacacgtagttgcctgcattacaacgtgcactccctaagccatcaagcctgggggtagtggtgcaggcggtacaggaccaccctgcccttggcgttcccgatggccaggctgccgccccccgggctgaagtccaggcagtgcacgtagcccagcggggagcggctggtgggccagttggagaagacggtgccgctgggcacgtggagcaggcgcagcgcgtcccgcttcatgcgtgaggccatcgccaggacctgcccgtcggggctgaaggccaggctgtcgatggtggtggtcagattgagcgccgagtggcgcggcgggggacgtgcggcatccctggggaacgccgcagcgacgtcggctgctgcggcagaggggggcagcaccgggtccgaggagtcccctaagatctgctcccggccatacacattcacgacgccgctgcttgagcctgggagtttaggagaaagagggaggaagttaggggattgggatctggcaatggatgtggtttccatgtcaaatttcatgttgccatggtgtcagcatcttatgctcgcgaggtggagacatggagtcacccgccaggctaccagcgnnnnnnnnnnttggcaatggatgtggtttccatgtcaaagttcatgttgccatggtgtcagcatcttatactcgcgagttggggacatggagtcacccgccaggctaccagcgacctttgcctggaaagctgttgccatggggcaaactctcaaccatgctgagggtacttttcggtcccgatggcacatacgtgcacgcctcctcgtcccttccccatcattgacctctgctcaccggctgcaagcagggaatcgtcaggggagagggccagcgacgtgccgcgcaggctgccctcatccacgaagcgcgcccggcaggatctttgccgcaggtcccagatgtacacagcgccgtcccctcccgaggtgtacagctccatcccgtcgctgctgaaggccccgctccgtgcctgcacgtgtttggttgggattattgatgagcaggggtgtatttgggaggaggctgtgcagtatgggacaaattacccttactctccctctggagttcatgatgcatgtcctcatccccaatgcatgccagctacaggtctcgtccatgcaggcagcttccctgcacatctgtcacaccctcaccccagcacaccactcaccgagccgttcattttcagtgtgcccaccagctgcctggtcgccagggacatgagaggcagggtgccgtcatcgccaaggaaagccacgactgtgatggggaggagagaggtccaggtgatcaagcctgagaacacagcagcagagctgggcggtacaaatccggcatgctgggtgaccagcaggacatggnnnnnnnnnnnnnnnnnnnnnnnnnnnnnnnnnnnnnnnnnnnnnnnnnnnnnnnnnnnnnnnnnnccctcggggctacacctggcatgccctggcccgcaggctgccgcctgtcacgcttcaatcctcccctggcccctcgctgctgccacctgcagccacaccacacaccctcccccgcaattcccccctacacaccctgcgagccgggcccagcgctnnnnnnnnnntgtctgcaagatgctcaacgatgaagctcccctggtgcagcctgacgaaatccctcattatcggttgccgcggcccgcgcaaagggacannnnnnnnnnggtctgcaagatgctcgacgatgaatctcccctccacacccctggtgcagcctgacgaaatccctcatcatcggttgccgcggcccgcgcaaagggacannnnnnnnnnggccacaaaaccctccaggctccggtcctgggtcccaaacagacgtgggatgcgctccatagtcgcgctctccaggtccgccacgtaaaagtacttgcgccgccccgtggccagcaccttcctgccgccggcggcgaaggccgcggcgtgcaccggcaggtcctccaggaacaggctctggaccagggggcaggcgtcgccgtccacggcgaagaagcgcaggcgcttgtccagcgaggcggtgagcagcagctggccgttggggtggtactgcagcgcgcgcagtaccccctgggctgggtcggcggcgtttgcgtcgcgcatgcggctggcctccagctggcccgcgggcagcgccctgcccttgaccagcaacccgcccgaccgctgcagcagggccgcggtctcggagtcgggccccgcctccgcgcgcgcgccgcgcctggcccacccgacgcgcgggttcagcttggcgtgctgggcgcgcaggcgctcggagtatgccgcgccgtccaagaccttctccccgttccgctggcggagcttgcgggcgcgggagacgtcggccacgttcacacgcaggctggcgtcctgggggtcgtgccaggcgggcgcccgggcctcctccgtgggctcacggtcctggaacacgggcagctgctgggggtcgccggtgctgagcagctcggctgccacgtcctcctcacctcggaacagctgggtctccagctccgccatctgtgacatagaacgtcggtggcgtagaatgagggctacctcgccacccgggagtcggaggagcactcccaatgccaggcagtccgctcccacgtgcagcatgctccacctaccctggcctcctcatccgctgtgatacgggggcgcttatcgccgggcatggctgcagacgctttcggtggaccgactatatgtttgcacaccgggaacagtggaagactgacgctgcggactggccggcgacacctcagttcacggctagcattctattcacaacatggcgcccatcataccgcttcttcttgagtattaagtacacgtcgtgtgtgcttcgtttgcgccccttgccttgcagagtggacgcaggcatgcacggcaatgcaatgcatggcgcccaaagtcctggggggggttaacgccgcacgcagagcatgttcgaaacccttctggtttcggaaagggtcatggtgtcgacaaaagattccaaactggagtcaacgagtcgcacattcgttttgatcgggaagtagacaccgatggaatatttgtacgtgcaaggtccgtgccactgaaatctgtagagctggaaattctgcctgagggccgtcagttatcagcactgctcgggtgtcctcctgtaccgagcgggagagtgtagaggcaccagtgcgatgcaatcagggcagcttcttcttctcatttcagcgtttcttggtttttacggcgtctcagctggtcgttacaagaccgatgcggggaggtgaggattcgtgatcgtgccccgagaagatgtggtgggattgcatggtgtgggtgttctcaaggccgtgatgctcgcattgctcgatttaaacccaaagcacggtgtcctcatcatgtgcaagccccattccatctactcagactggatggaaagctgaatgtccatctcgtctgccacacccatgatgacgctgggtggctgaagaccgtggaccagtactattggggtgctaacaacaccatccaggcatgatggtcaccgatacgatctgctgaccgttgttttaccatgaatggaatcaggacgtttggcagcaacttgtggatactctgtgtgtgctgagccccagactgtggagcactcaagaacgtactcctccttccttctctcaggatgccggggtgcagtacattctggatgccgtggtggcggcccttgctgccaacaaggaccgcaaattcacctatgccgagatggtgtgtgggtgtgggttgtgtctctgcttatcaacttgagatagtccctgttttcgcccccaggaatagcccagtttctttgcatatggtccggccagacccagtgccgcgccaccccatacatgcaacacgatagatttgtcattcgcttcctgctcccagtccagcttgtcctgtgggaattttaccctttctggtctcgattttgttccccttccccccacccctgcctatttcccattcagtctttcttccagcgctggtgggatcagcaggaggaggacatgcgggacctggtccaccacctggtggcctcgggccagctgtcctttgcgaacggcggctacgtacagcacgacgaggcggccagccactatgtggccatgatcgaccagaccacaaggggccacaggtgtctctgctgctgtggagggcttgggcatgtggggcagaggctctggacctggagcattgcaaatgatagcacccaatgagaaggctataagtcagcccaaggatgcaaactccttgctttagcatggaatgggccctccaaaggtatgcaagggggcatgaccatctattgttctcttgtgcggtacattcaattactgctcccttcgcccttctgcgcagcttccttcaggacacctttggtgtgaagcctcgcatcgcctggcaattagatccctttggccactctgccacccaggcatccctcatgtcggcggaggctggatttgatgccctcttcattgcccgagctgaccaccaggtggggtcaggaggtgatctcagaattcccatggaggtggtacgggtagaaccctccttcctgtcacactcttggtgggagctaagacctgatcacctctaatcatgccaggacatggatgtgcgccgcacaaagaaggagctcgagttcatctgggcacccaacgggactgtgggtggggatgaggacggcatcttcactgtcaactttgccagcggtgaggagcggatgtgcatgacgactagggttatcggcagtttccgggaagaatgattgcaaactcgagttggctgtattcccccctgcccgcacatacatgattattacctgattgctatgagaacagtatgcaaattctcgctagcaacaacttgccttggtcaacgtaccacaggtcagtatggacctccagaaggctttggattcgagtggggatgcccccctattgctgacgatccgcagctcaaggaatacaatgtgcaggacaggtgatgcgtgcaggagggtcggaaagttccgaaggggggtgatgggtcactcgaggcacagggttgggtcgtggcttgattacaagggcgcagcaagacactgagctgtcttctgcgacatgaggtgtataaatgtgagcatgcaagatccccctggaatttggctcctcctggacctccaatgccgtgctccctatgcacacctgttcccattctgaaaccacccacagggtggatgcctttgtctggtatgcacagggactggccaacgtgacagtgggcaatgatgtcatcgtcaccatgggctccgacttcaattacggccgagccaatcagtggtgaggccgtgccgacggcgtgccccgctgtgcttaatcgccaagactctggaaagggtcaagtgtcaagtctgcactgaggcacaggagtgaatgatatcgctagacctccatcaccaatattccaggtttaagaacatggacaagctcatccactatgtgaatgcggatggtagggtgaatgtgctctactccacccccgaggcatatgtcgacgccaagcatgggtacaaccacacctggtctgtcaagcgtgacgatttcttcccctactcggactcttcgcatgcatactggacaggtgaggacctttgaagaggaggaggatggctgtggcaggtcaaagagtgaatgtgggggggttaagctcatgagagccgggtgcaggtgtcgcagttcatctcttccttggcaaagtagctcctgcgctgtggctggcatgcctacaagcgagcccacttctctccctcacccctccaggctacttctccagccgccccacgagcaagcgctacatccgccaggccacctccttcctgcaagctgctcggcagctggagctgactgtcggcggcaagtccagcggcggcccgaccacagatggcctggaggccgccgtgtccctcacccagcaccacgattccatcaccggcaccgagaagcagcatgttgccaacgactaccatgagcgactgagtgcaggtctggcggttggtggtgtgggtgtcgtcaagtggctccgtgagcccgtagcatcatgtgagcacttggactgccagcccgtccatccttgcatgggatcagcgtgcattcttggtgtctcttgaatgcattcgcgtggatcgcatatagcatgggagatgtgtgggaaggagggcattgaactcggaatcgaggtcaaagactcaagctgatgcggccgggtcgagcatcaaccgcaatgccaatcctaacctcccgccgtcaacaggtttggtggaggcgcagactgtagtcgtgggcgnnnnnnnnnngatgcgtgtggatcccatgtagcacgggagatgtgtgggaaggagggcattgaactcggattcaagctcaaagactctggctggtgcggcagggtcgagcatcaaccgcaatgccgatcccaacctcccgccgtcgacaggtctggtggaggcgcagactgtagtcgtgggcgctgtgtcccagctgctcggcggcgaacccctgctatcaaacgctgccagcgccgatggctcgatgctgcgcttctgcaactacgccaacgccacgatctgcgagcccagcgtgcgcctgagcagggaggggaggagcatccgcgtcgtcgtgtacaaccccgtggcctggacagtgagagctcccctgagggtggctgtgtcgacacacacctcctgcgagtggatcgtgcaaggtctgcgggttgtccaaggggagtggtctggcatgccgtgggcatgcaaagtggttgtcctgcctctggagnnnnnnnnnngctcctgcgagtggattgtgcaaggtctgcgggttgtccaagggggagtggtctggcatgccgtgtgcatgcaaagtggttgtcctgcctctggaggatctgcgcggctgtggtatgagtttgtggacttgtttcaagcatctccagcaagcttggtgtgggatacgggcccttcgcagtcacacccacgaccccccacatccacatccatgctctcgctcatctatcacaggccccaacaacgaaaccctgccctcccatacggtgtccgtggatgcgaccactcgcaggctgcagcacctgctccacgagacgaatgcgagctctgaggcggcaggggacgcggaggtggcctgggtcgcagacctgcagcccctcggcctggcaaccttcaccatgctgccggcaagtgttgggcgtgctgaaagggacgtggtctcgggtgcagggcctaggaggcggcgcgacgaggtcctcgacaacggcatcctgcgcctcgtgtttgatgcagaggcaggcgagtgtagggatgggaggggtcttggaggccagtnnnnnnnnnnnnnnnnnnnnnnnnnnnnnnnnnnnnnnnnnnnnnnnnnnnnnnnnnnnnnnnnnnnnnnnnncacgaattcttcatggcgtaagagcggatggacggtgccatctgcctggattcgattgcacaaagcatttgcctgcagtccccctgcctcctgcttatgtgcacatcctatgttatccctgtaaaaggtgcactcatccttcaagcaccnnnnnnnnnngtgcctgcaatccccctgcctcctgctcatgtgcacatcctatgttatccttgtaaaaggtgcactcatccttcaagcaccccaccaacctcccaatacaggcagcctgaagggcatcggcatcgatggcgcggagcccatccagctgaccacctccctggcctggtacaactccagtgatgggttggatgtcccggagggtaaggacaggggccaggccgggggcgcctacatcttcaggtaaggggtttgggctggcgctctctcgctactcgctaccagtcaacacaggaaccggcccaagacagcgagctccacatgctgccaggctcaagcttggcgggtgaccccacccctcctcacacagacccggcaacaagaccttcctcccgcgccaccggcgtgatgttgagctgaggatcgtgaagggggaggtggtccaggaggcccatcagcggtttggcgactgggcgaccctggtcacaaggtagggcagcgctggatggtcggcttcttcccgtttcagggtgctgtcaactgcaggcaagcaggtcgcgaggaatgagccacaccccttcgcctccctcccctttcccttctcctaccaaccccaggttgtaccaaggccaggcgcactttgaggtcgaatggaccgtgggtcccatccccgtgtctgacggtctgggcaaggaggtggtgctggagtaccggtcgtccaccatccgctccggccgcaccttccacaccgactccaacggccgccacatgatgcaccgcgagcgcgatcaccgccccggctggcggttgaacgtgacggagccggtggcggggaactactacccagtcaccgcagcggcgaccatccaggaccgggagcactcgctcgccgtcctcgtggaccgcgcgcagggtgggttgaggccaaaggggggggggggccggtcagggggtggagaagcaggtgcatggggcgcgggaggcgaggaacgcgggaccactgcagcgaaggacgcacatgcgcgcacttgcatgatggggccattgtgccttcctcttnnnnnnnnnngggggtggggggtggggccgtcagggggcggagaagcaggtgcactgggcgcgggaggcgaggaccgtgggaccactgcagcgaagggcacacatgcgcgcacctgcatgatggggccattgtgccttcctcttgcaccgagggtctgtcgacctctgcagcaagccaggccttgcagtggcccggctggaggatcctcagctcaaaccgannnnnnnnnnnnnnnnnnnnnnnnnnnnnnnnnnnnnnnnnnnnnnnnnnnnnnnnnnntccctccaggcgctgcatccctggcatccggccggctggagttcatgctgcaccgccgcctgctggcggacgacggccgcggcgtggcagaggccctgaacgagacggcgtgcggcgacgcgaaccgcgaggcgccccacgcctgcggcgggctggtggcacgnnnnnnnnnntggggacgcggaccgtgaggtgccccacgcctgcggcgggctggtggcacgcggcgtgcatcgggtgctggtccagcgagagggaagcggggaggggcccgcccatgccgccgcggtgcgccgcaccgcccaggccctggtcaacgacccgcccttggtcatggtcggacccgtgcagctctttgagccgccgccggcagcgccgcctgcacccacactgctcgcgctgtccctgtcgggtggcgccaccctgccccctgacgtccagctgctgactttggctgagctggcagggcgtggcatcgtcagggtggcgcacctccacgaggcgggggagggcggggacgccgcgaccccggcgacctttgaccttgcgcctttgctgaggagcatcaagttctccgaggcgagggtctggtttgaaacggatggggggcatgtgtgcgctttgccatcggcagcgggcgaggagagtccggtggttgtgtggtcacacccattggctctacaaaacctctccttacccccaaccgcaggtgacggaggtgtcgctcacggccaactcagaagtcggtgccagacccaggctgcgcttcaattcaggggaggacggcgcagtgaagggggtgggtcggccgccaaccctgtgcaaggacagctcccttgttcacccgccttgcagaggagggaggctcaacatcacactgaaaccttttgaggtgggtcttgtatttgaggaagactctcatggtttgaaagattagtatgagggaatggggtcgagatttggggcatctggggtaaagacagggcacaggtctgcttcaggttctcctgaagcttctgggaactcctctcctgccttctaaagtagcagctgcagggagtgnnnnnnnnnnctttgaggtgagttgtgtgtttgaggaagactcccttggtttgaaagattagtatgggtgaatggggtcgagatctgggggatctgggggaaagacagggcacaagtctgctccaggatctcccgcagcctctgggaactcctctcttgccttctaaagtagcagctgcagggagtgaggttttccatggattctttgtgttcatccatgtcctcccaacatcctacatcctgtatttgaatgtaagaaatactttcacactccctttctgttgctcttacaattgtgcaggttcgtacatttgagctgcgcctcgacagccgttcagccgcagcagcgtgaggagctccacaagaaggcacagtctgccgcagccaggtgcagccgtgaccttcgctacaggacgcgagcctactccacacggnnnnnnnnnntgtgaggagctccacaagaaggcacaatctgccgaaaccgtgtgcagccatgaccgccgctacaggacgcgagcctactccacacggatgcgctgcgcttggctgagcagcttcaggtcggcctccagggcggagagctcgtcctccagtgcctgcttggcgcggcaaagtatgaggagtaaacnnnnnnnnnncagagactttcatgatccctttctgttgctcttacaattgcgcaggttcgtacatttgagctgcgcctcgannnnnnnnnnggtctatgctgcacaaaaaatagcaggaaaggaaggcacacgggtacctgcttggtgcgcaggagggagggcgtctccacgacgcacggaaggcgcatgtaggcggcctgggtgacttggcgcttggcggtcacatgctgcagcagggtggcgacctccttgccatccagttcaaggacctggggatgagtcgtgctgggtgggtcgggtgggcaatcaccttgcacgtcaggccaggagttccgcgcaggaaggctgtgggactagtgtggatttgttaactttcaaggcctcgacccaacactacccgcgaggaggcatcgtnnnnnnnnnnttgggtttgttaactctcaaggccttgacccaacactacccgcgaggaggcatcgtgatgtcgctgagcggcctgggctgactcagcagcagcagctgcccttgcccgtgcctcggcctccatccggcgctcatgcaggtaggcgggcacccgcccgaagtcgggtttgttcaggtagtccatctatggtggcaaaggggtgcaaaggggcattggatgagcatgcatgacagtttgcgactgtggcttggtcaaagcaacatgtgcctttgtggaaaatatctcagcagtcttccagnnnnnnnnnngtggcaaaggggtgcaaagggcattggatgagcatgcatgacagtatgcgactgtggcgcggtcaaagcaacatgtgcatttgtggaaaatatctcagcagtcttccagctcggtgcatacaccatatgcttgcctgaagaggcgcctctgcgcgttgctggagtgggagtacatgcctttgattctctgtaacccagtcctttccactggtctgacccatgagaggtcgctcatgccgggctggcactggaggcctccgtctctcgcgtttcctccggtcttgaaggggatagaggagggggaggggggaggtaattgctcagggactgccctgaagacctcggctggctaacctccccggctttggtgctcagggtctgtacatgttctgcgtcttgaaccctcacctgacaaagtcatctgcaagggctccgaaaggcgagcggcaccgacatgactttttccggccttcatcttagctagttgcgatatggattcccttcttatattcactcgaggttgttctcatcgtttggtcaagagtagtccttcaagtcgcgacatgtgccacatgtcctccggataccccgcgattcgatccccacctatgcaatcgcgtgagcattatttacctacaatgagtgacacatccatcaataannnnnnnnnnttggctaccccgcgattcgatccccatctatgcaattgcgtgagcattattcacctacaatgagtgacacatccatcaataaatgcgattgcattgctgggcggcccggaacaatctctcaccatgttcgctatacttcacatacttcggaacacgtgctccagcgcgctcgcagccccatccccgatccccgtccgtgcattggtagggtgtgtctgcccctcgccccttgacaacccctttcttgacaatcgacatacaccacgatgaccatgttgggactgacgtccaatcgggcgacgagttgcttcaagcacaaccttcccaccaggtaaccaaggcgtttgttttagatgtgtgctcttacctctcgcgaccttacccagcatatctcaagcaatccctgcgtgtccgccttctgcagatcgaggctggtgtcccatgnnnnnnnnnnaaatgaccatgttgggactgacgtccaattgggcgacgagtggcttcaatcacaagcttcccaccaggtaaccaaggcgtttgttttagattttctgctcctgcctctcgcgacctcacccagcatatcccaaacaatccctgcttgtactccttctgcagatcgaggctggtgtcccatgtgtcagtgcgatgtgtggctgcgccagagaaaagtgcgcccgaatgcagttggacagggatacagggggtgcatcatcatgctgacggtttggtatctgacagtagctgcgcgacttggtgccacacaaaccactggctccaccatacatggacatcacacccccacccgccctcccccaggtgaggtgaccacccgcgtcgagcgcaacaagaactttgccaagctgcaggccgggtacctcttccccgaggtggctcggcggcgcagggagcaccaggcagccaaccccgacgccaagctcctctccctgggcatcggcgacaccactgaacccattccccccacgatcgtgaacgccatgcgcgacgccgctatcggccttggaactcgggagggctactccgggtgaggggcgtgggcaccttggaggccctgtggagggagtgcacagccctggcagatttgcctcgaactttgccaagtcatgccttcctcctcctggctgtgcctgtgcaggtatggctcggagcagggtcagagcaagctccgcgaggccatcaccgagcgcctgtatgcccatgtgggcaggaagcccaacgagatcttcgtttcggatggttccaagtgtgacatcgggcgcctccagctcatgtttggcgctgatgtcagcattgcaacccaggtgactggggcatcaaggggttgtgagaggaattgctgagggactgagttgggtgaataatgcttgaatgatgcaggaacttccagaagggcacatgggttgggtgggacacaggcccctgctgtgattgtgacccctgcggtgcatgccagtgcagcaccccttctgcgctgaggcgactgacccccggtgaccctccaatctcccaggaccccgcataccccgtgtacgtggactcgtcggtcatcatggggatgactggtgggcacaatggagaggactttgacggcatcacctacatggtctgccggccagagacccagttcttcccggacctgtccaaggtgagcctgctgccttgtgatggctgaaggagctcgtggctgtagaggcatccgctatgtgggtgcactttctcattcctggttgaatgaggaagggattgaggcaggtaatgcctgtgcaacccaccctgcattcatttgagcacggagctcgccctcacccaaccgcgcctccgtcctccaccctgtcccaggccgagcgcacagacatcatcttcttctgctcgcccaacaaccccacgggagctgccgctacccgctcccagctgacggagctggtagcctttgccaagaagaatggcagcatcatcgtcttcgacgccgcctacgccctcttcatctccgaccccgactgcccccgcaccatctatgagatcccgggggcggaggaggtggcgctggagacgtgctccttctccaagtatgccggcttcacgggggtcaggctcggatggacggtggttccggagcagctgcgatacgctggtgagcattgacggggtgaatggtccctgatggttttactttcctggatcgaaaagaatattccttggagccttttccaagcaactctctaggaaggcgacagggcctnnnnnnnnnnaggggtgaatggtccatgatggttttaatttcctggatcgaaaagaatatttcttagagccttttccaaagcaactctctaggaaggcgacagggcctgttcaccttggtttcaggccatggcccatcacctcaatgcattaaaaccatacaacttcctccttacttcctcagatggcttccaggtgatgaatgactggaaccgggtgatgtccacgatcttcaatggagcctccaacatcgctcaggcggggggcctggcagccctgtctgacaagggctgggccgaggtccaggatctggtggccttttacaaggagaatgcttccatcctcaagtgggtggtgtggatgattgatcttggatgtggcaggccggtatggtgggggcgcacagacgatggcgtgagggattgggtgaagatttcaagcccagggtgtatccacatggaaatggtgtgccttgcactccccaggacccactgggctcaacnnnnnnnnnnnnnnnnnnnnnnnnnnnnnnnnnnnnnnnnnnnnnnnnnnnnnnnnnnnnnnnnnnnnttccaggaccttggcttcacggtgtatggaggcagcgatgcgccctacatctggatcgagtttccaggtgtggagcgtgaggcttgtgttccatgcaatgcactcttgctctctcgtccctgcttgcgtgtagnnnnnnnnnncgccgtgtttaccgctttatgtctgcatccgctagagtttcctcataccataaccctgcaggaaaaccnnnnnnnnnntgccgtgtttaacgcttgcatgtctgcatccgctagagcttcctcataccataaccctgcaggaaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggattgtgttccatgcaatgcggtcttgctctctcgtccctgcttgcgtgtagatgccttagtagctgcagctggacaagccatccagacttcgagcctgtgcaggcgagtctgacttggtgaaccccatcgattctgtcccccttaccccagcccccacacctcctgccttgccaggccgcaagtcctgggatgtgtttggcgagatcctggagcgctgcaacatcgtcaccacccccggctcgggctttggcgcggcgggcgagggcttcgtgcgggtgagcgcctttggccaccgggaggacatcgaggaggcggtgtcccggttcaagaccgcctacaagtctgcttgatcgctgggtctctctgtgtgtgggcggcattgtgtgagaaggagcccccacaccgcgggtcgcatgccaggctctgacacgggttgattatggcattttgctttgtggaatgtgtgctggcctcgctacactcatcagatattgagttgctcgaaggggttgagtgcagtacagattacaagccgggaaggaggaagtgctgctatcctgggcacgatgcaaccagaaacaagttgtcgggcaaattgaggaggcacatggcagtggggagtagccttgacctccgcacgtacacaggagtccaccgaatttccagccgccgacctcccctggcggggaggatggacgtccaccccacccctcagccctggactaggcgattgcgccaagtgtacagcagcgagctcttggcgtagtgccggtcgcgttccatggcggtcaacaggtctggtagggtcagggtctccgtctcctccgtgaccttggcaggtcctccaaacagctttgctcggcccggaccgccctgaacatgcaggcgcagtttgaaaggcgagggggaagcttttgcttgccgcagtgacccatggcagggcgcgatctccgggcatgaacactcatcgtgactaaactctacgctcatggcgggggtacgatcgtccaaaacgacccttacaccgcccccacaacctcaccccaccctcaccgcgcccgggtcctccttggccgccccggcagccgcacctccgaccaccgccggctgcgcgcccctcacggcggccg

SEQ ID NO: 36226 - DNA, 92 bp, Chlorella protothecoides
gtctctgcaagtgacatccaacatcttttgacgacgttgcaagagattgtatgtgcaattcaatctcatgacagcctgaattaccaccaagc

SEQ ID NO: 36227 - DNA, 61 bp, Chlorella protothecoides
gggatccacaccaggtgcaaagtcatcttgtccctcatttgcttgctgaaacagttcgccg

SEQ ID NO: 36228 - DNA, 76 bp, Chlorella protothecoides
gcttaaagagcaattcgctcccacgctttttcatacccaagcactggcgcattcccctccctgcctttccatgccc

SEQ ID NO: 36229 - DNA, 67 bp, Chlorella protothecoides
gagcacgctcacgactctcaaaccttcccaaccccctctttgtcccacagattggcagccaccattt

SEQ ID NO: 36230 - DNA, 85 bp, Chlorella protothecoides
ttgcgacaccagcccagaggcatgtccccgtacgaggacccccccccccccttgtcccggcaccagcctacaccattgccttgca

SEQ ID NO: 36231 - DNA, 66 bp, Chlorella protothecoides
ccgctcctacgtgtttcttgctgctgtaacctggttgacttacactcggtgcaccatgttgaagca

SEQ ID NO: 36232 - DNA, 118 bp, Chlorella protothecoides
tcctttgcgctcttgctcggctacatgatcacacgggcatcgcagaacatgggggggggacggcgctgccgcccacggggtgggttggaaaatgggtggcgcaggtcgttgtggaggg

SEQ ID NO: 36233 - DNA, 61 bp, Chlorella protothecoides
agccttccctgctttgtttggcgtctgtattctacaccagccctgtatcctctgccctgtc

SEQ ID NO: 36234 - DNA, 71 bp, Chlorella protothecoides
cagagacggtgtcggcgtcacggggagacccttcgttcgtatcaatgggaggaggtcccggggatgccatt

SEQ ID NO: 36235 - DNA, 61 bp, Chlorella protothecoides
gaggcagatggcccgctccactttgcgcccacccccccgtaccagcccctctctcacaccc

SEQ ID NO: 36236 - DNA, 61 bp, Chlorella protothecoides
gctcgggccttgatggaagtcgccttcagcaggtgggaggtgggaggggccgcggcctgga

SEQ ID NO: 36237 - DNA, 61 bp, Chlorella protothecoides
gccggtcagctcccagacgccgcgctgcagtgccaccagctctgattttggcggcatgctg

SEQ ID NO: 36238 - DNA, 70 bp, Chlorella protothecoides
gctgcccaagaacaacatgcgcagggtgggtgtatttgacgggggggccaagtagcgggtgcctggcatt

SEQ ID NO: 36239 - DNA, 66 bp, Chlorella protothecoides
tcagctctgtctgccagtgtgtcagcggaacgtccttcctttaaaaagtcatgtccattcttcaac

SEQ ID NO: 36240 - DNA, 61 bp, Chlorella protothecoides
gcgcgacgtgaccgcagcaagccccgccgcgtagccgtgcacttcggagccgggcgggttg

SEQ ID NO: 36241 - DNA, 66 bp, Chlorella protothecoides
acgggcccaatggccgagcaaacgcacagaatgctagctacattctttgagaaatgcagttgtcac

SEQ ID NO: 36242 - DNA, 127 bp, Chlorella protothecoides
tggcgaggtggagcctgcggcgccggcggttgcctgcgcacccggtgccaaccaagaagaccgattgaggggacaaggtgctgccgaggaagctgcaagaagaggcccagggcggtctgggccggcg

SEQ ID NO: 36243 - DNA, 93 bp, Chlorella protothecoides
cagggttgtccagcccctcattcggccaccttctatcgataggaagagcacatgaaatcaatacaataattgcatgtatcactctggtggcgt

SEQ ID NO: 36244 - DNA, 66 bp, Chlorella protothecoides
aggtggcccagccccgcctccaccacctgggaacaaagcaagggcaaaggagggattcagcatgag

SEQ ID NO: 36245 - DNA, 71 bp, Chlorella protothecoides
cagcgccgtactccccgccactcgctgcatcgcaccgcgcctgttgagtgggttgcagggtcggcctccag

SEQ ID NO: 36246 - DNA, 61 bp, Chlorella protothecoides
cgatcagtcacaccttgccgtcccaacccaacccgatgccgcccagctggagatcgaaagg

SEQ ID NO: 36247 - DNA, 99 bp, Chlorella protothecoides
agttgaaagactctgcacgaggagagggtgtgtgggtgaccgggataaagggtggggaaggtcttaccgggttcagacgcagaccgcgccgtgggctcc

SEQ ID NO: 36248 - DNA, 38950 bp, Chlorella protothecoides
  modified_base (413)..(422): a, c, t, g, unknown or other
  modified_base (1032)..(1041): a, c, t, g, unknown or other
  modified_base (1408)..(1417): a, c, t, g, unknown or other
  modified_base (1866)..(1875): a, c, t, g, unknown or other
  modified_base (2248)..(2257): a, c, t, g, unknown or other
  modified_base (2499)..(2508): a, c, t, g, unknown or other
  modified_base (3029)..(3038): a, c, t, g, unknown or other
  modified_base (3103)..(3112): a, c, t, g, unknown or other
  modified_base (3639)..(3648): a, c, t, g, unknown or other
  modified_base (4298)..(4307): a, c, t, g, unknown or other
  modified_base (4801)..(4810): a, c, t, g, unknown or other
  modified_base (5020)..(5029): a, c, t, g, unknown or other
  modified_base (5420)..(5429): a, c, t, g, unknown or other
  modified_base (5648)..(5657): a, c, t, g, unknown or other
  modified_base (6061)..(6070): a, c, t, g, unknown or other
  modified_base (6155)..(6164): a, c, t, g, unknown or other
  modified_base (6294)..(6303): a, c, t, g, unknown or other
  modified_base (6696)..(6705): a, c, t, g, unknown or other
  modified_base (7238)..(7247): a, c, t, g, unknown or other
  modified_base (7304)..(7313): a, c, t, g, unknown or other
  modified_base (7956)..(7985): a, c, t, g, unknown or other
  modified_base (8049)..(8058): a, c, t, g, unknown or other
  modified_base (8388)..(8397): a, c, t, g, unknown or other
  modified_base (9025)..(9034): a, c, t, g, unknown or other
  modified_base (10622)..(10631): a, c, t, g, unknown or other
  modified_base (10745)..(10754): a, c, t, g, unknown or other
  modified_base (13474)..(13483): a, c, t, g, unknown or other
  modified_base (14841)..(14850): a, c, t, g, unknown or other
  modified_base (15611)..(15620): a, c, t, g, unknown or other
  modified_base (16621)..(16630): a, c, t, g, unknown or other
  modified_base (17016)..(17025): a, c, t, g, unknown or other
  modified_base (18121)..(18130): a, c, t, g, unknown or other
  modified_base (18426)..(18435): a, c, t, g, unknown or other
  modified_base (19394)..(19403): a, c, t, g, unknown or other
  modified_base (19476)..(19485): a, c, t, g, unknown or other
  modified_base (19562)..(19571): a, c, t, g, unknown or other
  modified_base (19667)..(19676): a, c, t, g, unknown or other
  modified_base (20196)..(20205): a, c, t, g, unknown or other
  modified_base (20515)..(20524): a, c, t, g, unknown or other
  modified_base (20887)..(20896): a, c, t, g, unknown or other
  modified_base (22741)..(22750): a, c, t, g, unknown or other
  modified_base (22936)..(22945): a, c, t, g, unknown or other
  modified_base (23019)..(23028): a, c, t, g, unknown or other
  modified_base (24172)..(24181): a, c, t, g, unknown or other
  modified_base (24285)..(24294): a, c, t, g, unknown or other
  modified_base (25871)..(25880): a, c, t, g, unknown or other
  modified_base (26189)..(26198): a, c, t, g, unknown or other
  modified_base (26497)..(26506): a, c, t, g, unknown or other
  modified_base (27040)..(27072): a, c, t, g, unknown or other
  modified_base (27921)..(27930): a, c, t, g, unknown or other
  modified_base (29118)..(29127): a, c, t, g, unknown or other
  modified_base (29570)..(29579): a, c, t, g, unknown or other
  modified_base (30000)..(30009): a, c, t, g, unknown or other
  modified_base (30566)..(30575): a, c, t, g, unknown or other
  modified_base (31426)..(31435): a, c, t, g, unknown or other
  modified_base (32319)..(32328): a, c, t, g, unknown or other
  modified_base (33570)..(33579): a, c, t, g, unknown or other
  modified_base (34058)..(34067): a, c, t, g, unknown or other
  modified_base (34418)..(34427): a, c, t, g, unknown or other
  modified_base (34671)..(34680): a, c, t, g, unknown or other
  modified_base (34771)..(34780): a, c, t, g, unknown or other
  modified_base (36106)..(36115): a, c, t, g, unknown or other
  modified_base (36193)..(36202): a, c, t, g, unknown or other
  modified_base (36649)..(36658): a, c, t, g, unknown or other
  modified_base (38774)..(38783): a, c, t, g, unknown or other
cgccgccgccagggccccccttgcgccgcggcgcgtccaccacgccgccgcccgcgccgtcgtcggtgccggagcccgcgccgccggccagctcctgcgccaggatgcggcggtacagcgcgcgcaggtcgggctcgggcgcgatgggcgcaaagtcgccgccctccgtctggtacatggccatggtcacaaaatcatcctcgctgatgcgcctgcgggtttgtaattgttttgggggggaggggtgttgtcgtgggcaatcgggtgctgcggaggactccgaccatgacgcaggaggtcagggagtgcacagccgcactcctcctcgcccctcttgcttcccatgggtacccactgcaggccagctagcaacagcacacgacccattcttggcgagccccgccaccagagannnnnnnnnntttgggggggggaggggtgtcgtcgtgggcaatcgggtgcggtcgaggactccaaccatgacgctggaggtcagggagtgcacagccgaactcctcctcgcccctcctgcttcccatgggtacccactgcagaccagccagcaacggcacatgccccattcttggcgagccccgccaccagagacattccccaccggacacaaacacatcaccacacctgtcggccatggggttgtgcgcgtcggtgttcagcatgatgatggcaaaggagagcaggtacgcgccgtccgtggtggggaaggcgttggggttgcaagcgcagtaccgcgccgcaaaggcctccatgatgcggtcgatcttctgggcctcgccggggagcctggggtgcagaggcggggtggtatgtggtgggtggctatgtttggatgatgcatgcctcgttgcatcgtccggggccagcattgccggcctgcaatgtcagcctctgtgccaagggagcgcacggcacatgggaggacacgacagactgcatagtaacagccccccagctcgcctgagacctgccaccatcccctgccatacctgaagtcgacgaggagctggcgcagtnnnnnnnnnncgtatcgtccggggccagcgttgccggccagcaatgtcagcctctgtgccaggggagcgcacggcacatgggaggacccgacagactgtatagcaacagccccccagctcgccggagacctgccaccatccactgccgtacctgaagtcgacgaggagctggcgcagtgcggcatccagagtcatctcggtgaaggcctgagcggcaatgaactcgtgcatgacctgggaaggaggacgaggctcgatctgtcagagtctgtgtcctggccactcacgtcgtgcatcaccggcgggccgtgcgactcatcgagggacagcgatggcggccgtcaccaccaaggatgcctgttgagcgccagggttcnnnnnnnnnnctctgaccactcacgccgtgcatcatcagcgggccgtgcaactcatcgagggacagcggcggcggccgtcacaaccaaggatgcctgttgagcgccagggttccctgacgccaaagcttgacagcctcaccaggctcgagcaccggaagcccagctgtggctcaccgtcatctcaaactcttcatggtgaccaaagtactcgcccagggcctccttcttgagacgggggccatgctccctgaggaatgctgcaacctcgagcgcgctaggacccaccagccccgactccaccaaccgccgcatgcctgagcgaggaggccgagggagtgtatggctgctcggtggtgcaggacgctgtcaactgcgagctttgacactgtaatagcagggtcatagcgccccaggacagcgctgggcccgccttgccaatgcccattctcccagcctcnnnnnnnnnntgcgaggacgccgagggaatgcattgctgctcggtggtgcaggacgctgcccactgcgagctttgccattgtgatggcatggtcatagcgccccaggacagcactgggcacgccttgccaatgcccattctcccagcctcccgacacgtttccctgttcatgcagcagcttgtcgtgcctttgatgggattggcattgaagtcgtcaatcccagtctgcagggtggccttcatcagcttgtcagccacaatccgatccagttcctgggttgtaataagagtatgtgatctgagctcctgatcagcaatgctcgtgatcataagtgctcagatggcagttgatcgcgccaagtcccagcattgcacactctggnnnnnnnnnntttgtaataagagcatgtgatctgagctcctgagcagcaatgctcgtgatcattagtgctcagatggcagttgaacgcgccaagtcccagcattgcacactctggagagcagccttgccctgaggtaggcatcccaggaggagttccagcccctcccacagaaatggccccaaagagttgagcacatcgcacccccctcacctccaccaaggctgggcgcagggacgcagctcgctcgggtnnnnnnnnnnaccccaaagagtagagcacatcgcaccctcctcacctccaccaatgctgggcgcagggacgcagctcgctcgggtgaggcctccccgctcgcctccgcctcctcatccacagagtctgtgatggcacgtgacttgatggggcctgcccatgtgtccagggaggaaaccaccgccaggagggcctgattcatggtgacagaggaaggtggagctcggtaccatacatcacatcctgacgaggcatagagaccctggcatcatcccctccagctggcacatgaaccaagcgtgaaactcaccctcctcgcaccagaacgtcaaaatgtctcccctcttctgacaccaaacctctccccaccttgagcgccgcctccttgagccgcttggtggctgcaggcggcccaaagccttccgaccccgtcaaggaagccatacgacccagggcctaggtaattttgggaggaggaatggggggcaggggctgaataaggacgatgcaggcccatgaaagcaatgtagannnnnnnnnntcacctgcatggcctccattatttgttcccggcactctcaccttgatactgcgctcgtacaggtnnnnnnnnnngggtaattttgggaggaggaattggcggcaggggctgaatcaagacgatgcaggcccatgaaagcaatgtagagtttcgcgccatctggaccctgtcatgaggcgacgtccatgagcttacggctggggccactgtggccacctgcatggcctccattatttcctccctgcgctctcaccttgatactgcgctcgtacaggtttgatgcctggagtgagcagtcgtagttgacaaagacgtccaccagtatctggcatggcaggaaagacaggaaagatcatggtggctgggccccaactcatgcttcatatgccccaccagtgcatgggctggaaaaacaaacttcaacaacgacgacgtcttgctctttctctatagtgcctcgggtgcttgagtgtctgcatgatcaactcgtccaaacaatgcattttaggaccaaaagccttgggctgctgttcccacacgctctccctccctccccccctccctgaacaactcctgacctgaggtgaggagcagatgggcnnnnnnnnnntgctctccctctctccccccctccctaaacagctcctgacctgaggtgaggagcagatgggcagcaggccctccagagcagcctccgcctggaacacgctctcgggccttgggggcagaggggcgagcgtggctgtctgtgacagacagggttttgcctttacatgccagcgcagggcggtagatcccaaggccaggccatccgcatgtgcgatgcctgaaacccctcacaccgtccatccaacatcctcccacccccatttcaccccaaataccaaatcacctcgcggcctccaggggtctgaggaggaggagcgggtacagcgcccccagctccgcccgcagcccggcgcggaggcgcggcgcggccgccagcgcgcagagtaggcgcaccgcggcgcgcacggcctcgtcgaagggcgacatgcagttgcgcaggagcaccaggcacagcggcgcgcgcagctcgcccgcgaactcaggccgcacgcccagccagtcatgcagcgggtcgcagagcacacgggtcagcagttccagggccagcagcttgccctcgtgcagtaccgtctccaccgcgccccacgaagtttcgcgcgcgcccagctgtacagggggggggggggggttaaaaagggggggggggggggnnnnnnnnnnatgcagcaccgtctccaccgcgccccacgaagtttctcgcgcgcccagctgcacagagagggggtgggggtgggtgtaaagagtgtgcggaggagggtttagagagtgtgcgcggggatgggtccggtttctgataatcgcgtgtgcaacagggccgccgcccaccttgcacatggcccccaggacggtgatggcgtcgcgctcaatggtggtgagcaggcgccaggccgaggcgcggcgcgagtgcatgagcgcgcggcgcgggtctggcggcgtctccgccttggaccgcccctcgtcgcccggccgggggccggaggccggcagctcctccagagcgcgctccaggccccgcaggtcggcctgtttggaaaggatgaaagtttgaatgggggctgcataacaacgcgatgatcaggtgcagagggtcaccggcagatcccacagggtgataggtgccaaagaagaagatgcggacgtggctggcctctccnnnnnnnnnncttgaatgggggctgcatgacgacgcgatgatcaggtgcagcgggtcaccggcagatcccacggggtggtaggtgccaaggaagaagatgcggacgtggctggcctctcccggcaaagtcccagcacctttttcccctgcacaacaaacagccatttcttcccccaggaaagtacaatgtgtcccctccctcccagcacctgctctgccnnnnnnnnnncctcccctgcacaacaaacagccatttcggcccccaagaaagtacaatatgtcccctccctcccagcacctgctctgccatggtggccatctgcgcggtgcggatgtcctctcgcgccatgctgcggctgtgcagctcgatggcggcggtgggcgtggcgatgggcgccagctccgactgccgcaggtcggcggcgctgggcgagccgggcggggagggcgcgggcgcgccgggcgccgccacctcgcgcgactcgctggcagaggcgacgcgctcgccccaggccagcgccgccgcctcgagggtggcagggtcgtcctgccactccgcctcatcctcggcatggtctgcccggtcggggctgggccggccagaggccggcgacacttcnnnnnnnnnncgccactccgccccctcctcggcatggtctgcccggtcggagctgggccggccagaggccggcgacacttccgaccccgggactcgctgttgctcgcctggctttgtagactcgtccccggaccttggccctgccccttctccatcagcgcgtggcggtacggcgtcggcgccggactgcggcgccggggcgccctcctcatccacgctctccagggcnnnnnnnnnnaaagtctgcgccggactgcggcgccgaggcgccctcctcatccacgctctccagggcaggagggtaggggtagggcgtcggcagcgaggcctgggaggtgggcgtggacatgcgtcggtgcagggtcggagcagggccgcccggcgacacgcccatgggtgtctgcgatgaggatgagggaccgatggcgcgaggggcatgaagcaggccttgcagtggtggaccagagcacgcgtgtgggaaggcctgtaccacagctcacagtcgtgaagttcttggggagcaccgtcctgggggcttggcccctcgcctcccaacggaggcctccaacgctgccttgctcacgtttgctgggccccctgaccctgacactctgcccccggggccaaactatccacagcccnnnnnnnnnnaaggcctccgacgctgtcctgcccacgttcgctgggccccctgaccctgactccctgcccccggggccaaactatccacagcccnnnnnnnnnnggggaccgatggcgcgaagggcatgaggcaggtcttgcagtggtggaatagagcgcgcgtgtgggaaggcctgtgccacagctcacggtcgtgcaggttttggggagcaccgtcctgggggcttggcccnnnnnnnnnnctcccctcccctcctcacagcccaccatgacttggtggtccacccgcttcagcacggtgttgagcatctggaggagggccgacttggcggtggcctggatgcctgggtcggaggagccgatggccaagttgaacaccgcccgcacagcctgcatgaggcagtcgccatgcggcacaaagtgctcggccgtcacggccgtgagcagcgcgcggaccatgccaagctggacggctggcgtggtggacacccccgtccttgccaccatggtcaccacctgggggggagcggcgcggaaggagggtgcagggggtctgctgcgggggggaggcgatccaggccggcagcggggctgcacagtaggcctgaagagcccgtccggatgacagcagcggnnnnnnnnnncgggttctgctgcggggggagggcgatccaggccggcagcaggctgcacagtaggtctgaagagcccgtccggatgacagcagcggcgcacagcgactgtggcagtcctgcgcccagggcacccacatgcaaacactgggagcgcctggtcctcttcgaactacaatacttccctctacagcaccacgtacctgggtgacgatggtgccatcatcgccacgcccgctcgaggacgactcgccctgcagaaaagcgtgcgcgaccagcttgtgcagcgtgccgagggccgggtccatgatggagggggcgccgctgctgcaggccgcctgcagcatgctcaccagctaagcaacagataaagaggggagagatgagctctgctgtgcagccgggggcgcaggactagcagcgctgagcaggggggggattgaaagctttgcatgcagcggctccacatggtatgcataggagacttgattgtcacaccattccacctgtcctaatttgcactttcagcaggctaatactgctcnnnnnnnnnngaaggtgagtctggctgcatggaccccgatcagtatctcacgcccaggaccagatcnnnnnnnnnncatcctcactcaacacagctcccaacccacccacctcctggcaaaggggcgggggcaggatggggtctccaggctgcagtgtggcgtgggaacctcccagtgaatctgtaggaccgggaaggtgaggatcagctgagtctggctgcatggaccgcgatcagtatctcacgcccaggaccagatcactatcaggagagaccggcacctcacccagcagtccttgacacgtggcgcgaagctgcttgtgttgtctagatgacgccaggtcatgtatctggcggaccgactgggtcacgaacacctccagattcactcctgggcctcgggaggggtgggccatgttggcacggcccttgagggcctcttcaccttgggccctcctgggtcctgtttcacggagcttccaatgccttcatcgctgattatagtgtatgaccacatacacgggagcgtgcgtgggaggattaagcttgcatggaagcgccaggtgcccgatggggcgatgcgagccagcagccgcagcatgggtgcatcaagcacttcaccagaaagtaataggtggaagcctcgcgaactctcattcggtcacaacattcccccctgagcctccttaaaggaagtcctgtcccacgtcgagggtttnnnnnnnnnnnnnnnnnnnnnnnnnnnnnnaagaaggaccttgaggcacctttacctaaacaggtttatctgagacctgtagtgtacgcacgtnnnnnnnnnncctgtggtgcaaggcgccaggtcaacctgagggtcaagtgggagggctgagaacggctgattagaaggaccttgaggcacatttaccgaaacatgtttatctgagacctgtagtgtacgcacgtcgcttcatacatccccatcccctcaacggaagggtcactcacataccatgtaacactggttactgcaagagttgaaagaatggaggacacatacgctcggtgcatttcttcatgtttaaaaaaggacgagtcgggtttatgaagttcatttgagagtttctatgaaagcaatgaagttctcaaggagaagtgatgatccttcacannnnnnnnnnagctcggtgcatttcttcgtgtgtaaaagaggacgagtcgggtgtatgaagttcatttgagggtttctaggaaagcaatgaggttctcaaggagaagtgatgatccttcacaatcgcaccgaccaaggatccggaggaaatcatctccacttccggtgcgcgaggggcaggaatcggtcacagtccgtagataccaccaaagcacgtcgaaagacagtgaagccttcttgatactcgattgttaccccatttgcgcgagttgacgggagcgacaagcttgttctgaccctgggcaccctcaccaccagcaacccaacgccagcaaacgcggggcctcccctgcacttatctacgataattggcaggctgcacgccatgatttcaagcaataccccttctcccgaccgcaaggttgggcggtacgatcccatcggccacaatccgcggaacgaccgtgctggtggtggccagaggtcggaggatgagcaggacctccaaaacttcatcaaggtgcggtctaggactcttgatcctatgttgaacgatattttgagcccttcatgctgcggagtgggtcaccgagctgcccggccttcgtctccgtgtgcagatctcctcccgcgaggannnnnnnnnngaacttcatcaaggtgcggtctaggacgcttaatcctatgttgagcgatatactgagcccttcatgctgcggagtgggtctccgagctgcccggcctttatctccgtgtgcagatctcctcccgcgaggagccaaagcattatgcttccaagatagcctggaacgcccgtggtgaccgccacatgcccctcattgccactggagccccagccatcaacatcgccatcaaggtgcgcgcgtgtgttgtccggacgctgggctgaacgctgggaggacgctagcctgggtgagccacccccctttgcacctgaatatcaacgcacctttgcgccacacccacaggctgtcgccatcgctcggaagtaccttgagaaggacgagctggagctcatgtgccagcctgccttccgggacaggtgcggcgtgtatggcgacaatggatgatggtgcctggggtggccaccctacatgacctctaccctgcccggtccccatcctcaaagtgtcctttgacccgactccgcatgcaggaagatgggagcgtcccttgccctctacctctcctccgtccccgccgctgagctctccgccaccctgaactccgaagtgagccttccggtgtgacatgccaaccaccagctgccatacacgcaccttcctccaccctgtgcttgcctctcccaaccagcgccgctcaccctcccaccatccacgcccccccaccgcccacgccaacgcctggcccgtttcccacccaccacctgccaccccaccaccttgcatgcgagcagtttggggagctcaccgtcggcaagaacagcaagccacagacagtcgccggagccatcgcgggcagggtgagcgtgaatgtggattggaagctggagaatgggacttggggactgggtgcatcaatgactcgtccgccttgctgccccagagctgtcgaggggaagcggacggctccctgccaagaagcggcgccgaccctgctcaggaatgggtgctcacaagccatactgcaccaagattgcccacccttaccccatatgttgcaagctcaggctcgcgatgggacgggggtggtggtcaccagcattggaccggacgcagtgtgcaacgcatgcgtggcgacctgccacgcccggatatacctcgaggtgggtgtgcgcctcacccctgtgcaccctgggatgttgtattgctggtcaaggccatgtgcgaaccgtgtgcatgctcgatcgcaatccttctggtcgctgggtatgctgatgatgccgtcgagtcaccacgcacctacatgtggcggctgccccaccccccttctcggcaatcctgttccgcaggacgacaagatcgatgtgcgggcgatcccgatctttgaggaggtggagaagacgagcgtcgacgggtccatgcacaccatgacggccctgaagctgaaggtcctcattgaaggggtgcaggacagctgaagcagaacaagagcgcagaactctctcgcattcctcaagaggtggcctttggcgaggcatacaggcgaccatgcactgcatcctttcgtgacacgcatgcacagcaccagtcnnnnnnnnnncattgctggtcgaggccatgtgcggaccgtgtggatgctcgatcgcaatccttctgggcgctgggtatgctaatgatgccgctgagtcaccacgcacctacatgtggcggctgnnnnnnnnnnggcgcagaactctctcacattccccaagaggtggcctttggcgaggcatacaggtgaccatgcactgcattctttcgtgacacgcatgcacagcaccagtcatcgcgacatttcgacgtgtgatctggaggtttctttttgagatatttgggcaaggcagcagttccggggacaaaagagcgcagatcgtgagcgatggggaactcccgttgaggcattggagtcggtgtctcatcaccgctcctgctcactggtaccctgtaagcctcactatcagcgtcgtgttgtctttcttgttcgtcgcgtggtcctagaagtgcccgttcctgaattttcgtccagtcacggaaacgtcgcaccactccgccatgagtttggcgaatgtgctcctccgcaagcactccaccatcgcggccgtgctctttccagtcagtgtcggggttgggttcttctacacagtaaaaacgggccgaactgcggcggcaggcctgcgcgaggctgtcacaggtgcgagaacgtgcggtcttccgaaacaaggggccgtgacacgcctgcgggctttgctcgggaacatggggcatgcgaggtaacagcatgctctcgggtagctcgggagcacgcagtgtgcactggccaatgcgattctcccatggaggctgacgcggatttggacctgacccatacctgtccaggcaccagcggagaggaggaggtcgtagcccccatccgagcctactccatgcgctttcggtagacccgcctttcataacgggctcgaagccttccgtcaatgtattttgcagctctttgctgcctgtttcccaatgttcctcctgtgtccagcaattttcaaccatgctgatcaagttttgaggcgtcttcaatccacacatgacattctgggtcataccccaacatttttatgagtgagcggcccccccgacggtgggctgccttttcgattttcaatgatgtcaaccaacttgcacacttcttaaccggcccaattttcagtctgctgccgcatcgtttgtcacgtggtgctgtttaaggggagccgagctcctcatgttcaattaatcaagtgtaaatctggaacaaagaagtggtgctgcgaggcagcaaaagggtgatggcatggatcaggccagggttataaaccagactgtcagtacgattgccgtgcaaggggccaatgggtcgccgcttgatgacctggttgcctacatggcgagagcttggatcgaggtctgggccccagcccttgctgcaggcccacccgagtgcacacactgcatgccagccatcagggcggcccgctgtggtgctgggctcatccgctgggactcctgccgtacttgctcttccaggcgcccttgccgcccggcacctccaggtgcgagaagatgtcgcgctgggcggacgtgcgcggcgtggcctggcccacctgcggtgacccctccaggtccagggacgaagaggagcccgcccctgcgcccccccgcagcagggactgggcctcgggggcgggggacgcccggccggccacgagcgcccagagccgcgcgcgtgcgtccttgcccgcgccgctcctcgcagcctcccccgagctgacggcgcccaggtttggaggagggggcgaggggaagccgtggtcgtcgtgctcccgcccccccgccagccgccgccaccagggcgcccgctctgccggtgcgggcgggccagggcggctggcggccccgctgccgttgatggcggggtcgatggtgaggcccagcggcagcccgttctgccggttctggccctcgactcggagcaggcgacggccgcgggcggcgacgccgctgccgtcctcccagtcgtcctcaaactgcggggagggtggggtggagtacgaaaagcgcattgcctccccaacttgagggcgcgaggtggaaggggtgatgtaggagacagggcccccgggaagacacccatcagaatggcaaggcgctcggcctgccgatccctcggtcacccagctgccacccccagcatcccacctgcaggctgccgccgcgctgcagcagcctggccagggggttaaagagacccagggccaggaccaggcagtagggcgccagggcggcgggggcaaaggcggtgaaacgccagccgatgaggggctgctgcatcatcagccgcccgaactcggcatagaagacggtgtcggtgacatccggcccagcggcccgtccctggggcagcgccaccgcggccatgaagttgaaggccaggggcgaggcgaagcgcgagacgagcagcgcggagtagcagagggagtaggagtcggtgtggccggggaccatgcggtagaaggccacctggcccaggcggtagagggagtagttggcgcaggcgcaggggtaggccagggccagcatgcaggtggcggcggtggggaagcgcgcgccccccgccgcgcccagcgcccacgacaccgccgacaggttgggcagggaggcggggatggtggtctccgccaggatgaccaccagcgaggcagcgccggccagcaccgccaggatcctgttggttgttgtgtttcatcgggggggtggggaggggcgagccgagcggagtgggcggcgaggggggtggccgactctatgggaggagccccgcttcaccactcctccgcacacgtccctgtgtgtgctgaagagcctcacccaacacannnnnnnnnntgcttcaccactcctcctcacacgtctgtgtgtgtgctgaagagcctcacccaacacagacacactcccacacacctgtaggcccagaagtggacggcggcgtcctgcagccagccgcgcaggcccggctcggtggcgaaggaggggccgtgcgaggcggcgtcggcgcgggccgccagggaggcctccaggcgcaggccgcgctccgcggcggcgcggaagagcgcggcctcgcgctcgtggtccttcaggtcggtcttcagccggcgccgcagcgccgccaggtccgccaggtcgaagatgtccagctcgggcgagtcgtccagcgcggcgaccgcggcagggttgggccggaagcccgggcctgagtgtttcggggagggcgagggggtccgggtcgaatcgggatcggaatgaggcacctgaggttcgacacgtccccgccctaggggcagcagtggaggcagagcaagcatcattcatacagaaggtgcacgagggtctgaccagggcgggacgcgacatatcggtgccagcgatgggcctcgctctggcgcccgctttccctcacatctccacgccgccttcaacccccccacacacccacacatgccctccctccaaccccacccgtgctctccgccagggcgagcaccgtgtcgacgcagggcctgagggggtcgtgggcgccgaagagcacgctagcccgccgcgcggtgagcacggtggtggagaggcgcaggttggcggcggcgcagcgctcggccagcgcgcccagctcgtggcagcaacgctgcagctggtcggccaggtcggcgcagcgccagagctggcgcgggatggccaccaggccatagcccatgaggaagatggcgccgatcaggccgtaggcgttgctggaggcgatgcagaagcccaggatgttgcgtgcctccagccgccccgccagcaggagcaggaggatgccggacgcggccacacccaccagggcgcagtagtacaccaggtggtaccgcaccgcgcccagcgcgcggtccagcgcggagaactctccgcgccgcgtgtgctccatgtggatgggcagcaccagcaccatgacgaagaagccgtacctgccgggggtgaggaggaacgaggaggacaggatgctgagcgtgtgagtatgtgctcgcgtgtgtatggtggagagcatttgagtaagagacaatggcaggcagcgccagattctattaaaataagctgcccagggaagtggggcaccccatttccccaaggcgcctcgctgataagcgcccgggtccacgcggggtgcactcttccaatcacacttgtaatgcgcccacgcaccagtaggtcgnnnnnnnnnngaagagacaatggcaggcagcgccagaatccattaaaataagttgcccagggaagtggggcgacccacttccccaaggcgcctcgctgatgaccgcccgggtccacgcggggtgcagtcttccaatcacgcttgtaatgcgcccacgcaccagtaggtcgccctccaccatgtggcgagctggggcggggagcctcccagcagcgtggttgcaacgtcggtgggcaccaggatgagcgtggccagggccgcaccccaggccagccccacatccaggcgcacgaggaggcctgtggaggggctgggcagccataccaggccgtacacgacggtgcaaaccacgaggggcagggccacggcgtagaagaagagcatcatcctgcccttgagcccagcggagctcgccctcgcacaaatgtcacatggcacagagacaatgtctctagtcgaggaggttcgcaggaaaaggtctgcggggcagtgccgacccgtggtccttgtgtcgatcggtcggtcctcccggagcaacctgcttgacgcgccctggcgcttgtcacggaccggggggcattgatctagcctgcaggcaggggcacacatttgcctcaagtatgaagctccacactcttacagacgagatgaagatgtaagatataatttcattattacgggtaggtaaatgctggccgttgtgagtacttgacatggaaacctggcaagcacccctgtccacggcaaggccagggcaagccgctccacccnnnnnnnnnnaagttgctggccgttgtgagtacttggcatggaaacccggcaagcacccctgtttacggcaaggccagggcaagccgctccacccacaacccctccctgcttcctcagccattctcctgctcctcgtccttcatgagactggaagcgccagcctcctgccgtctggagtatgcatttgccttgtgctttggcgtgaacgtgaaaccctgcaccagagtgaatgcgggactgaggacatggttgctggctcatcattggggtcggaattgtctcaaaccgccctgtccacatgtcttgctgcactccgttcctgagagacacgcatgcaatccctgaatacatcaagttgctgactcgctcccttttattccctccctccgttccaccgctgaccaaacgcacacacatatgtgccatttactcaccgggggtgcagggcccagcagcatctcggagatgcgcacccagtcgccggcgtggtcggaggccagcagcgtctccaggtcggatctgcccacgaagaccggcaccctccagtccatgcgctggggcagaacatccagcaggccgaccgggatgtagcggtgctggaacgacagccactccagcaggaagcgtctgcatgcatggcaatgggagggagaggaagggtgtggggcatagggtgccattatacatgcaatgcccctcagagggtggaatgggagagtgccggcacccgctcccacatgcgcacctggtgctttccacgccacgggcgtcgctgccccaatgctctagcccaaacgagcagtaaagcttcagcaggtccagtctctcccctgttggggaggagggtttgcttgatgagacagccgagagacatatttcagacaaaaaatgcaacaaaaaccggccaagtccaaagggaagccggagcgcccttggacaagctgatcccaaagaaaaccatcagacttgtgaggctccaccgatctgcctgcgccccagccccaagcacnnnnnnnnnnagatgagacagccgagagacatattttcgacagcaagtgcaacaaaccccggccaagtccaaagggaagccggagcacccttggacaagctgatcccaaagaaacccatcagacttgtgatgctcctccgatctgcctgcgccccagccccaagcacctgctgagatgtcccagtccctccgctgcttgatctcagtgaaaatccagggcttgatcagggccccacgcgcaatgtatgtggtcgccagcctcccacccgactcttccagatgcctaattcatggggtgggagtcgagggggggcagattggtgaggggctgctgtggtggagaggggtcccatcgtgcttcctgaagatatcgtcacacagactgaagcactcttnnnnnnnnnnaagggggggcaaattggtgaggggctgctgtgatggagagggatctcatcgtgcttcctgtagatatcgtcacacagactgaagcactctttgcgagcagatcaatgcacccagacacccacaaatctgttcaggcggcagcaacatggacaagcgcacgagcacagtggcgctctcaacccgcacctgtagtggtcctgccagcccaagatatccccgttcccgatgagttggaggggcgcctgggtcgcagcggcacagttctggatgtatggccagtcggctggcctcgagtagcgctgctccctcgtccggccatgcagggtcacggcgctggccccccagaccgccgcaccggggacaaaggtgtgggctacatcatgcccatcattgtacgcctgtgagcagcatgcaggagaggggtcttgcacaggatgcctgaaggggaggaaattctacccggtaacacgccggctagtggcaggcatggcatacgtttgaagtgggctacatcaccttccccatatttcccttccagccctaccaccagcccaccttgcgtgtcttgaaggtgagggggcactgcagcacgctgctcacgctccgcacaatcgactccatgcgtgctgggcgcaggatgcaggccgaccctgcccccttgctgcggaagggaagtcatgctgatgtgagtgcagggtcaggctgcatggcgctgaatcgggcgtgccgcaggcggctcgattcgttgaggcatagatgctcctttcagatggtgcccctctcgataattcgaccccgaaactctgcaaagcgcctgccaccccacctcctgcagcctcacctgcagatcgcatcgatgggacacccaaagttgatgtccacaaaatcgacagagcactggtcttggatgagctgggcacagcgggccatgctgtcagggtagcctccacagatctgagttgggcagggaggatgggttggtattttcaggtgcaggctcatcctgcttcatctgtgcagggatgcaggatctggcaatcgccaggagtgcgctgtgttgaaaagcgttcatgtaccgcatgcacagcagcacacnnnnnnnnnntaaaggaggatgggttggtatttacagatgcaggctcatcctgcttcatctgtgcaggaatgcaggatctggcaatcgccaggagtgcactgtgttgaaaatcgttcatgtaccgcatgcacagcagcacacctggaccccgaagcagtcctcgtccggatggcgcctcagcagcgcccactcggatgcttgcccctggatcagtgtgaacggggcgagtctcgcccccagtaacctccaccatcctgcgagcagccccgcccacgtacgctctcactctgctttgaacatgcagnnnnnnnnnnagatgcttgcccctggataagtgtaaacggggcgagtctcgcccccagtaacctcaaccatcctgcgagcagccccgcccatgtacgctctcactctgctttgaacatgcagtgcgaggttatctggcctggatcatccaccaacttcacctcacctggagtaagttcgtggccagcgccatctcaccacaggtgatgtcggcccccaaccgtttggccaggcggcggaagggtaggttgcccacagtggtcagaggtgccaggtacagcttgccacggaagtcgattgcccgtgccgagctttcgcgcttgtgctcggcagtttccaggtaagggtgctgcggaggcggcgcggccgcaggagcggccgtttcgggctccgtcacagggatacccagctccgccccaggccctggcgcagtctcagcgggtactgtgcacagctgtgcctcggcctccactttggcagtgggaagcacctgcgccgctgcaagctcgacctcaggctctgcctttgccagcacggcctcccccggcagcgctccagcgtcgggaccttgggtacgtggccgcttgccctcctgtccctcctcctcctgcttcccctgtccctgccccgcccgactgttccgcaaccccaaggtcgacagcacacggtcagctgtactgaagtcgtagcggcgatgcctgacgggagggcgtgtgggttggggaaggttctgatggagcctttgagcaggttttcggactcttcctggaactagattgacaggagattcatgctgggagtgctcacggcagcctgtgccagcaacatcagtccttctttgccacggcaggacggctcaggctcagtgaagattgcagctttctgcccctcctctgctccaatgcccacagcacaccaagcagaatgtctgtgttatacactacaagaaccccacctaccacaactggtnnnnnnnnnnggggttggggaaggttctgatggagcctgtaagcaggttttgggactcttcctggaactagattgacaggagnnnnnnnnnnttgctccaatgcccacagcacaccaagtgaaatgtctgtgtcataaactacaagaaccccacctaccacaactggtnnnnnnnnnngacatcgtcttgctcggcaggtgtggagggctcgggaaaccccgtgccagcagcggacgcccgtgcagcctccacctggcttgctgtcggatctannnnnnnnnnccattgtgttgatgctactctgaatgcttggacctggcagcagcgccacagggcgcatgggaatcgtcccatcaccccgccagaaggcctgggcagctccatcaacatcgtcttgctcggcaggtgaggagggctcgggaaaccccgtggcagcagcgggcgcccgtacagcctccacctggcttgctgtcggatctacgggcgtgaggagcgggatcaccgccgcactggccccgtccaaggcagcagcgagcgcctctgctgtcaccacaccatttttgtcctcagtcttcaagggcggggccactggcagaccggtgacagatgccgccacgggcgtctgttggaggtactctgacgtcaaggggtcggggtgcgaatgcttgctggcccactggcaggtgatgcctggttgtggggaggagaatggacaaaggataaggacactgaaaaggagtgtgcacgacaggcaggaatgggcagcagcccaggagtggtgtgaaaggcccccatgtgctgnnnnnnnnnngaaggataaggacaccgaaaaggagtgtgcaccacaggcaggaatgggcagcagcctaggagtggtgtgaaaggcccccatgtgctgcattctggtgtatcataattttcagaaacttaatcaccacagcaaagcccatcgactcaccaaagggacagctgccttgtgcgtgaaaagggcattgcccagggagttctggtggcttggaattcaggaaggcccgcacatcgtggttgaacctggaatgcaggatgggtgcacagtggaagaacctggtcggttgccttgccacatgagaagccctgcctgnnnnnnnnnnaatgggtgcacagtggaaggatcttgtcagttgccttgccacatgagaagccctgcctgccattgagcaacaggtgcacactccatagcaggatcaccgcctcaacgcttcatgccagtcttgtgagccctcccagccacccaccggcaattgtccttgaaactgcaggttccttgggcaaagcgggtgcacagggctgccgtcgaatggcgagccttggcgcgagcctgaggtggggcagcattccactcgatgcaatgtgttgcatcatcttgttcactggcgtgttgcaccccgctgcatatgcctgtgcctcttacactcccacaccctcaaggctgcctaccttcttctcttgacgcnnnnnnnnnncgcatcatcttgtccactggcgtgttgcaccccgctgcgtatgcctgtgcctcttacactcccacaccttcaaggctgcctaccttcttctcttgacgccggctgagactctgctggccgtccactccccctgctccctggctaccctgcacctggacgatgtgcactctatcgcatccaggtcggatgaactctggcttcacaggggcgtcaccctgcgccaccagctcttcaggactgcgcgacgggactcccattccccgagcagcagggcagctcggtgctcgttccaataaatttgaggaacaagtactatttaagcgcctaataaaccagagcgctcggtgttccgcgagatccatgcaatgctctgcatgcgcccttgtctgggctgaacagcgcgcccgccggaggtgatcgtgacctggcaacctgacatcgtgtcgcggccaagaacgaacagactgccatgcatgcagcgacagtcggtagttgcgtatatgatctctttgcatgaatacgcaaagagcttcgctatgtggccatcagtaggttctaagggttgtgatacttgtgacggtatgctcgcttccaggtatatgggcccaatctccagacacatttctccacgatcacctcagcggcttatctgataaatttagtaaaggtgttatcatgataaaagctaggtcgcaccgtgttgcgtttgagcaaaggttgaggtatgctctgtaaagcccggtacgctcccacgcattcacatcattgatcaaagacacagggaatgtaaaagattgaatacgtttctgcacacatgcttgaagcgcttttgttttgttatgtggtgcctgtcgtttcggggacatcggagttcatgcagctcgacagggggtacgccgggatggtaccgcatgcccgatccattttccatccgacccaatctcgtccgcatgggcctgcgtatcaagcctgtctgcgaccagggcacatcgcctttcccccgaccagcatccttaggcactgtaggtcgtctctgtcgcgatgaaggtaacggctggacttttcgatggcctcaagagcaagtctcctgccaaggtagggtggccggtggggggtgcgcccgtcgagacctgctctgcatcgatcttcccaagcatggaactcggcgcagcagggcacatcattaccgatccatacgctgctccatgcgcaggaggtgcgcaagggcaacgtgaagttgccgcccccccgcacccccaaggtggatttccccaccaagctgtccaagcccaaggcccccgtggcgcccccgaagaagagccctctgcccgaggtcaccaagtttgcccgggcgtctgtgccccagaccaatcgtgatctggaccggaagggaggcaggtcctcgtacaacctgggccgtggcagcacccgcaagcaaggtaggctcggcgcgcatgaacctggaggaaagcggggcgggtgtggttttggaagtgacgtgcatgcgcgcgcagcgcagttttgcgcgcgtttgaatggtcaattctcagccagcatggtcgttcagatggtatcgatgtgtggctggcgggccctgtgctcactgacgccctcctcaccccccatgatcccctcacccccccacctacacctccctccactccaggcgagacgctgtggctgcccaacaccccccgccccgagtggctggacggctccctccccggtgaccgcggcttcgaccccctgggcctgtccaagcccacctcctacatccagatggacctggacgcgctggaccagaactcggcggtgaacaaggcgggcggcgtggtggggtccttnnnnnnnnnnacagcgcagttttgcgcgcgtttttgaatggtcaattctcggccagcatggtcgttcagatggtatcgatgtgtggctggcgggccagtgctcactgacgccctcctcacccctcatgataccctcacccccctacctacacctccctccgctctaggcgagacgctgtggctgcccaacaccccnnnnnnnnnntgcctccaacgccgacgaggtgtcccccgacgcgctggcgccctacagcgaggtcttcggcctcgcccgcttcnnnnnnnnnncgcctccaacgccgatgaagtgtcccccgacgcgctggcgccttacagcgaggtcttcggcctcgcccgcttccgcgagaacgaggtcatccacgggcgctgggccatgctggccacgctgggcgtgatcgtggccgaggcctccacgggcgtggcctggcaggacgcgggcaaggtggagctggacggcgcacagtacctcggcttccccctgcccttcaccctcacccagctggtctggatcgaggcgctgctggtgggcggcgccgaggtgtaccgcaacaccgagctggacacggagaagcgggcctaccccggcggctggtttgaccccctgcgcctcgcctcgggcgacgacaaccgcgccttcaagctcaaggaggccgagctcaaacacgggcgcctggccatggtgggttgtggcacaaaggggggggggtgatgtatggggaggagcagggaaatgtatcggcagggactgcgccaggctcgccccggggaaggacgaagttcgggctgcagttccgggtgataaacccctcgactgaaggcaaagcccaggccttggccagctggcccaaaacctggcagcctgcatgggaagggcagtgagtgaggctgaaagggtcgtcccttgcgccctaaaccctggtgctctgtgaaaggggcgtgcaggaccacatccccaggcttgtgttccgagttgccggcaccatccataatagacatcctgttcccctttcctctggcgcgcagatcgcgttcctgggtttcagcgtgcaggcctggaccacaggcgagggagccctggggtcgctggccaagttcgccacctcctttgccggatgaggcggggtgcggtggaatcttgagaagatccagtcgaattttgttgtggaagttcctggcccatgtagaggagcttgcaccggagtgtctgacatgaggacggcatgcggtgcaccgctcctgtgctcaagtaaatctcttgtaatcttcccaacaacggaatggcccggtcagccgctgttaccaatttgaggttctggcaccacgtgaggcggctgctctcgagaccagccgctgaataagtaattggaatatcgatatataaatgtcacagtgactgttgcacacaggcgtnnnnnnnnnntcccgcaccaggaatatcgcgtttggacaggggggttgcgtgctcgctctccgacaccgcccccccggaacctactgcatgcaggcttgcatggtgcgagcgtnnnnnnnnnntgcaccacgtgagtcggctacactccagaccagccgctgaataattaattggagtattaaaataccaatgtcacagtgactgttgcacacaggcgtccacagactaggctccgtgctcggcaacatggcgcctccggtgtctcccttccgcacagacatcctgaagggcaaggtggccctgatcacaggcggtggttctggcatcggctttgagatcaccagacagctaggtaagtgcccctcaccaggagtatcgcgtttggacaggggggggtgcgtgctcgctctccgacaccacccccccggaacccactgcatgcaggcttgcatggtgcgagcgtcgtgatctccggcagacgcgtggaggtgttgacccaggcttgtgctgatatgtcagcacaaggtgtcgaaacccactttgttcaggcaagcgcggtgtggcggcatgggctgtgatggaccagtagtagcagggacgagtggaggcagacttttcagtccccctccggctcaggcagtgtgtctataccctgatccatatcaggtagcaccccaaatgaggctctggtgcaacctccaccttccctctcttccccgatcccctgcatgcagggagacgtacggaagtacgaggcctgcgaggccatggtggcaggcgctgtcgccaagtttgggcgtctggacgtcctggtcaactgcgcggccggcaacttcttggcagccccagagcagctgtcgagcaacggcttccggaccgtgctggagatcgataccctgggcaccttcaacatgtgcaagtacgatggagggctgctgacaggttgagggtgggcggtggtgtcacatgtctgcggcgacaatgggggcaccgcctgcgagcgcatgcgcaacgttttctgcaggccttcacaatggcagatggtgggcagtcattgtcttccaacacacttgaaacctgtcaactcctttcgagtttcgcccacccacactccacccaacccacagggccgccttccccgcgctgcagtcctcgggcgcgggctccatcgtgaacatcagcgccacgctgcactacggcgcgacctggtaccaggcccacgcctccgccgccaaggcggcgatcgacagcctgacccggagcatggcgctggagtgggggtcctttggcatcagggtcaatggcgtggcgcctggccccatcgccggcacggcaggcatggagaagctggccccgggcaaggcctcggcgctgagcgctgaggtggcgcgccgcgtgcccgtggggcacatgggcgagcgcgccgacatcgccctggcctgcatttacctctgctcctcggccgccggcttcatcacggggcacaccatggtcgtggatggcggcgagtggatgtacaggtgtgcaagtgcataagaagcagagggggagtacagggccccagcagccaaagggagagctgtgcgcgggtgatgctgggctggccgctggcaccggtgtgagctgcgattacccttgaaggatgcagcatgctgtcagccgatcgccaggtcggctgtggcttccggcgcgccccagnnnnnnnnnntgtgtgcgtgcatcagaagcagagggggagcgcagggccccagcagccgaagagagggctgtgcacgggggatgctgggctggccgctggcaccggtctgagctgcgattacccttgaaggatgcatcatggtgtcagccgatcgctaggtcggctgtggcttccggcgcgccccagggcacacctcccgcccttttcaactgacggctggccttgtaatgatctcttgtgcacccaaccacttccgccacctcgcagggagcccatcgtgcctcgttcgatggtggccaaggtctcgcgcggcgtggnnnnnnnnnncccgccacctcgcagggaacccatcgtgccccgtgcgatggtggccaaggtctcgcgcggcgtggagggcaagagcagggcggtcggcattgcaggcagcagcaagctttgagatggctggagggcgccaagccagccgtggagcactgcaagggcaccgccatgttatggccaggatgacctcctgcttcaagttttcctggcatgcaagcccgcgtttccatgagaaaggggcgcacatcttaagggccggaatgtctgtacaaatgctgagcattcgcatgccaggcagcacaacnnnnnnnnnnacgtttccatgagaaaggggtgcacatctcaagggctggaatgtcagtacacaggctgagcattcgcatgccaggcagcacaaccgcccaggtgacagggtgcactctggcgggcagttacatgcaaagggcagcactggaagcctgcaatcccaacctgccgtctggcggtgaagggatcagctggcccaggagttcaccctcacagcggtccaggctgagcggaggtttcacgtgaggtcgtcctcctgcatatctgcatacggcgcggtgatcatgcgcttcactcggacctggaaaatggatcgaggacggatttgggggccagtgaaggggggatctgtgcaaaaatatactaccatcgggacgaaatcaacgcctagaacaggcatcagccccctctgctggcccctcctttcacttcagactcgtgctctcacacaccagttcccctcaccaggatcgcggtcttccaagcgtccaggcgcgtcatggagtcaaactcctggaccgcggcggtgaaggcgtcggcgnnnnnnnnnnnnnnnnnnnnnnnnnnnnnnnnnaaacgtgatgtcgatgtcgttgtagcgctggatggcatcccgcacccccggcaggctgtttgaggccagctggcagatgccggcgcacaggaggtagcccttggcgctgcagaggggtgattggggtgggaggagggacttgcatgggagatgccattggcgcatcccgagggtctcctggcaccggctacgatgccgactcatctggccaagcattgcacgcggaagagggctgttgtgctcataaacaggcacccccttgcatctcgcgctcctcacaccacaaatcacccacaggcaaccagaaatctgtcatgtagctccgtagccgcacctgtacttgagcaggttgttctccacagaggtccgcgcaatgccctcatacagggcgatggcacgggggtattgctccagctcggcggatgtttgcgcgatctgcatggagggagggagttagtaggtgtcttgggcaggcggcatgctgtgcagatgatctgttgaggcggtctggtgagttgtcagaaccctcacccgacatcagtgccatccaaatcattctcaagtaccagaaggccatctctctccacaagcacaccttcaaattgcacttgttggcctccgcattggagttctcggtggcaaacaggtctgccgcctgctccaggaaggtcatcgcctgctctttctccccctcacgctccagcacctcgccgatctcctggggcacaggagaggatttgggaagggtgagcgtccacaagggagtagttttctatggccgtaggtccacgccgtgcgaccacaatccccatgcccttcgagtccttgacccaggcacctcgcaccctnnnnnnnnnnaagtagttttcaaggccatgggtccacgccgtgcggccgcaatccccatgccctccgagtccttgacccaggcacctcgcaccctgagctggcgcgctgccatccccaggcggcccatgtctgtgtagatgctgacggcgttttggagggcctgcactccccctgtggaaggatttggaggcagcaggggtgttgtggtcaggggttggtgacccgggacttgcgcatgcagccagtggaggaggcgtcttcatgcgagcagacagaatgatccactgggacagtgcagaaagcgcgtccaaaccctctgtgcagcgcatgtgattccgcgagtccacaaagcaggacactaggttctcaatcaaggggaagaaatccaaggcttgtcgccatggacttcaccatcggcccctccctttgcaactagagcctcagaagctgttaactcactcttgtggtcgatcttgaggtaggatttgctggcgtccacccaggcactggcagcatcatgtggactctccagcttgatgtgtatctcggccaacttggagagagtgtcgccagcttcggcccctggcaaggcagaatgattctggtctcaggccttgactgctgctgcatcccacacatggaatcgctccagagctgccacgacaggcaggcccttgccatgcaccaggaaacccagtctcttgcacgcagcctgagacgcgcacatgacttggcgagcttgaactgattggctgccttctcaaagcactcggctgcctcctcgtacttgttgccaaaccatcccagcgacttcagcttcttctcgcccttgctcaaccattctcgtccttgaatttggaaacttgccatgctgggagggagaggagtcgagcgggatgtgatcagtgggcactcaaccgtcggcaatagggggggtgtcgtgtagtcagggactcggcgagcgcccaccttcctgctgcgcactcccagagtatgatggggaaaacctggaatcgaggagatcgacgctttgcaccagcaagcacagcgcgagtcctgccccaatcgacatgggcctgtgtgtgtcggggctgaattccgcgcctgctagatccagacccagtccagcagcgagtgggctcacgatcatcgcccgaaaacttggcggcaatggctttctctacacaccttcgtacnnnnnnnnnnaccgcgcctgacggatccagacccagtccagcagggcgtgggctcacgatcatcgcccgaaaatttaggggcaatggctttctctacacaccttcgtactgtgacacaaacctctgagggcttaaaggatacagcgttagctgaggaggcccttacagttcagcaagttcagcggccagcgcccatagtatccctctcgccgtgtgcacgatccctggagacggggactccagccctttgtcaatcacctcatttgattcccgactggggttgcagaggtctggcgcagcgccacgaatctgcagctcctctccctctgcgctccgtcttcacttgtcgcttgacggttgccagctgatcggccgggcgccatgaacgacctgctctccctcataaaggtatgcacatcgcctggtagcccatgtcatgtacatccagccggnnnnnnnnnntgctccgtcgtcatttgtcgcttgacggttgccagttgatcggccgggcgccatgaacgacctcctctccctcataaaggtatgcacatcgcttggtagcccatgtcatgtacatccagccggggaagctgactccccgctccgctcccggaacccgccaggaccaggatgcaacacaagccccgccggacttggaggcgcagatctccaccccaccctcccccaccaaggaggaagaaggggaggagaagagcatggagggtttcttcaaggaggtggccgccatcaaggcacgaagggtgttgggtgaattcttgggctgggcgcaaaggttgctgcagcagacggcccttcagccatgcgggcttgctgtgaccctggggtctgtggtgcagaggcctgatgctcagggacgctgtcnnnnnnnnnncacggcccttcagccgtgtgggcttgctgtgaccctagggtctgtgatgcagaggcctgatgctcagggacgctgtcctctgcttcctctccccacccgcatccctcctcttctccccacccatgcagtcgctgatgggggagatccgccgcaaccagggtaagctgtccgacgcgcacgagcagtccaagaccatcacccgctccgctgagatgcgggacctgcgggagaagatgcaggccgagatcaaccaggtgtcgcgctcggcggaggccatcaagaagcgactggcggagctggaccggaacaacgaggcggcgctgaagaagggcgtgtacacgcccgggtcgagcgcggagcgcacgcgcaccgccatcacgggggcactgaagaagaagctcaaggacctgatgggggagttccaggacctgcggacacgtgtgaatgcggaataccgggaggtagtggagcgccgggtgtacacaggtgtgtagagggtttctttggagggggggcataaggtaactgcgggatttcataggctcgcttggctgctnnnnnnnnnnaagggggggggcataagataattgcgggatttcataggctcgcttggctgctctttggtgatggccccagcctgaccaggcctagaggccctctgtcctctggggtagaaggatgtggagaggggtcctcgaggcctcctactcagatgaccctaccatggtgttcgcaagtgtgggaatggggcgaggtatctcacatgtctctggctttccgcgccgagtctgcctctctacccatcacagtgacgggtcagcatgctgacgaggaaaagattgaccaaatgatcgacacgggggagtccgagaccattttccagaaggccatccttgaacagggcaggggctatgtgagtggcaacatggaagggaggcgggggttgaggaggggtgtttcacgaccaaatttcatgtcttccatgcctgggagccactgcaggctgtccctcttgtgcccttgcttcacatgacctgccggaccccctcagcatcaccatggcatgcccgtcccctgcccaccaggtcttggacacgctggccgagatcagggagcggcgtgatgcagtcatggagctggagatgtcactgatggagctgcaccaggtttgcagtgtgtggaaggaggagtgtcggggggctcgcatacgtcaacatcccaaaagggcgccgtcgctcttggcgtgccaggcgttgcctcccatcccactgtccttctgtggtcaccctccagtggcacatcctttcacaccctttgcaccccccccactacacacttcacccaacacgccttcacccatccttccctctctcactgccccagatcttcctggacatggcggtgctggtggaggcgnnnnnnnnnntacccctccctccacacacttcacccaaaacgccttcacccatctttccctccctcactgccccagattttcctggacatggcggtgctggtggaggcgcagggggagctgctggacaacatcgaggcgcaggtggcgcggtcggtgggatacgtgcaggcgggaaccaaccacctgcaggcggccaagcagcaccagcgctccaagcgcaagtggatgtgctgcggcctcatcaccggcatcatcgtcatcctcatcgtcgtgctggtggtcatcggcaccacgcgaggcttcggctccagttgagagggggggagtggtccgccgtgggcctgcctcccccttgcccgtggccgcccgcacccctgggaaagggtctgcgacgcttgactcagggcgagacatgacgctgctgactgggcgcctgcccccgcttggccctggcttgtaaccaccactcgatccagtgcactgcgtgcacttgctggcggccttgctgacctggccgtgcagcggcctagccgggtgagggcgcaggatgctgggtgcccggcgatctcgagggtatggccagtcccggcaggcccaccctgtgccgcgccaggaagccagaaaggatgccagccaccgccccgggcgcgtcctcgtgcacggcatgccccgcctgcgagggtgcggggcctgggacgtgatgttgcgccagtgtgtcgtccagggtcgcgcctcaaaacagttggagcagggcaggcgcattccccacgtcggggagcagtgtgatcccgccttcaaatcttgtatcccctcaggacggcccccgtgcatcagccaaatccaaacacgcctgggggagcaaggccagctggaacctgccctgcatctggccnnnnnnnnnncgcgccagtgtgtcgtccagggtcgcggctcaaagcagctggagcagcgcaggcgcattccccacgtcggggagcagtgtgattccgccttcgaacctcgtatcccctcaggacggcccccctgcatcaaccaaatccaaacacgcctgggggagcagggccagctggaacctgccctgcatctggccgatggtcagtgccttgtccaggcggtccgtccccgccagcaccagcaccttgggacagggcaggcccaggaaggcggggctcaggccccgataccagccgtcccagaagggcgcggagtcgggcaggggcgtgcgccagacccagccccctctggcctggtctggggccttgggccgccccagtggtggacgagggggaaggccggggggccgttgaacttcagcgcctgtcgcaccgaccccgccatcctccgagatgctgggcaggctgggaggaggggggagcacactcgcgccacgcgtcgtctccgtcgccccccccgcctcctcccaccgcagctgggagggcagcgacaggcgcgcggcggagggattggtggtggcgtgcgtcgcccgcgcccaggccagcgcctccttcaggctggcaaagcgtgccggtcgcgcgctgagcacgctgcgcatggagggcagcgcggcgagcgccgtcccctccaccacatcgatcaccgccacaccggccagcgggcagctagcatctgtgggtgagggtgtggttgatactgtatatgtgtgggttgtctgtgtgtgtgagggaggggagggcatgcaccggaagtgcgtcacctgccaccgagggggaggggtctctcctcgatactcccctcctcacctggcaggccacatacatcccggaacatcccgccgcctgcaacaagacacaccttcctccaggatacggcgggcggcccagacggcaacggcgccccccatgctgtgccccaccaggaccagcggggtcgtcagctgccgccgtgcggccaggacgtgccagagctccgccacgtcagcggccagggtctcggccgccaggtcggcatcgtccgggctcctggtctccccgtggccccgcaggtcgggagccaccacctggcacctgcgcggcggcggacacagggcccatgttgctggcggatgggcttgggcccgtgtgaggggatgcaccctacccatgcaccttgctcattcctcagcgcggggatcaataagaccacannnnnnnnnnccccatgttgctggcgggtgggcttgggcccttgtgacgggatgtaccctacccatgcaccttgctcgttcctcagcgcggggatcaataagaccacacccagcccaacaaatgctcactgtataccccggagctcggccgccagcacgccccaggacaggccggtgtagcctccgccatgcaggcacaggagcatgggtgcatctgggggcccagcgctgtagacattcatgtccagctgacgactacgcagggccacagtctcctgaccctgaaagtaatcactccatactccagaagtgctagaatcctcctctccagcacgctcaggcgcagcggctggggcgggtgatggtggaaggggaagcctggaggttccagcatgccttgagccacctcagcagtgccatgcgcttcccaccacgcacggcgcgggagtcgatcacccaagaaaaatttgctcatcttcctttgcaatnnnnnnnnnnctgctatgcgcttcccaccacgcctgacgcggaagtcgatcacctaagaaaaatttgctcatcttcctttgcaatcagtctgggcacctggtgaggcccacgcctgctccatgacgtgtcggagcaggggggaggccatgttcgtatgtcagggatgcatagcacaggttcgccggaacgagtccaggtccggcagcaccggctcccggatgttatgctacgcaccaagaatggatggattctcagatcaaaatgttgcgacacgtcggcatggttcgaatatggcggggagtatcccatttgtgctcagttcgctcgcgacaggctggaggtctgagtgtgggtcagctnnnnnnnnnngatggcggggactatcccatggtgtgctgagttcgttcgctacaggctggaggtctgagtgtgggtcagctgaagaaaatagaatgggagggcggcaaaactcgaagctgattgcactcaatacattcagcaagggcatatgactgtgggtttcctgattcatcttgctcagctgcaatctttacaatccctctgcgcaaattgaccaacggcttctcgtcatagcctctccagctctgctcannnnnnnnnnttattgttccagttcacgaatcgtacctcatcaaatgccagcacacttcttgagatcatttgggcaactacccagcgatcgcatattgtgnnnnnnnnnncaagaaaatagaatggaagggcggcaaacttcgaagctgattgcactcgatacattcagcaagagcataagactgcgggtttccttatttatcttgctcagctgcaatctttacaatctctctgcgcaagttgaccaacggtttctcgtcatagcctctccagctctgctcacggaggtgattttttggacccattgggcggcgctgagcaggcacagacgatgtcatctagccttctgttgttccagttcacgaatcgtacctcgtcaattattgccagcacacttcttaagatgatgtgggcaactacccagcgatcgcatattgtgcggatctcccctcagatctggcgccaaatcagggttccgattgcgagcctggccattacccgtcctacccagcactcgtacgataaaccgtcctttgtgtggaggatggtggcacgacaccagcttcgtgcgttctgctcgctagaacttcaaaccctcgcacaactcgggtcttacagagaggcgagtccggcccaacactgagcatacgttcgtgaagcgcttttgcgcacgttcgaacgacctcgtgggctcaacatagagtactgtgctggtctcgccgcctcctgagtctccctggtgcctggcagcctacatgggcagcaaggaggacaagttggaggtcttcttcaagagcgtgttcaagccctttgctaaggtcctgggcatctccgacaagtctaaatcaaagtcgcgacgagagtcctcgcgtgcacctcctgtcgagggtgcggggcccggggtttcgcaaccggcttgcggtacggaaaaaaccgtcgaaggtgtcgactgtgtcctcctcaaactgccccccccccttcctctcgcgcagagaggccgagggagaccaggaaggagaagccggcggagatggggaatgcatgctgcacccccccggaccagttccccaaaccagtaggggtggtgccccgacaggtatcgcgcctcacacccacaaggtgcgcttggcggggtggctgacagtgggatgcgggggtccatgggcgttggaatcccctgccctgccttcgatgcgatggcgatgcaccccgcacacccctgcgccctccctccccctggcgctgagcagcaacctgcaggtgacgaaaactggtgtgagcgtacgcgacatctaccgcatcggccgcactttgggaactggaggtgggtatcgcggcgtgtgaatcaagcatgtggggatgggggctggattcctggatggcgtgtgcgcatttgggctcggggagtcgtggccagtgactgagactgggaaccnnnnnnnnnntgatgcgatggcgatgcaccctaaacacccctgcgccctccctcccgctggcgctgagcagcaacctgcaggtgacgnnnnnnnnnngtgggggctggattcctggatggcgcatgcgcatttgggctcgggaagtcgtggccagtgactgagactgggaaccgtttaatgaatgccttgagcaacacggctcaactgcactctggctgcctccgcaaggctgcttcaccactgcacgctctgacatgcctgcagggttctcggtggtcaagcttgccacgcacaaggagacgggcgatgagtatgcctgcaaaatcatgagcctgcccccgcctggcgcctccaatgccgccgaggtgacgcgggaggacatcttcaaggagatcaacatcctcatctccctggaccaccccaatatcatctacctgcgggaatactttgaggagggcaacaaggcgtacctggtcatggagtacctgggaggtgaggaggcatgatcgagggtgatggggttgggttcggagatgtccatgnnnnnnnnnngaacaaggcgtacctggttatggagtacctgggaggtgaggaggcagaggtacatggtcaagtgtgatggggttgggttcggagatgtccatgtggggttttatgggggttggccacgtggtggcacctgagcgcttctagaaccgggattcgaggaggcagactccggacaaggtggggggtgttggggccccccatctttcttcctggatccctgccataaacgtcacactcataccagggcgcccagctctcccatcacaataaaacaacaagaacacgctcctcaccgcccccaggcggcgagctgctggacgcggtgctggacatcgggcactactctgagaacgaggcgcgcatcatcttccgccagatcgtggccggcgtggggtacctccactccaagggcatcgcccaccgcgacctgaagctggagaacctgctgatggccaagcgaggggacatcatgggcgtgaagattgccgactttgggttagcaaagggccaggccgccacctcgctgtccaccatctgcggcacgccacagtacgttgcgccggaggtcatcgccaagggcgccaagagcggcttccactcctacaagctgtcgtgcgacgtctggtcgtgcggcgtcatcctctttgtgctgctgggcggctacccgcccttttacgacgagtcggagccgcgcctgtttgacaagatcaggtgggtgtggtggggtcggcgagggctcaggtgtgctgaccttcatcacccccaagccgccgcagacccccaccaacccatgcgcccatggcaggcggggcgcatactcgttcaacgaccctgtgtgggagcagatcagtgacagcgccaaggagctcatcaagcggtgcctgaccctggaccctgccctccggcccacctgcgaggatgtgagcaggtctcttgtttgtgtgtgggctggggtgtcggctccggaagaacactggcgcaggggcccacagtgcatgctcggctgctgagactcttggaacccgcaggcatgccgacctcgcttgcacccttgtttgcggggtggtcgcccggtccttgggaaccacatgcttttgaactccgcatccgccctgccctgctgccagcgacaactccatgcccaagagtcacaccacaacaccctcctaaaccatgccatccctcccctccacgaccgcccgccctccagatcctcaatgacccctgggtgatgggcaacgcagtctcgccgcccaaggcgcagctgctggccaccaagtcgcacctgcgcaccagcatgcggcgccagcgcggcgccggcgccagcaacgcgtcggagcctgcgcaccagccacccgtggccgaggagtccatcatcgcccagctggcggcggaggagcgggaggagcggcacctgcaggaggagagcgaggagcgggcggccgacgccgcgcgcgcctgacttggggggggttgtcctgaggatgcgcagcccgcggtcctgcctgtagagacttgcgccaatgctgcggccactccgttcattcggtcctgccttgggcttggcatgggcgcataggccggagcggcactgccgtggcaccctcgccacggcttcactctggtctgctgtacatgcaaactgcgtgttaaaatagtgggtacagcggtaggtacaccaggggtgtgatgaagacatatcatgtcacaggaaggcatcgtcatcgtccatgtcagcaagcgaggggactggcggccgggcctggggctcgccgccaggtttgaggtcgggcgggcctgctcgtatgcgcttgggcaaggagaaggtctggccgctgggccgcccaatcatgggtcggggcatggtcggcttggggcccctgcgctccggggtgggcgagggaggggtggggttcatttcaaggagctggtgggatccagtcttgccccagcattggtcagaggggttgtcagcgtcggtgctgactatgctggagagtcactgtccccacccttccccaacccacgcacacgcaagcatccatccccattccccacctggcgtccagcgcggtgctccccgcggcagccaccttccccggcacccccaggttctccnnnnnnnnnntgcacacgcaggcatccattccccttccccacctggcgtccagcgcggcgctccccgcggcggccaccttccccggcacccccaggttctccttgtcgccgtccagcgcgggccgcggcgccgcgctccggcccggccccgcccgcccgccccagggcgcggccccc

SEQ ID NO: 36249 - DNA, 115 bp, Chlorella protothecoides
gggcctgcgtcacggcctcgtcgtcggcagtcggcgcaggagccgagccatcgaccggcatgtctgcacctgcaccagccgtgcctgcctcgggcgctgcatcgccctgctcccc

SEQ ID NO: 36250 - DNA, 80 bp, Chlorella protothecoides
catatcagacagggacatgcaaactaggattcccgtttcttgaaattgaaccccccccctctatttcaatggtacaggct

SEQ ID NO: 36251 - DNA, 72 bp, Chlorella protothecoides
gagctcctggcagtgacctgggagggggggttgggggggtgagatgatgggtggggaacatgggtgaagggt

SEQ ID NO: 36252 - DNA, 118 bp, Chlorella protothecoides
ccccgccccctgctactgcccaaagtcacccagccccccccttctccttcaaatccatgattgcttcccccctccaaaacctctgtacccaggtccagtccctggcccagctgggggt

SEQ ID NO: 36253 - DNA, 6461 bp, Chlorella protothecoides
  modified_base (99)..(108): a, c, t, g, unknown or other
  modified_base (499)..(508): a, c, t, g, unknown or other
  modified_base (1745)..(1754): a, c, t, g, unknown or other
  modified_base (4447)..(4456): a, c, t, g, unknown or other
  modified_base (4818)..(4827): a, c, t, g, unknown or other
  modified_base (5671)..(5680): a, c, t, g, unknown or other
cgccacgcggtccaccacggcgcgctgcagcgcgcgcagcgtggcgtcggcgtcggcgccgcgcggcgcgtgcaccgtgaccgagtccagggccagggnnnnnnnnnngcgcgcagcgtggcgtcggcgccggcgccgcgcggcacgtgcaccgtgaccgagtccagggccaggggcgccgccagcaggcgcgaccagaggccgccctgcaggcccagcaggcgccagcgcgccagcttgtcgctacacgacatgctcagcgtgccctccccgcgcccgggcttgcggcgcaggtgcccggaggcctgtgcgcgggtgtgaggctcggggatggtggccggggcggcgcccagggcctgttcctgggactccagtcccaggagcttggcgccggtgcggggcagagtacgggtgggcgacgggtcgtcctgcttgtgcttgtcattcagggtacacccagttttccctaagacctcgcggtcatccgaggcagaagcannnnnnnnnnccggggcagagtacgggtgggcggcgggttgtcctgcttgtgcttttcactcagggtgcaccctgttttccccaagacctcgcggtcatccgaggcagaagcagcattctcctgtgacctggcctcgcccagggtcccgccagcgctgccatgcgccgcctcccgtccgtcggcgtcgtgcacgcaggcgtccccgcacggcggctggctgacgtacaggtgcacccccacccccggccgcaggcggaggcgcggggcgccgcaccctcctcccccctcctcatcgcgacacagcgggtctacagcgccctgcgagcccaggtcccgggcgtgggcatgcaggaacaggaggaaggcgcggcgcgccagcacctccgcgtggcagtcgttcagggccgcgccgccggggtcgcgggccgacgcccccaggcacttggtgccggtggccagggccgcgacgcagagtgtgggggggcaatggggggtaggggtggaaagcacgatcgccgccagcaccgtgtgctcgtgcgcctggggcttcccggtcctgggcagcgctgcgaagcagtccagcgcggccccggccacggcctgggggctgggcagcatgttttcgtgagccggcgagggcgtgccgggacccgctgcaggtccatgtgccatgtctatgggcaggccccgggggcgggccgcagggtcggtgggtgcctgagctttggccgctgcgcctgggggcacaccacgactttgttaccagcagggccttgcacgcccgaccgccagcggggccgtcctggcgactacctactctcaggaaacagacacctgccctactcctgcatggcgtcagcaggctcctccacggccttggcggccatcttcttggcgtgctccacgcgcttctggtgcttcttggtacgcacaccgctctggcgcttcacgcgggccttgtgcgcctggagttggatacacggaatgttactcgttgagtgaagcgcagggccccggccatcctcgagtcagtgacaggcaccaccgccacccgaccccaacttgcggcgcacacctgcaacgtgccagcctgcttcttcgcgactctcgctttagtcttgctcctcttctgccagctgtccatgcgcccgttgaaattaccggtcttgcaacctaatcggaacgaagtgttgaaaggttgagactccgggcgctctgtacacgccggcagccaggtcgccgcccnnnnnnnnnngttaccggtcttgcaacctaaacgggacgaagggttgaaaggttgagactccgggcgccctgtacacgccggcagccaggtcgccgccccgaccacatcacccacctcccgtggaccccatcctaggttcttggattgtttcagtatcttcaactcgttttcgtccacgccattatctgccccgcagcccccctcacccttctcgtgcgcagagttgctggggcatgataaacgcgggacggtccacgtaggtccatgggccgataccgacaagaaggttccgctttacaatgacgcacagacggtcgatggtccgattatcatcaacgtctccaccgggtcttcgtggtcgccgcactccttgtggcgaggaatacagtagtcgctgcgctctcctgttgctgggccaaactcatgaactctgccgcaagcctgcgcttgctctccgatctcaaggctatctcacgcgagcctccggacggctgcagcgcttctcccatcgcagaagataacctttacgtgtgggtgagtcggtcggacccgttggcctcccgacgccatgccctgtggctgcaccggttacatgcacctccccacctctcccccacacccacagagcgccaccatcttggggccagccgacaccccctggtaggtattgtgcatggatgccatggcctggcccacctcacgtcctccgtgtgggagatcaacaccgccctgagccatgatgcctgcagggagggcggcgtattccagctccggctcacatttggggacaggtaccccgacctcccaccccgtgtacgcttcacctcagagatctaccacccaaacgtctatgtaagtagcgcacgtaatgctgtcccaaggaaggggatgctccctgtggcctgtgtgatgggagcgggcatcctccctgcggcgccacgaccctgtcgatgctgtgcccctgctctggcccctcaccgccccctcttcccccttctctgctcaggcggacgggacgctgtgcatggatatcatccaggaccagtggtcgccgtgccacagcgtctgctccatcctgacctccgtgcagtcgctgctcactgaccccaacccccagtcccccgccaacccggaggccgcgcagctgctcactcaccacttggcggactacaacaagcgcgtccgtcgcatcgcgcagaagagcacggaggagtgaggcacgctacgccggcgggccccttgcctcgccttctcacgtgatattgacgttgctctcctcctagggctcccccttgtacagcctgccctgagccggtggggccccctcctggccttgagaacctgtaccctgtaacccctgccatacccctgccttgcaaccccaaccccacccgctgctggtatccgcagtcaatgtacagaggggcgaactacgcggggcatgcaggagcgagtgcttctggaatgaaaggggcccgccggacgggcgaacgcgtgccatcccgcggcatgtgtggcgtgccgggcgtgcaagcagccctccaccgccggcgcggtcagaagccgtggaccttgatggcgtccttcttagtcaggtcgttgccgatgaggaaggcggacacgttcttgcgctggtcgccctgcagctgcagcaccttgcccagctccttgtcctccaccactgtgccgttgcagcagtactctgaggatgtgggaaggtggggagcgggcaggacaggatgaagagtgaatctcactacataggacctggcccagcctgggcccgagttcccggtccaccccgggagcatccccgcgttcgggctgcaacctcctcagcgcgatgcatgttcacattcttgtatgaggtatcgacccgccgccccaaccgcatgccggcactcgcctttcttcagggccttgagaattttgtcgagatcaaacttctttgggaggccctgcacggtcgtcaggcacttcttgccgttgcgctgttgcacgcgtacatgcacgtagtccttggcgtcctttcccttaacgtcgttgtcgccagcatcagcaaaagggtctgggatggagggggcggaggagtgaggcggagaggagaagccccgcttccaaacagtgtctagcgacattcaagaagcccttcatatgtacaaatcagaggggaaagctcaccaaacccgccgagactcggtgctggaagaacaacggcgtcggacattcagcgacggacggaggcggaaatgcgcacgacccactcctgagctcacgagaagaatatacagggagcaaggacagccaaaagtgtaaaggaggggcgctatgtgatcggagggagtgtggcgggggagttgaattgctggaaggcaccaggaggttcccagggtataaggggggacgttgagccctggtgctctttcgatcgcgcgtcgcccagcaggcttgctgagggacgtccttggtgaaacagctccctgagcacaggcatctcacgccccaaacctccactcgtggacaggggagctcggtggatgattggcgtgctgccaggctgacacgatggtaagtataggggctgggggagggtgatctcagacaacttgtgcccgcaggcaatggccgacacgtcctcacatccattcctcacctgctcaaccccttcccgtacacagcctctgcgactggacatcaaggcnnnnnnnnnngcaacttgtgcccgcaggcaatggccgacaggtcctcacatccatttctcacctgctcaaccccttcccttacacagcctctgcgactggacatcaaggtaagtctggtgcagggcagcgcgtcccttcaccgccgcggtggttgcacggttctcgggtactgctccgtgccaaggtgtcgagtccctgcgctgacatgtatccctcccccctttgcagaatgtgttctcgcagcggtcggagcgggtgaagggggtggacatccaccccaccgagccctggtgagcgtccgctctgggccgggcatgagaatgcgtcgcaggctgttgctcagaaagggcacccatgggcattggctgggnnnnnnnnnnacagggccgggcatgagaatgcttcgcaggctgttgctcaggaagggcacccatgggcattggctgggtgaggatccccaaccctcgcctctcccacacctccaggatccttgcctctctgtacaatggcaatgtgtacatctggaactacgtggagggtgccctggtcaagtcctttgagatcacagacctgccggtgcggaccgccaagttcatcccgcgcaagcagtggatggtctgcggcgccgacgacatgcacgtccgggtgtacaactacaacaccatggacaaggtgaagcagttcgaggcacacaccgactacatcaggtgagcggacgtcgcaggttgatgggtgcgggagcggggggaagggcagctggactgtcggtatctcgtcaatggtcttcctctgtgtgcgctgtggtgacaccaccctgtcatactcctcgctccagccatccagacatccaagcgatccccacccctgattcccaggcacctggcggtgcaccccacgctgccctacctgctcacctgctcggacgacatgctgatcaagctgtgggactgggagaagggctgggtcaacacacaggtcttcgagggacactctcactacgtcatgcacgtcgtgttcaaccccaaggaccccaacaccttcgcctccgcctccctagatcgcaccgtcaaggcgcgtggctgctgggacgctggggggaaatagatggggaggcggtgctggtcgccggggagctgcctgtcatttgaggagggggggggggcactagttaagcctcggaaggaccctgtcgtggtgccaaccatgcaataaagcctgtggatnnnnnnnnnngggggggggttggcactagccaagcctcggaagggccctgtcacggtgccaaccatgcaataaagcctgtggatcccaagccccttccctctttcctccccaagcaggtgtggggcatcggcagccacatgcccaacttcacgctggagggccacgagaagggcgtcaactgcgtggactactacaccggaggtgtggaagggggtgtggatgatgcgggggcgcttgccaacgcatggatcatgggctttgccgcctgtgaccctcgagttcccccccccccaagaatattaaaaactgattcccttttcctcctcccccacccccttcaacaggcgaccgcccgtacctggcctccggcgccgacgaccgcctggtgaaagtgtgggactaccagaccaaggcctgcatccagaccctggacgggcacgcccacaacatcacggcggtggggttccaccccgagctgccgctgctgctgaccgggtcggaggacggcagcgtcaaggcctggcactccaccacctaccgcctggagcacagcctggaccacggcatggagcgggtgtgggcagtggcctacacgcgcggctccaactccatcgccatcggctacgacgagggctgcgtcatggtcaagctgggccgcgacgaacccgtggcctccatggacgccggggggaaggtggtctgggcgcggcacaacgagatccagaccgtcaacatcaagtcgctgggcgacgcgcacgaggaggtggggggggctgggggggggcccggg

SEQ ID NO: 36254 - DNA, 95 bp, Chlorella protothecoides
gacaatcagatggaggaagtccataagaagtgggttgggagggagacgaggctggctacaaggagttgggcccgaggcggtttcgatcgccgtgc

SEQ ID NO: 36255 - DNA, 71 bp, Chlorella protothecoides
cggcgaggcccctcaccagtgggccgggcctggcgacgccaggccgggcgactccaggccgggcgacgcca

SEQ ID NO: 36256 - DNA, 61 bp, Chlorella protothecoides
gccagacgtccccgaccgcatcgtggccacttcggtgaccgccacctggaagtacagcgca

SEQ ID NO: 36257 - DNA, 61 bp, Chlorella protothecoides
ccatcgtctgtgtcagcaggtggctggaggtgcaggaggcgcttgacggcggtcatgatca

SEQ ID NO: 36258 - DNA, 75 bp, Chlorella protothecoides
acgcagcatcacgcaggggcgcacctgcactgccctgtagtagttatcctctgtccgctgggtcacgcttcgcca

SEQ ID NO: 36259 - DNA, 13911 bp, Chlorella protothecoides
  modified_base (441)..(450): a, c, t, g, unknown or other
  modified_base (1167)..(1176): a, c, t, g, unknown or other
  modified_base (2011)..(2020): a, c, t, g, unknown or other
  modified_base (2247)..(2256): a, c, t, g, unknown or other
  modified_base (2536)..(2545): a, c, t, g, unknown or other
  modified_base (2921)..(2930): a, c, t, g, unknown or other
  modified_base (3486)..(3495): a, c, t, g, unknown or other
  modified_base (3767)..(3776): a, c, t, g, unknown or other
  modified_base (4158)..(4167): a, c, t, g, unknown or other
  modified_base (5108)..(5117): a, c, t, g, unknown or other
  modified_base (5466)..(5475): a, c, t, g, unknown or other
  modified_base (6407)..(6416): a, c, t, g, unknown or other
  modified_base (6645)..(6694): a, c, t, g, unknown or other
  modified_base (6806)..(6815): a, c, t, g, unknown or other
  modified_base (7331)..(7340): a, c, t, g, unknown or other
  modified_base (7646)..(7655): a, c, t, g, unknown or other
  modified_base (8519)..(8528): a, c, t, g, unknown or other
  modified_base (9291)..(9300): a, c, t, g, unknown or other
  modified_base (10795)..(10804): a, c, t, g, unknown or other
  modified_base (11530)..(11539): a, c, t, g, unknown or other
  modified_base (12308)..(12317): a, c, t, g, unknown or other
  modified_base (12924)..(12933): a, c, t, g, unknown or other
  modified_base (13342)..(13351): a, c, t, g, unknown or other
  modified_base (13826)..(13835): a, c, t, g, unknown or other
cagctcggcctgggcgacgaccgcgcacgctgggagccggcgcgagtgccgggcgtcgccgtcgttcacccggaccgcacgctgcgccgcaaccgccggcccgcgccgcgcaacgtgctcctggccgcgagcaagggcgcgcggtgacgccggcgcacccgtcgccccccatcccttacctgctggccccccccagccccggagcagaaccccttgtacctgacgccgcgcattgccctgaaaaccctcatgcacacactctccttgcaaactctcatgctgctgacaatgacgtgcaacaccgaccttgacgcccaagggaagtgggagagtccgggacaatgccccgacgatgatgcatgacccgagatcgcgggcagggtcacacgcatctgcgcgcggtcgagcgctccgggcgggactgcgagggcggcgctccannnnnnnnnngcagggtcacacacatctgcgcgcgatcgagcagtccgggcgggactgcgagggcggcgctccatgcgcgcgcattgagccatggccgatcgggggagagaagcataaagggctgagagggcaagcccggcacgtcggtccttgcaccgactcgcgacatagccaggctctgccttccacgccggcccccagtaccaccaccagggtcacaccatgatctgatcgacgcgagacgcgctgcatggtggaagccatgtccgtggaggagcagctgctgaggcagggcggggtcgcgagccaatcccactccggcccctgggagggtcggtacggcaggttcacacccgtccagctccggctgacggcccagggcgacatcgagatcatcagcaaggtagaccgggcggccaggaggagagggcacgggcatgggcccagggccagggcttcccacggcacaggagaccctcacctgcgctccttccccaagcaggcctccccgcagccctgcccccggtactgcctgcccttcatccgggcccctcctggccaggtgtgcggtggctggtgcctgggggggcgaggttggggtgctggcgtggattgcaccccggatgcatgcgtcgcggggcccaacctggatggccccacggcctgatcttcagacggcggccccggtcgaccctagcgacacccatgatgcctggctccgcgcannnnnnnnnncggccaggtgtgcggtggctggtgctggggggggcgaggttgggggtgctggcgcggaccgcaccccggatgcatgcgttgcgcggcccgacctggatggccccacagcctgatcttcacacaacggccctggtcgacccaagcgacacccatgatgcctggctccgcgcagatccgcggcctggacgcgatcggggccagcgcagagggcaggacactgaccatctggcacacactcccaccgccgaagcggtccggcagccaggcgaggcgcaggcggcgcaggctcgccctcacactgcaagacgagcagggttgcgtggatgcagccctcgccatccgggccgctgtgtctgctgccgccccccggcggctgctggtcgtcatcaaccccgtcagcgggcgcggcaggtgggctttgtgggaggcgaagacctggttgggctgttacccactcccaggggggggacagaaggaggagaatcctcgtgtgaggagacaatgagatggaaggaggggggttcttggatgctgggcggcctgtgacgctgggcccgctgtggcccgggtggcgccgctggaggtgtggtggcctgccacccctgctgctttgaaaaaggcgtttgcaagctttgggcactccattagtgggttcttgcccgcaacaacaatgcaggggccaggccctcttcgacaaggaggtccagcccctactggaggctgccgggatccaggcccgcgtggtgtgcaccacttccaagggccatgccaccgagctggtcaaggggcagcggcccgaccaggttgacgccatcgctgttgtcggtgcgctggnnnnnnnnnngacttccaagggccacgccaccgagctggtcacggggcagcggcccgaccagattgacgccatcgctgttgtcggtgcgctggctggggttggcacgagggtggggcgctggtgctcaaagtctgtatcgattcgaaggcagcatgcgggaggtcctgtggcctgcgaggcctcgcaggtgggctttgaacacagcagcttggatccatcgctgcatctcgatccgnnnnnnnnnncctgtatcgatttaaaggcagcatgcaggaggtcctgtggcctgccaggcctcgcaggtgggctttgaacacaggagcttggatccatcgctgcatctcgatccgctggacactcctccgcggatgctgacaccctgtcctcgctctcaaggatcatgccgagcccccaagcctccactcccgcccgctcaggtggtgacggcacggtgtttgaggtgctgcagggcgtgctggaccggcctgactggaaagccgcgcggcagctgcccctggtccagannnnnnnnnnagctctcaaggatcatgccaagcccccaagcctccactcctgcccgctcaggtggtgacggcacagtgttcgaggtgctgcagggcatgctgaaccggcctgactgggaagccgcgcggcagctgcccctggtccagatccccgctggctccggcaacggcctggccgcctccacaggtgcgtgtgcgcctggcacctgtgaggcgccttctgcaggctgcggggtcgggaggagcaggcggcaggatgcggccggcggggcagcagcggcgaggctgggcgcacttccaagccccgctgccaattgcgcagggccttcatcctgcggagggacgcatgcacatcggagcggcagcactggcccagctgcacgagnnnnnnnnnngaaagcgcagggccttcatcctgcgaagggacgcatgcacattggagcggcagcactggcccagctgcgcgagcctgcctctcaccatctgtatcctcttcgaccccaccctccgcaccccacccatgcgcaggcctgtgggacgtgaccactgcggtgcacgcgctggtgaagggatgcacgtcgcccatggacgtgtcttcggtgctgcagccccctgcacgccgcgtcttctccttcctctccctgacctacggcatgatccccaacctggacatcggcacggaccacttacgctggatgggcagcccgcgctttgtgctgggcgccatccaccagatcatgaagcagggcgcctaccccgcgcgagtctcctttgtggatgtgcggcacggcgtggtccagggggcagggcacgtggaggaggggacaaacggcgcgggccccccaatgcggcacatcggcgccttccagcgcctgccagacggtgcggggcgcgcctgtctggagtacaggagcccaggctgggaatgggcgcaggaggcctcgggggcannnnnnnnnnagcctgccggacggtgcgtggcgcgcctgtttggagtacaggagcccaggatgggaatgggcgcaggaggcctcgggggcatgctgtcgaggcttcattgtcaagcgtgcggtgtcgtggatgctgcactttcaggctcgggcctcagacctgacaccgagtgcctcctgcaagccccacactccccacgccgtcaaccctctgcacgcaggctgcagtggcattgcctccctgggcctgacggccccctggcagcccctgctggcgggggnnnnnnnnnncctcaggcctgcgcctcagatctgacactgagtgcctcctgcaaaccccacactccccacgccatcaaccttctgcacgcaggctccagtggcattgcctccctggacctgccggccccctggcagcccctgctggcgggggaggtccagttcttcgcggcctgcaacattccctggctggacaccaattttcacgtcgcgccgggcacgctgctgcacgacggtgggtcacgagctggggcgaggcgtcggtgttgggtccgcaccttgacgggccctgaatgtgtatggctggcatgccactggacaagagcttttccggatttatcatcccaagtgtccccccatcggcagggcacctcacgctgctgtacacgctggnnnnnnnnnncgtctgcaccttgacgggccctgagtgtgtatggctggcatgccactgggcaagcgcgtttccggcttcatcatcccaagtgtgcccccatcgtcagggcacctcacgctgctgtacacgctggggaggatgggcaggctcaacggcctccgcttcatgtcggcaatggacagcgggcagcacatggatcgcctcaccctcgaacggcccatcgcctttgtgctggagccgcgggcgtccggtgagtacagctgggaggaacgggggaattgtgccctgcgctgcagatgcggaggcatgcactcggtctgggacgagggcgagagcccagcctcggtctcgagcactgcttgctgagggggctgtgtggtccatctgaattgtttgcatgccagtcaggtgcggtgcaagaaggggtcgggccagcggtagacccgtagcgcgccactccggcgtcgtgcttccaacgatcatctccagaagcaccttccccaccgacttgcgcagatacgtggatcgtggtagatggggaggaaatggcgcacaggctgacctttgtggaggtccaccccagcctctgccgagtcatcgtctgcccacgtgaccctgaggcgggcaaagatgtggaggccagggaggacggcggccactcccggggaagggcgagcaaggcgcaccgccagagctgatgggccagcacacttttttaccgagctgcagagacgcctgctgctgtactgttttccgtcctgcgcatcactccccagtgtacatcatgaaggacagacgccgcacacagcctgtcgggagggaacctgcggaaacacagtctggccgccccccaaggcaatcgccttgcaggagggtgattgatttggtagctggcctggcgagctgcacgctgctcatcaggccctgcctcgaggccccttcccacgccnnnnnnnnnntgaaacacagcctggccgcccccccgggaatcgccttgcgggccggtgattgatctggtagctggcctggcgagctgcccgctgctcatgaggccctgcctcgaggccccttcccacgccctgagcctctcctgccgccgaatccccgcttgcgccctctgcctcctcgtgccgatttcttcctcacgcctccggttggcgcctgcaatgggattcagacatttgtgtgtgtgcatcccgggggacctcctcgtgaggctggaccatgctgcaccatgcactcccaattcgaaggcaacccatgaccccctcccacatccattccgctagcctcaccccggaccatcgnnnnnnnnnncaccacgctgcaccatgcactcccaagacaaaggcaacccatggccccctcccacaaccattccgctagcctcaccccggaccatcgctccactgtgctcatgtgcgccttcttccctccagatctctgcccgctgccagcaggggtgctcgccatcgcggccttggcaacaaactgagcacggtagttgatgtgcacggtgctgccatccctgacagggagtggtgagaggaaagcagtgtgcgcaagggacacggcaccgagctgccagggcatgcaggcctgctcagccatgtggctgcatgcttctgtcaaactcctctcctcgtccagaccagtctctgggtaggaggagaggacagtgacccacccagcacaccttggatcggtgccacccctcagggcttccaccggcacgaaatcgaggaatcgctgccaccagggtcggcagctgccaggcagccaatctgccgcttcgaactggccacaagagagaggggggggtgggggtgcatgcgccctgtctgggctgctggccacgacggcttggccgtggcagggggggcccagctcttcgtcctcagcctcccaggcaagctggggcccggctgcagcttctgcacccggcccatcaccagcacacgaccagaagggatcttgcggcgaggggcaggcagccgtgggacttgagcccgaccggtgacccagcctcgattcgccggggccttgccgccaagcatgccctgagtcccctcgctcacacagagtctcctggggcgaccagccctgcggatgtgcgccgtcgtcaaagtagggagagctgtggattggggtgccatggtgctctcgactgtcgcagcccagcggagtcgacagcgttccagccagtgcattccgcacttttgcagctgcgagtgcagttggtggcttgnnnnnnnnnngaagtagggagagctgtggattggggtgccaaggtgctctcgactgtcgcagcccagcggaggcgacagcgttccagccagtgcattccgcacgtttgcagctgcgagtgcagttggtggcttgtatggccggccagcctctggctgtgtattggttatctggccaggaggtatcaggaagtaagctctcaataggacatgtagaataatcctcagcctgcatttcccnnnnnnnnnnnnnnnnnnnnnnnnnnnnnnnnnnnnnnnnnnnnnnnnnnctcgcctggcagcaatgcccctccccctgcctcaccggttgcagggcagtcgtgcgtggtctggagaaggcggggggctgaaagtgtttccgggggaggctgggcagcacgnnnnnnnnnnacgcgtggtctggagaaggcgcggggctggaagtgtttccgggggaggctgggcagcacggcacggggctgggcagcagcgcggcgagcctccgcaggcagcctgtcgtctacagccggcttctccaggggggaatcatgccacccatccgactcgtcccccaggagatcgaagcagggtggatcattgagatccacaacatccgtgaggataccggtgaacgttggaaaagagggcgggggggccggattaggcatatattgtggggcggcagctgtggtgggcatgtgaagggggacactggatgcctgatcggccaacaccgcgcccgcttcacggggatgtagaaacggagcacatacatcaggccgagattttttcagagagagtcgactccgcagccgggcactgcgcgaagggcggaagatgggagaggtgaggtagggccgcacggcctgcggctcggcgaagagcaatgcagcccgcagactcgaaagcactcacccactcgtcgannnnnnnnnntgggcggaagatgggagaggtgaggtagggctgcgcggcctgcggctcggcgaaaggcaatgcagcccacagactcgaaagcactcacccactcgtcgacgccatggttggtcatatctgtgcctgctctgggtcgcatcacgacgtcattcagccggcagccggacctgtcgctgtcgatttcggatcgctgggtatccggagcgcgcgcgctctcgtctgcacaagccctggcgatgtaaacgagatactgacaggaaatagtactggtctgagtgtaagagagatattgattgcctagcaagnnnnnnnnnnagagcgcgcgcgttctcgtctgcacaaagccctggcgatgtaaacgaggtaatgacaggaaatagtactggtctgggtgtaagagagatattgattgcctagcaagatacattgaatgcggtgtaagaggctcctagctggtcttgacagcccgattcagcccgtgcacatcattgctttcgttcaacagtagctgccctgcgcgccagggctgcgttgccatgtgcgtcactggccttcagctgtggctcctccgcctccagcaggctcatgaggacggggcggccaccagggcccatcccaacggccgcatccatgagcatcccctcccactgatccccttgtagcagggagaagagcgtagaggaagcgaatcccccggcacggaccagctacgaggtgtggggcggactcgatggtaaggaaaagggtagaaagccagactgagccccacatggcgattgccagcatgtcaaaccgcacagaacatgagcattatacaccgtgcatatgcctacactcctacactagctgacgcaccttgacagtcacgtctgagcccctctcaggtcccttgagggggagcgtcactgatgcagtgtgtccgcctcggccaatgacgacggaactatcataccacggcccggcattcacaggtgtcccaagcttcgagaggaggcgattgtgggactgtgcggcgtccatgacatgcctgatggtgatatagtggagtcaattagagggttctcacgactatctgtaacactgattgtcaggttcttgaggcatgtctaggttacagccttagacaccagcaatcccactatctccatatcatacccaccgtttagtcgtcagatatannnnnnnnnncttcttgaggcatgtccaggttacaccctcagacaccagcaatcccactatctccagatcatacccaccgtttagtcgtcagatatattgccgcatctcccaaggcatcccatgcgtaatacatcgttacgccgacgaggccatatcctcctcctcttcgcgcaagctcgactgccatggcccacatccagcgaccagacaagattgatacaactactttacagatgcaggatacctagtcgtatactcatgtccagtataagttttacacccatatcgcgattggtatggtaattagtatatcgtgcagattgccaatgcgcaaccacagtttccaaccccccccccccccctgctgcgcgtgagaagcttgtgcaaggcacgtacctttacctttcgcagatattaatgagagagctcatcagccaactgagaagcaccatctatcctcaacgccattcaacctgtagctaccagtactacgatataatctggacgtcttgcaaccggtgacgcgatcgcgacaatcagtaacgggcccggtgatcatgttgcagagattcgttcgtattggcctgagtagcaatgcgcgttgcatggcgtactctgcgcaggccatgcgcaaagcgcctgaaaaggtaatgagtctcaataagacggtattgcgcttccatatgaatgtgatcagcgttcagagctgtttctatctctctggcgtcatgcagggtgtcgcacccggtctcacagacattgtcgacgagannnnnnnnnntaaagctgcttctatctctccggcgtcatgcaggttgtcacacccggtctcacagacattgtcgacgagaccaccaggtgaggtgtgagagtcataatctcggtgatggcatatgaagttgaaggtctcgtttcatctcgagggactgtaacctgttgcgacaccccagtggccatggtcgatgccccttgcactacaacgtcgtccatgcccgtgctagggttgtcagcgaggacgattttgtggagctggatgtggaatacgataggtacgcatactgcatttgctggaaattgttttttatctcgatattctaatccaaacacgacatagaacatccattgtgttgtgctaaatggccatttgctgcggtcaatgtttgtgattctgacatgattactggcattggctccatcttgcagggatgatcccaaagccattgcagatatgtatgccgcgcccgaacccctccagcctgtggatctggatgctgcgatggacatgtacgtcctatgactgtataccggcgtaggggtccatccctgtgactgggagtcatcttgtccagtctgtagtgcatgatgttggtgcaacgccacctgctggctggctgcttcgcactcaaatcccagccttccaagctcaggaggagtgaggctagcatccccgccgaggactttgagcctctgcacaacgagcccctggatcggccagtggagcttgagacagagtacgacaggtacagatggttgaccatgaatgtttagggcagcaagtaaaaagagctcgatggtgcagaataccagggagcaggtgaagcagtgcgccattacactcctcctcgagccacttcttcagggatgacctggatgccattggcgatatgtttgcgccaccccctccccttgagaacgtggacctagatgctgagctggacatgtcagtgtggggccctgtttgatgtgttgaattttgcgggggtttccaggacgagaggcatgtagctgcaatccaatgtcttgcaggccgcaaaatcctttcatagactcttgggtgccaaaccctgactccaggaggagtgaggagcgcattactgccgaggactttgagcctagacagtcggttcccctggaccgcccagtgtaccttgacgctgagtatgatatgtgtgtggatgcttgtgctggcgtggtgggaggaattcagtactttctccattgcatgccgcggtttgctttgtcggagcagaggccatgccaggcgcaccagctccagaccttggaggccttcagctcggattgatgttgtgcaggtcgattgaagcggatgatgaggcgccagatgagcaattcgacgcgcaggaggtgcccgacaagaagtgacagcgctcctatgatacggctcggaagcctgctggcatccagcgatgcttcctggagcccaggagagtgtagcggcgataattttgcaagctgtggaacagcatcatgtcagnnnnnnnnnncgcctgacaagaagtgacagcggtcctatgatacggctcagaagcctgccggcatccagcgatgcttcctggagcccaggggagtgtagcggcgataactttgcaagctgtggaacagcatcatgtcagtggctgccagcaaacaactgtggggtggctggacccctttccattttaaacatgtttccatgagcgtgcgtgcattgtcattactttcctaggcacaaagtgttttttaaacggcctcctgactgctcattggtggcccctgcggtcttgccaagcacctggaggcatgctgtttgcattggacggcttacagtccaacatgaagcgaatggcagggtgatcgacagagaatggcagcacacaggtcgaggaggaactcgggggagcaagcgcaaggagaagaatactcttggtatggcattggtagcgctcaggggtgtcacgtacaatgggagggcagtggcgtccagaggggagagcggccgcccttgtccctgttgggaggatgtcagttgtggaagcggcagcaggaggctgcatatcagcaggcacaggttgatgggagaaggcttggatgaagggcagtggatgcggggtgggcacgctgccaccaccgcgtctgcaatgtgcccgatgaaagagggtgcgggggcacccacgcctgaatactcaggccccgactcacgcgctcacaccccctcgcagccgactcagagnnnnnnnnnngcccacgcctgaatattcgggccccgactcacacgctcacaccccctcgcagccgactcagagtccccgcccaggcagcgcggcgtgcaggacgctgatccccgccgcgatgacgatgcgcttgacccaggtcgtctgccgggcgtgcggccgccgaccgcgtggcaggccatcccgccccatcccagcgcgagcgcccgcgggacctgtgcgcccgaacccgggcagggtccccgccgggtcgcacgccgggcggcgcagcgccggccgccgcgcgttgagcagggcgccgggtgggaagcgcggcaggtgcgcgtccagctcaaagtactcgagcgggcgggaggcgacgctgggaccggcgcacgggagggaccgtgaccggtcagacggtgggggggtggtactggcagcggcgccgtcgcgggcgctgccgcgtgcggaactgatcagcaggacggggccgccagcctcgaggcctgacgcaagcgagctcgccgcctgctttgggcgagcatggtccctgcgcaggttgggcagatgcacgagagatatgagcaggaacacgaccaggagaggctgctccgaccctgaccaggcctggcatcaggagtttgaggcaccatcccgttgtccatcagcctgtgccccatcgagattcccatgatgcctgggtgcgccattcaacttcccttcatccccctgtcctcgctcgaaaccaacgcacagtccccctccgcacccacctcagggcgctttcgtacttctnnnnnnnnnntgagagatatgaacaggaacacaaacaggagaggctgctccgtccctgaccaggcctggcatcaggagattgaggcaccatccagttgtccatcagcccgtgccccgtcgagattcccatgatacctaggtgcgccattcaatttccctcctaccccctgtcctcgctcgaatccaacgcacagcccctctctgcacccacctcagggcgctttcgtacttctggacgagcgaccacaggctcttgggcaccaccatcttcacaatggagggccggacctgggagtcctcaaagtagcaggtgaggagctcggtgccaacctcatgcgcctttatggcgatgcacgagacgtattcccgcacgcgcaccgcacccttgaccgcaccctcggctgcaggtggggttgtgagagggtgaccgaaaggagcggagggctgttgaaaggggcacacgccgcaaagcactcgctgcaacgcccgcctcgacccgcccttcccctgccgacactctggcgccccacagacacactcagagcgaggctgtgcacccgcatccaccccgctctcctcacctcctggcaactccacgtcgcggcacagcgcatagnnnnnnnnnnatggggttgtaagagagtgaccgaaaggatcggagggctgtttgaaggggcacacgccgcaaagtacttgctgcaacgcccgcctcaacctgccccttccctgccgacaccctggcgccccacagacacactcagagcgagtctgtgcacccgcatccagcccgctcttctcacctccgggcaactccacgtcgcggcacagcgcatagcagccgccgtcggccggcctgtcccagacgcggcgcgcgtagtggtactcgcgggaggcctgcaagggattggtggaggcaggcacattggatcgaggcaatgggggggatccacttgctggtgcgacccaggcacgagcatgatcgctgccatcctccatgatccttccctgccacaacaccctccctctgcaatcccnnnnnnnnnncggaggcaggcacattggattgaggcaacgggggggatccactggctggtgcgacccaggcacgagcatgatcactgcaatcctccatgatcctttcctgccacaacaccctccctctgcaatccccaccatgggccgggggaagcgcgagcgatacttctgcaggcaggactccggggcctcgggcgccgcctcctccggcgcgacgcgcgccacgagggtggccgcctcgtcccaacgcgcgcgcgcggcgtcgtccaggtggaaggcacggacgtcggcggggcgcacgccctccagcaccgcgcgcgtgcggtagaggtagaggccgcggcgcagcggccggcgccaggcctcgtaggcgatgccgtcgcgcctctcggccacaatgcgctcccagtcgccggttgccgccccggcgtcggcggcacccagcagcgcgtcgccgccgccccacgcctcgcgtgcgcccagnnnnnnnnnntgcttcgtcccaacgcgcgcgcgcggcatcgtccaggtggaaggcgcggacgtcggcggggcgcacgccctccagc

SEQ ID NO: 36260 - DNA, 501 bp, Chlorella protothecoides
tgggcagcgccaggcgcagcgcggccgctgccacgcgcgcggcaccggggcggcccgccgtcgcgcggcgcgcgcagcgtaatgcctcccccgccaccgcctccgacccggcgtcgccgtacgcgctgcgtggaggtgggtgcaagaggggaggcgggtcgcacggtggcaaggagggaggaggggctcgctgaggacaggcacacacacgctcgcggtatcctgtccagcacacgcagcatgcggcaccggggcaccccctccgagagttgtcaccctcgcccgccctcctctttccccccaacaccccaacccctgaacccaccccgccccactcacagcgcctcggcgacggcggcctcggcccagcccgcccacaccgcgcccgcctcctgcgggctgacgaccaggtcctgttccaaggctccgccctcctgcgccacctgcgccggcacgccgccgcgccccagctccaggccgcgcagggcctgcaccgccacg

SEQ ID NO: 36261 - DNA, 62 bp, Chlorella protothecoides
gggtgcgtattttgaggagggtggggcgtcgcggaggggcagagacgtgggagacttcgccg

SEQ ID NO: 36262 - DNA, 80 bp, Chlorella protothecoides
aggggcagagacgtgggagacttcgccggggtacagggatcgtgctagggggagtggggtggaaaaggggaagtatgcat

SEQ ID NO: 36263 - DNA, 578 bp, Chlorella protothecoides
  modified_base (87)..(339): a, c, t, g, unknown or other
gggggggggggggggggggggggggtgaggcaagaggcgacaggtgggggatcgtcaagcctgaccaaggagtccacgagctgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggggcccatgcctggcagggttgggggggcggggttggcgtgtgtgtgtggagtgggaggggagggtgaaagagtgggggtccggccaatgaagcgcaagcgagcactggtttgcctgccagcccgacagacctcaggctcagctccccttcccgactcctatggattcgacagcgcaccgtgaccctccagatcggcaagacactcccacccacctcaaacaaccgaccccgacc

SEQ ID NO: 36264 - DNA, 61 bp, Chlorella protothecoides
tcgtgatcgcagcgagcacatgctctggcgcgagcgcgctctcagacaagagcgggtgagc

SEQ ID NO: 36265 - DNA, 69 bp, Chlorella protothecoides
aaggtcgcgcggtgcgcatggtacagcaggaaggatgacgctgcacaaagtcacggcagtgcagcctgg

SEQ ID NO: 36266 - DNA, 134 bp, Chlorella protothecoides
gggggagagggtcaggcagaggaggtgattctgaaggaatattccagcaagacagggcggctttcgcagagcgggagagcgggccagacaatcgagggctgtgagaggtggcattgcacaaccgggtggtggta

SEQ ID NO: 36267 - DNA, 61 bp, Chlorella protothecoides
acggctgccagggcacacacagccgcgggggacattgccacctcggccgcctgcagctggc

SEQ ID NO: 36268 - DNA, 71 bp, Chlorella protothecoides
gcgtgggcaggccccactcctcttgcaggtgggtgcaccatcggtcacctccctggcgtgcctaaggcagg

SEQ ID NO: 36269 - DNA, 7662 bp, Chlorella protothecoides
  modified_base (2436)..(2445): a, c, t, g, unknown or other
  modified_base (3180)..(3189): a, c, t, g, unknown or other
  modified_base (4400)..(4409): a, c, t, g, unknown or other
  modified_base (4740)..(4749): a, c, t, g, unknown or other
  modified_base (4981)..(4990): a, c, t, g, unknown or other
  modified_base (5686)..(5695): a, c, t, g, unknown or other
  modified_base (5996)..(6005): a, c, t, g, unknown or other
  modified_base (6175)..(6184): a, c, t, g, unknown or other
  modified_base (7248)..(7257): a, c, t, g, unknown or other
ctgctctgcgcgcgctgcacctcgcacgccgcctcccgcctgtccgggtcgtcctcaaagtccaagccctcgtgcggccgctcccgctcaaagtccaggaggtccggggccctgccttcccgggtgtgcccggggcgggcgaggcgcggcgtggtgccggggcccagggccgccgcccgcgcagccagggcaaccgcggcgggcgcgtcgcacacgtcgcagcacccgtggcccaaagcctcgccggccttccccgatccaacggtcagccactcgccaaagtgggcgagcagcgcccggcgcctgcagcgggccaccaggcagtagtcgaccacggggccggaggcgtctcgagaggcgtcgtcggaggcatcgccggcgcccgcgccgcgcactccgcccaccgcactcctccccgcggccccgcctcccttctgcgccgcacgccgcagctcgagggccgcgaggtagcgcagcgccccgcagtcccggtgggagcagagcaggatggcccgggcgggggagccatcacgccccgagcgcccgctctcctggtagtagccctccagggacttgggcagggtggcgtggatcaccaggtccacatctgtagaaggtggaagggggggcggggggggaggggtgtctgcatcgacatggagttccaaggacggcggcgtgtggtgaggatggggagtgagggaccacagagtggcagcaagctgagcacccgaacccacaactttgtcctcacacccctgcactccgggcacatccccatcgccctccactccgccagtacctggtctgtcgatgcccatgccaaaggcgatggtggcgacgatgacgtggagctggcgcgccgaccaggcggcctgcgtctcggcacgctgggcggcgcccaggccggcgtggtagggccgcgccgccgtgccggccctggcgagcgcgagcgccacgctctccaccagctcccgggagcgacagtacacaatggccgcgcgcggtcggtgctgctgcagcaggcgcgtgacgtgcggcgctgggtcgtcgtcgacccactgctcccggggggaggttccctcggcggagtgggcgggggtggcgggcaggaacggtgttgaggcggccatgtccaggtacacgactgcaaggtgcgggtgatggggtgagaaccaacactcggcgcctgtttcggctgggggttggaacatgtggaacccatccagctgcaaggcccgtcctgatgtgcctgcggaggacacagcccagcaggcacctcggcgggtgcactgcagactcccccccccacccctgcactctgcgtttccgcgtcgccccgcccaccggagtagtgtatgtttggcctgtcgaaggaggaggccagcctgaccgggtcacgaagcctgagctgggagacaatgtcgtcctggaccctggcggtggccgtggcggtcagggccatgatgggcacctctggaaagcgggacctgagggagcccagcttcctgtaggacagggagtgagggcaaaattacaggtctgatcatccaccaggctgtgccagagagggcccccgggatgtttcgacaacgttctccactatctcaaacttgggtaccgacacccagagcacacagcacgcccatcaccactggacacaatgaatgcaccccattgacccccaccccccccggctccacccgccggggacccacctgtagctggcccggaagtcgtggccccaggagctgatgcagtgggcctcgtccaccgcaaacagggtcagtttccccgcggccgcaagcccgcccagcagcgcgtccgccggcgcggtggccaggtactccggggtcaagaacaggacccgcgtctcgggccgcggcgcctgtaggtcagcgagcaggtcgcgccgctgctgggtggggagcgaggaggaaagggcggcggcagggacaccccgcgcacgcaggccctgcacctggtcctccatcagagcgatcagcgggctgaccacgagggccacgccggggccgtgaccgccagccagcaggggaggaaggcagaagcacagggacttgccgctgcccgtcgacatgagcaccaagcagtctcggcctggcacaggcggcggtgtgtgtgggagggggtggttgtggtcatcgacactgcgggtgggtgaaggagcatgccctgggccgcaaggaggggatgccccgtgcctgctgggtcccacgccaaggcaacatccaccctgggccggacgagagcacgtgcctgccatcgcagccgtgatggcctccagctggttggggcggaacgcgtcatgctctgtggcaaggggcgatcgaacttagatcaatctgtgtgattcccggcggccagagcacggtcatgttcatcacagatgagcagcaaggcatgggcaacacgtcnnnnnnnnnncactcagatcaatctgtgtgattcccggcggccaagcacggtcatgttcatcatagatgagcagcaaggcatgggcaacacgtctgaggctgtgccgccacgggttttcgctccacaggggttccgatcacccactcaaacccaccccagtgtttgtgtaggagctgcagcgcctcctctcgtagccccggggggacccccccctccaccgtcatgggcccttctcaatccaacatggtttcgatgccggctgcaaccgggatgatggtgatgaacctttcatgtgccccatcgcaggcatggggtcgaccatgcggtcagcccagacctttctgagtcacttcgcaggcagagggagacgtgctgcgtccccaaaccgacactcccgggacaatactgagtgcacagcccggcgccatcccagcagacccatgtttgaacaagtaacacaaatgcaaagcatttcttggtcgggctgtgagagtgccctgctaggccggacctactttccttgcgcggcggggccttgcagtggcccgtcggggatgctaacgcatctcatgagccaacctccaaatatcaacataattcagaaggagagagtatcgactacaagggcttgagatcgcagttggcacacattgagggtatccggtgatccctgttgggccccccgtcggccatgggtgcgccaggccttactttgttcgcatgtgttacttcattgcaacgccnnnnnnnnnnaagtggcccgtcggggatgcgaacgcatctcatgagccgacttccaaatattaacataattcagaacgatagagtatcgagtgcaagggctatagatcgcagttggcacacattgagtgtatccggtgatccctgttgggcccccggtcggccatgagtgattacctctcatccctagactttacttcgcccagatatcttttctccacacactgcctgcctggatgctagccaagatgttcatcacacatggcctccccggcgggtacaatgtcagattggccgttatctcactgctgaagcagcctgccgccacttgccacagcccctttcaggatgggtgcgactgcgatgtgctctacccttggatatacagcaccaagtgaatggtctcagccgtgtaggcggcaatggaacgtgggaatggaaggcaaagaagttgcggtttcatcgaacatgaagtaacagtactttaccaggtcagggtcaggatgttttgagctcccctgtccactttacggcgactccatggacatgggactaaaatgccatccaggtgctctgcatctgcgtctcccaagtggtcgggtggaagtaatacaatgcagatcaacagtgagtggccccagcccggaacaagacattaagatgcttgggaatcaagcaggcagtgactttgatgggccacacctggccctacagcatgcttgctcaatagtaccccaacgggccgaaagaatgggatctgacattagccgaagatctcgggcgacgattgaaatttctagagtttgcaaacggctcctgtattctctcgagagctggcgaattctaacaaccctgcggcaaggactgggcacatgggtgcgccaggtcttactgtgttcgcatgtgttacttcattgcaacgcctcatgtcatcgctccccacccactcaggtttgccgggaccgcgatcacgcacgtaattttaatgaaacccaatcctgcgtggtacagggccagggtgggtgctgggacaacaatagagtggaagcgcggtctcagtgcggggtcccttcggatgtcgggtcatatgcagatctgggtggagcgatagatgttccgggtgatggatgtcatgaagtgatggccctcgtcttgcaagacttctttcatgcgctccttggggattaggacatgagtcgtgagggctccagggtaacggcccnnnnnnnnnncttcaatgaaacccaatcctgcgtgtgttagggccagggtgggtgctgggagaacaatagaatagaagcgcggtctcagtgcggggtcccctcggatgtcgggtcatatgcagatcttggtggagcgatagacgttccgggtgacggttgtcatgaaatgatggccctcgtcttgcaagacttcgttcatgcgctccgtggggattaggacttgagtcgtgagggctccagggtaacggccctccccaatggccttgggagccaccggggcggacatgcccttaaagaaaattatcagattgagcaagttcgcactgtctgcaagctacannnnnnnnnngtggccttgggagccactaaggcggacatgcccttgcaggaaatcattagactgagcaagttcgcactgtctgcaagctacacggatctttcatgatgtacatatgctataacaaacagtattggaaactttggtgtcgggtttcgcgacttgttttgaatggatatgagaaacagggaatttcccagcaggcgttgcatgcctccgacatcgattccccgttcaactccgnnnnnnnnnnagatctttcatgatgtacatatgctgtaaccaacaatattgggaactttggtgcggggtttcgcgactcgtttgaatggatatgagaaacagggaatctcccagcaggcgttgcatgccctccgacatcgattccccgttcaactccgtgcatgcaggcaccctcctcagcgcacgagggaatcgccacagcccaaacccatacccctttctgtcttgacgtgcttgacccctcagacgtcgcaccgcgcggcatggtggaggctggcgttcaggccgagctggagagcttgagggctcgcctggcacagtctgagctggacaaggcagccttgcagtcggacgtggagatgctgtgcctgcagaccacatccaacaccacattcaattcctcatctgtcctgcaagaaagaatccggtacactggtgcgcagcggttctagtgtggggtcggatggtgggagtgcatgcccttcatgggaccagggggggtccgagtcgaccgcaccctcccattcgtctagcacctgaccctggggtgcgaacttgttttattgtggtaaccattgtatctaggtgagcacgagtgggcttgatatgggaagcatgcaccacagatggagctaatgtaaggactgcccatcaataaatccctcccctggcctgatgccaagcagacaaggagctgtcgagctgnnnnnnnnnncggtgagcacgagtgggcttgatatgtgaagcatgcacaacagatggagctcatgcaaggactgcccaccaatcaatccctcccctggcctaatgccaagcagacaaggagctgtcgagctgcagggcagccctggccgcctcccaggcccaggcctccagcctgggggaggacctgcgtgccctgaaggctgcgcaccgagacacgggcgcccggctgcgagacgccctggaccggtccgccctactggaccgcgagcttgctttctaccagacctcctccgcccgggccgtggcggacnnnnnnnnnntctggaccgcgagcttgctttctatcagacctcctccgcccgggccgtggcggaccgggaccgcaccgcctacgaggcggagggtctgcgtgagcggaccctggcgctggagacccggctggaagacgcggagggccatgcggcgacgcagggcgcggcgcgcttggccnnnnnnnnnncgagcggaccctggcgctggaggcccggctggaagacgcggagggccacgcggcgacgcagggcgcggcgcgcttggccgccgaagagcgggaggcggtcctccgggctgaggtcgcgcggctggaggccctggcggcggaggcggccaagctgccgggcctgagggaggagctggctgcggcgctgcggcgggaagctgccttggagcgccggctggcgcgggccggggaggaggcagaggacctgcgcggccggctggaggaggccgcacaggccgcggccgacgctgcggcggcctacgagcggcagggggccgagctggaggccgagcgcgacacgaagagaggggcgcaggcagaacttgaatcggcgcggcgccagctggcgggcctggaggcggagctggcggcagcggcggcgagcagggaggccgccgacgcggcgctggtccggcgcgacaaggaggcggtggcgctggaggcgggcgcagcggaggcgcggtcttcgctggaggaggtcgcggcgcagaaggtctcagccctgctgcggctgtcggaggcggagggcctgttggccaggtacaaggagcgggtggcgagcctggcggcgagcctggaggcggcgaggcgggacgcggcggcgggggcgccgtcggggaacgatagcgcgcactcctcgcccagcaagcctgccaccagcccggccaagggccgcgccgtgcctggcggggggtggtggggccgcagcaacagcctcgagccctgagcagcctcgggctcggagccgcactgcgctggcatgctatagccggactgctcgactcgtccatacatcaaccctgacccctgacccctcgacccctcgcccatagcactgccccttgcgcccttgcccggcatcgcaggccacatttcgacaactctgcagctcggtttctgttgtcaggttggctcctccaaactgctgtacaggtttacaggcatagcattcccaaagaaagcaagggagagccatgcagggagctacgccatcccccccgaagccgtgccgtccaaccacaccnnnnnnnnnncccatagcactgccccttgcaccctcgcccggcatcgcaggccacattccgacaactctgcagctcggttctgttgtcaggttggttcctccaacctactgtacaggtttacaggcacagcattcccaaagaaagcaaaggagagccatgcagggagctacgccatctccccccgaagccgtgccgtccaaccaccccgccacgatcctcgtcagcgggcgccgctcttcagccccttagcggcctggtccaggaagctgcgcgccaggcccgccgcgtcccccagcgcgcgcttggccaggtcggccgcggcccgcgcctgctgctccggcgtgggctgacggtaggcgtaggccgcgcggcgcaccgccgccgccagcggcccctccagcgacagccggtccg

SEQ ID NO: 36270 - DNA, 61 bp, Chlorella protothecoides
gagggtgctgcgattgctgttgccggcaggtgtggtgggaggacggggatagcatggcacc

SEQ ID NO: 36271 - DNA, 61 bp, Chlorella protothecoides
ggagcagtcggatattgccgcggcccagtttccctgccactggtcaccaacatcactgatg

SEQ ID NO: 36272 - DNA, 93 bp, Chlorella protothecoides
atgcatggcgcgtctgcccggccccagggcgcatgccggtgcatggagttctccctcatcccccagtgctgttccagggaggtagtctccatg

SEQ ID NO: 36273 - DNA, 79 bp, Chlorella protothecoides
agtctcgtctcggcgcgcgctgctgctgaatttcatagatccataccgagctcgtcccaacgggacaccctgcccgttt

SEQ ID NO: 36274 - DNA, 84 bp, Chlorella protothecoides
gtcaggtggggcacagggccagtgggcggtcggccgggggctcgtcgccccagggagctcacagagatctgggtgccatgcttg

SEQ ID NO: 36275 - DNA, 145 bp, Chlorella protothecoides
gtccttgtctgtcctccaggcctcatgcaggacggctgttctgctgaagcccggcatgcaccggtgaatgtccttccgctccgaatcactccgcagggcgcctacggcgtctgcggatgctgatccagcagcagccagtcctgca

SEQ ID NO: 36276 - DNA, 77 bp, Chlorella protothecoides
ggtcgtcacgggcgcgccctcgtccacgtcggggcgggctcgccccctctccgccgccacgcggcccgccagcttgg

SEQ ID NO: 36277 - DNA, 74 bp, Chlorella protothecoides
agctgggcctcgacgccagccggcctgccgtgggggtcgaagatgcggggcgtcccggtgccgcgccgctcgat

SEQ ID NO: 36278 - DNA, 70 bp, Chlorella protothecoides
ttgcaggggcgatgggcgcaccgacgtatcgtcaaggctttcggcagcggcgtactcacacccgatggta

SEQ ID NO: 36279 - DNA, 61 bp, Chlorella protothecoides
agaatccattgtcgcttattcagtggatgggccgtcattactagccttagttgcgttgcta

SEQ ID NO: 36280 - DNA, 80 bp, Chlorella protothecoides
tctgggtcgggagtagggtgaagcacagggacaccaacaccacacccccgcacgcaccttggaggtgatctttttctccg

SEQ ID NO: 36281 - DNA, 404 bp, Chlorella protothecoides
ccggcgcccaggccgcccggccccggctgctgcaactcggcggcggtgagcagcgccgcgtagcgcttgcgcgccgccaggcggaagcgcgcggccagccagtcggcgtcggcggggttgcccgggtcgcgcaggaggcagaagagctccgtggcgggggtgaggacggggggggtggcgccgcgcacgctcagcgcgccctccgtcagcccgttgacggtgtcctcgctggagaaggttgaattttggatgagggaggttggttggggggtggtgacctggggaggagtgctccctcgtggctgtggagtgctggagtctgtgctgggcccgcggtggcgtggacgcacttgcagccctgctgggcaccccctcctccctacccttttccccaaatacccccc

SEQ ID NO: 36282 - DNA, 159 bp, Chlorella protothecoides
tccacccaggtatggaccaagctgcgccccggcgtccgcgctttccttgccggtgccgccgagctgtttgagatgacggtgcacaccaatggtgcggtcggggatattacttgggcggcggggttgcgaaagggacgtggtggcgtggcatgcatcacc

SEQ ID NO: 36283 - DNA, 113 bp, Chlorella protothecoides
gagccagtccatccgattgatttgaagctccatcagccacccatgccagtgctcttggccatcaaacccggcataccttgccattcctggtgacggggtccccaacagtcagg

SEQ ID NO: 36284 - DNA, 61 bp, Chlorella protothecoides
tgctcctgtgggggacaccacgcatgggcaccgccctcctcccttcctgagctgccaccct

SEQ ID NO: 36285 - DNA, 61 bp, Chlorella protothecoides
gcgctggcggctgccgcgcagcagaagcaggagcagcagcagcagcagcagcagcactggc

SEQ ID NO: 36286 - DNA, 61 bp, Chlorella protothecoides
aggcttgattggagaacacacttgataacaaagtgttcatcgagcacaatgtcaccgcttt

SEQ ID NO: 36287 - DNA, 69 bp, Chlorella protothecoides
cacccagcagcgcctaaaccctgcgccgaggtatactatgcgatgaacaagagactaagatggatgagg

SEQ ID NO: 36288 - DNA, 87 bp, Chlorella protothecoides
ccagcctgctgggcctaacgcctggcgtgcagccatgcaaacgatcgcagttactgtggtccccccccccccccccccccccccccc

SEQ ID NO: 36289 - DNA, 61 bp, Chlorella protothecoides
tggctgcttgaatcggtgagggagtggctttaatcgattctcgtgtttgggttctgcgact

SEQ ID NO: 36290 - DNA, 109 bp, Chlorella protothecoides
caggaccaggcgggctcccactcccattcctcctgggcatccccgctcggcccactccagtccccaagcaacacacacacctgcccgcacctggcaggaggggctgggg

SEQ ID NO: 36291 - DNA, 153 bp, Chlorella protothecoides
acgaggcatacgtgggcatgaaggtgcttgaggatgtggaatcggggggggtagaggtgactggggcaggcctttctggactcctcgaggcagggaagtgagtgccagtgccccggatcccgacatctctgcagggtgtcgctcgaggaacgc

SEQ ID NO: 36292 - DNA, 107 bp, Chlorella protothecoides
ggtcacgagtgacctgccgggctctgcagccttcgaccctcccccccccctcgggttcaaaaccaaccctccacctgcacctccgccggccaggtacgcggagatgg

SEQ ID NO: 36293 - DNA, 61 bp, Chlorella protothecoides
tataccaccacgaactcatgcgaggatgttcgaggcgagtgtccatggtatcaccttgggt

SEQ ID NO: 36294 - DNA, 68 bp, Chlorella protothecoides
tgtgtgagagcgccaatgcagcgcctgctggctggcactgtgtgagagcgccaatgcggcgcctgctg

SEQ ID NO: 36295 - DNA, 61 bp, Chlorella protothecoides
gtaagttgtaatacactggtcgatgtgcagaatttatcgaagcgatgcatgcccctccagt

SEQ ID NO: 36296 - DNA, 61 bp, Chlorella protothecoides
tccaggcgcagctctccaacggctccatgggaccctacaggcaagacctcgccaatccggt

SEQ ID NO: 36297 - DNA, 76 bp, Chlorella protothecoides
ctccatgtcatagcaacaccaagaagggggcggttggccagtggtcaagattgcgagagacgcctatgcctgaatg

SEQ ID NO: 36298 - DNA, 64 bp, Chlorella protothecoides
tgcggctagacctccatgtcatagcaacccaagtgggggggggggtggccggtggtgaagattg

SEQ ID NO: 36299 - DNA, 61 bp, Chlorella protothecoides
gggtggcacgccctgcgcactgtgagcaggggcgccaccgagaggcacatttacgctcacg

SEQ ID NO: 36300 - DNA, 75 bp, Chlorella protothecoides
gccgcagaccggcatccaggatctgcatgcatagtgtatggagggggagggggaggggggtcctgtctgcaagat

SEQ ID NO: 36301 - DNA, 70 bp, Chlorella protothecoides
tgtgggtgatagtctggcgtgacgtcgaaccttgcccgtccatcgcccgaggtgagatcatttaccgagt

SEQ ID NO: 36302 - DNA, 61 bp, Chlorella protothecoides
accatcacaaaggtttgaaggcgggtatgccggccctgccattatgctcaccccatccaca

SEQ ID NO: 36303 - DNA, 91 bp, Chlorella protothecoides
tggagcagaactgttacgatcgtggggattcaagcgaagcggaagaccgactcgtcgagacggtgttgggcccacgggtgcagtatcgaac

SEQ ID NO: 36304 - DNA, 112 bp, Chlorella protothecoides
gacctctccctgcactacctggtgcgagtgcggggtcttgtaatggctgttgggatgtgtcggtgcatgcgccgagcagggcagctgtttgtgtcagggggtgccctcagca

SEQ ID NO: 36305 - DNA, 61 bp, Chlorella protothecoides
tggacactctcacgttccgatcatccctgcaccatgtctctccgccacagtatcgccagcc

SEQ ID NO: 36306 - DNA, 69 bp, Chlorella protothecoides
gggcggtgggagggcaggcgggggaggggaaccccctgcggcgccagcctcagcgggtggaggagaggc

SEQ ID NO: 36307 - DNA, 77 bp, Chlorella protothecoides
cagtgcagggccagtctgagggctgggtgctgtgggccgggccatggagggcagccccgcctgctgacctgtcacgg

SEQ ID NO: 36308 - DNA, 62 bp, Chlorella protothecoides
cgaggcagaagaggaggtggaggaggggcccgcccccgccactcccttctccgtgtccatcg

SEQ ID NO: 36309 - DNA, 67 bp, Chlorella protothecoides
cccctcctcatacatcgcctgcctcgttgctaagctagtcgcttacaaatatgggatccacaccagg

SEQ ID NO: 36310 - DNA, 61 bp, Chlorella protothecoides
ccccctaaaagctaactacatgccccgcacacctgcccctctgggggacacagcccatgtg

SEQ ID NO: 36311 - DNA, 61 bp, Chlorella protothecoides
atgccctgtgaggactgggcgcttttccataccctgtttcctcgctgctgctcctccaacc

SEQ ID NO: 36312 - DNA, 77 bp, Chlorella protothecoides
ggccaccactttgtcttctgcagctcgccggtttgggaattttcaaacagatgcttcagtgaatttcagtgattgta

SEQ ID NO: 36313 - DNA, 8130 bp, Chlorella protothecoides
  modified_base (477)..(486): a, c, t, g, unknown or other
  modified_base (857)..(866): a, c, t, g, unknown or other
  modified_base (1151)..(1160): a, c, t, g, unknown or other
  modified_base (2810)..(2819): a, c, t, g, unknown or other
  modified_base (3863)..(3872): a, c, t, g, unknown or other
  modified_base (5893)..(5995): a, c, t, g, unknown or other
  modified_base (6773)..(6823): a, c, t, g, unknown or other
  modified_base (7023)..(7032): a, c, t, g, unknown or other
  modified_base (7124)..(7133): a, c, t, g, unknown or other
  modified_base (7225)..(7320): a, c, t, g, unknown or other
  modified_base (7856)..(7995): a, c, t, g, unknown or other
cggcgacctggcctgggcggcccgcgccgcgccggggcctggcgccacgctctgggcggacgcggcggacgcgcgctacgcgcgctggctgccggaggagtgctcctccgcgccatgcctggaggccaacgcgcgcgccgcgctggtggtggacgccgacgccgtgcgccgcgacctggccgccgccctgcccatcctgtcggtggtcggcggcgatcctgccgacgccgtggcgcggctggaaagcgtgctgccgcgcccacccgacgcccccgcgccgccgccggggacgacgggcctctggtgggacctggactgagggaccgcggcggtggggttgcccctcgaatgagacccgagtagtactgcctcgacctcgtgcctgctgtccacccttctgcctctctgctgtcgcagcagcatctcaccaggtgcacggttgcagagcacacagggggtgggtgacagtgaatagcnnnnnnnnnnttccacccttctgccctctctgctgtcgcagcaacatctcaccaggtgcacggttgcagggcacacagggggtgggtgacagtgaatagcgcaagcggggtccggccagtgaaggagcgggtggcgtacagagcagtgcatttttgcgagggaagagtgatggcgcagccgtgcatgcgtggagatgatcagctgccggtgtggtgtggggggggcgtgagcacagcaggggttgagagggaggtggagcgggttgcagatcactctgcggacgaggagcctcgtgctgcggtttcgggaaccttgcatgccgcgaatcgtgtcacctccaaagcttgcaaactaggggcatccagagcctcagtcgaggnnnnnnnnnngatcgtgtcaactccaaggcttgcgaactaggggcatccagagcctcagtcgaggggcctctccgggctcgagccctccacagacccaagctgcgcacaaatttcctggacgccaggcctgggtacagtcggctgagacgccaagcagtggcttgccctccggccgcacgtctccggggagcgaggcgcctgctcgccaccaccatcacactcacacacacagacaccccccccacacacacacacatcaagcaaggcgcagcgcgcggctgacgacctgagagnnnnnnnnnngtttcctggccgccaggccggggtacagtcggctgagatgccaagcagtggctcgccctctggccgcacgtcttcgggagcgaggcgcctgcccgccaccaccatcacactcacacacacagacaacccccccccacacacacatcaagcgaggcgcagcgcgcggctgacgacctgagaggtccagttggcggtctcgcccagagaaggcacctggcccgcggcctccacgaactctgcgagcgcgggccggtcgcgcagcgcggcccccgcgcccgccagcgaggcggcgacgtctcccagcagggccagcgcggccttccagacaccgacgtcgcggtgcgcatcgtcgcgcgcgatgcccgcgatcaggtccaggatggccggccccgcggcgcgcaggtgcgcgtcggccttggccttggacaggccgttcagcatgcccgcccaggcctccagtatgccgtggcgcagcgcgttgttgtactcgcccagctcctcctcgccgccggcgcccgcgccggccagctgcgcgctgagcgccatggagccctgcagcaccgcggccacgtggcccaggtagggctcgaagccgtcgcccagcgccagcgccacgtcgcccagcgcggagagcagggccggcttcaggctgcggtccacgctgccgtcgcccaggttggtcagcaccgccgacatggcgcggtcggcgtagggggccagcccctcctccaccgcgcgacacacgtcgcccagcacacccacgctgacctggcacacctggacctcctgcagtgtgtttgttaattgtgtggtttggggggggggaaggggggacgtgagggatatgtttgagtgtgtgttgacatgtacgataccactccagactacctgcgcaagttcctgaacgccacgctcgacagcctcccctgcagcaagagcgcaggcagcatcccatgttcctccttccccccccccaactcacacacaacatctccctcccacctggtgctggacgaggcctcggtgcagcaccggaaagaaggcctccaggtacttgccgaagccgcggccggtggcgtaggtcagcgcacccatggccagcatggcctcctcatgcacggtgccggcgcggcaggcgaagacgcccagcagcgcgcccgccaccgcgtcggcggcctgcgccgcagcggcgcgcccgccgtcgtcgtcgctgagccgctggagcaggacctggagcacgccgcagagcagggcctgctcctccccctgcttctccaccgcctcgggggagggcgcggcgtgcgcgctggcggcctgcaggcgcgccaccatcagcggcaccagctgcgccaccagggggacggtgtcgggggccgaggcgcggaccacctcgttgatggcctcgaaggcctgcgtctgcagccgcgccgtctccccggcgtccgccgtcgtccgggacgcctgtgcgagggggttggggggcgtccgtggggtcctgctggggtgagcggggcgaccctgcagcaccagggcagccgcagtctgtcctctcaccacgtgcacgcagactacccatgggcggggtcctgcatgccagcccgcccagtaccctcccaccaaccacgcacactcctggtcccgcttgggcannnnnnnnnntgcctgttcgagggggtgggggtggggggtcccgtggagtgctgctggggcgagcggggcgaccctgcagcaccggggcggctgcagtctgtcctctcaccacatgcacgcagactagccatgggcggggccctgcatgccagcccgcccagtgccctcccacccaccacgcacactcctggtcccgcttgggcacctccaaccacactcgacccgcaccgtctggaggagggcctggatgacggtctggaagtagggggacatgggcgaggtgcccgcgcccccttcgaaccctgccgccagctggctgagcgcatagcagaccttctcggccaccagcggcccgtcgccgatggcctccagcagggcctggatgatctggggcaggttctgggggccgatcagcgcggctcccgtgccatgcacaaactccagcgtgcggcctgcgatggggagccgcgcaggggacggggtgtgcagggtgcgtgcaggcatctggccttgggtacttgggctgtcgcgcgctgtcgacaagcagggtgccgcccacggccccgctgcactcaccgatggtccaggcggtggtgttcttgacctgcgggtgggcatccttgagcgccgccaggaggaaggggaggcccgcggacacgagagaccccagggtctcggggcttgggccctccagcatgctgccaaaggcaaaggtcgctgcctccctggcccgccagtcctcgggggtgctgttcttctggatgtttgcctgcgcgatgcgtcggggggaggagaggcagtcgggcatgcttggtgtggctggatctggctggacgtgtacagtgctgcacacctggcgcaggatccggcatgggacacccatgccatgcggtcacagccccttcccccctttccactgaacacccagtagaccccccccccttttcaggatgcgcctggtctgataccctcacccccccacaaaccccacgatcctcccccaggagaagcacaagacacctgctgacctgtacatagggcatgacgaggggnnnnnnnnnncatgccatgcggtcacagcccctttccccctttccactgaacacccagcagacctcccctttttcaggatgcgcctggtctgataccctcaccccccaccctcccacaaaccccatgttcctccccccggagaagcacaagacacccgctgacctgtacatagggcatgacgaggggcacgatggcgtcgcccaccacccccgcgcagagtccgaggcaggtccccgcagccatggccaggttccaggcgccctcctcgccctcctcgccctcctcctgcttggtcagctgctccagcaggagcggggccagctgcggcagggcggcggccacgaagccgtgcagcacgccgccctcctcctccgcggcggcctcctcctcgcacaggctgcaccagaactccagcgcctgcagcgccacgctctcctcatcgccgcggatggcgcgctggctgagcgcgaagatgtcggccatgtaggccggcagcgtctcgtagtagttccccgcgatgctcaccaggcactcccaggccgcgtggcgaaggcgcgcgtcccccgccaccgtcccctcgcacacgcgctgcatgatgtagctgcgctcgccctccgactcaaagttcttgcgcgcgaactccagtgcgttgcccagggcggtggtggccgccagccgcacctccgcatcggccgtgcccttgtccatgccgcccaccaccgccgtcaggatctggttcactgcgccctgctccaggtagtcctcctccagcgccccaagctcctcgcacacgtaccccagcgtctccagaccggcgtgccgcacgcctggcgcggcggtgccggtgcccgccgccgccagcagcgacgggatcagctccggccaggagccggcggggatctcgatggcgcccaccttggcgatgaccaggcccgcggtgtgccgggcatccgccacctggcgagtggagagggaggggatggtgaaggaatggggggcggtacggtaagttgaatcggatgagtcatcataatggcccggtgcgccagggagagtgggagtgggagtgacgtaggacggtgattgtgggacatatgatcgtgattctgtgacagatgaatgtagttgtgcccaaggaaaagtacaccacctccataccgaaccaggtgaagcagccttgcctcgccgtctcaccccgtccccccagtcccgtattatcacctcagcgtgcatggtggccaggagcgactgcttgacctgagaccgcactcccgcatccagagacatccaccgctccgacaggcctgcctgttgacatatttgcgtggtggggtgcctgggtgatctgatctggctgccaggcacagtgccagccaggcccggccgctggatcccggccggcatccaatcgcacctgtcgacttgcttctttcgcatccagcgcattcttgaggaccaggcccgccaggcggcgggagctgaccggtttatcgccactgcctagctcggcggcaagggacagcacgaaggaggggaactgggactcctgcagccctttcagttgcccctcagccgcattacgagtggccgcatcggggctctgtgcgctgtccagcagggaggtgatgtccagcacctgcgccatcctgcccacaggaggcgggtgtcgccgggcctagccgcagtctcgagcaatgcagagttcaatttcggcccctgattgatcacgacgcaggtccggaggggcagaggggcgtgtgccgatgggtggggatgtggtggactgctggcgggggtacaaagtgaatgaagcctcgatggggaaggggccagggggcagggtcgaatgcgggggcccagtcatggcacagagctttgatggcccggtgggcgcgggacggcccctgtcaatcgagccgcggccaatccgctgtcttccccctgccagatccgatatagcactccaagacggtgcgagctgatcaatcgtatggcgagccttgccttccggacgctgcccttcgtgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgccacatcgccatgtcttccagtgagcggcttagaagtctcaagtacttgctctggtgctgcgtaaggcccaatattcaccacttcaccctcggtcccctgcagtctcccgtgaagtgatcgccaccgagaatgctcccggggcggtgggcgcgtactcccaggcgatcaaggccaatggatttgtctacatctcaggccaggttcccctggttcccggcgtgagttgcatcctttgggtttcagctccggggcgcgggggggtctcggtccaggtggtgcaatgtggtgggaccaactacatgccaaccccccgaagcgcaccgattcattcacaaagccgcatcgcagacttctgttgaacctgcataccattccacacccctccacagaccaagaacttcaactctgaggatgtggaggagcaggcggagcaggtcatgaagaacctggaggccatcctgaaggaggctgggtcgtccttctctcgtgtggtgaagaccaccatcctcctggccgatattgccgacttcgccaaggtcaacgccgtgtacggcaagtacttccccgtcgacccccccgcgcgcgccgcctacgccgtgcgcgacctccccctgggggccaaagtggagattgaggcggtggcccttgcgccgtgattgggaccctgatcctctcatgactaactggctgcactcccatcagctccagcaaatgctcgcgcaggcccgatgccatgcgtggaaggctgaatctcctgaaattacgacccatnnnnnnnnnnnnnnnnnnnnnnnnnnnnnnnnnnnnnnnnnnnnnnnnnnntcgtctctccgacttttcagcagatggaggcgtttcattgccggctgcttggaggaccccaggcacgtcgtggcaggaagcagggtcaacgagcagagtggggacaaccgtcagtgagctgcacgcgtgccccccaccgaccaaagggccgcctccctaggtccagccaagtggcaacttggacgctcaggtcccgcctnnnnnnnnnngcagcctaactcaggggcgtcccagctgaaaggtgcttggtaatcgtgggcctggaggacgccaccctggcaggttccactggcacggcacnnnnnnnnnnacagcctaactcaggggcgtcccagctgaattgtgtttggtaatcatggacctggaggaccccaccctggcaggttccactggcacggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcagagtggggacaaccgtcagtgaactgcacgcgtgcccccgaccgcccatagggccgcctccctaggtccagccgagtggcaacttggacgctcaggtcccgcctctacctcgccagcatggcccgcagttcccacgcggcctgccccacgtcccctccctcgccgcccagctgcgcggcgacttcctccaggcccaggccccgcgcccccgcccgcagaggccgcacagtgtgcagcagggtgcccaaggccacgaggccacgcacccgtgtctcgctttcttcccccggcgtgctcagcagcacgtcgctcgccgcagacaggatctgcagttgcatgggtggggggtgtggagggtgaatacaggtcgacaggattgcagttcttagaggtgctacctgagcaatccatctccaaggtaaaccccccctcttcaccccacacgccacgccttcacctcacttgatgaagggtctgtgactggtcgggcttctccactttcccctccacacaacctttccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggccacgagggccagcaccgcattgtgcagcgcggtgactaacgcgtggcgcgcggccttggtctccggcggcagcgccgtggccagcgccgccgtcagcgccgcgccgcccgcccgcgcccactcgcgcgtc

SEQ ID NO: 36314 - DNA, 77 bp, Chlorella protothecoides
aggtaaggcaatgtcgggtgatggccgtgaccatttgctaatcttgacatgagctcgcttgcgcgtgcttgcagatt

SEQ ID NO: 36315 - DNA, 151 bp, Chlorella protothecoides
tcggccccacctcctcatatgtccggcgggtaggggagggcgcgccctcattcaccatgacgacgaaggcaagaggctctcaaccggggatgcgagttgggagaatccaaagtctacatgtgccagagaccgacaagcatctgcagtgcgc

SEQ ID NO: 36316 - DNA, 72 bp, Chlorella protothecoides
tgcccccgccggcgccggggcgcctcgccgcctgccttcccaacccagcctccccccccttccaaagcggcg

SEQ ID NO: 36317 - DNA, 355 bp, Chlorella protothecoides
  modified_base (86)..(289): a, c, t, g, unknown or other
tagctcccggaccgaggcgtccagctcatcaatcgccgcgcgcaggctggcgctctcctcctgggccgccgcaaggcgctcctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataccaagattgcaagaaaactacttcagatgctgacaaaaagctattcattacagccctcgag

SEQ ID NO: 36318 - DNA, 10626 bp, Chlorella protothecoides
  modified_base (789)..(798): a, c, t, g, unknown or other
  modified_base (1199)..(1208): a, c, t, g, unknown or other
  modified_base (1720)..(1729): a, c, t, g, unknown or other
  modified_base (4920)..(4929): a, c, t, g, unknown or other
  modified_base (7738)..(7747): a, c, t, g, unknown or other
  modified_base (7832)..(7856): a, c, t, g, unknown or other
  modified_base (7988)..(7997): a, c, t, g, unknown or other
  modified_base (8393)..(8402): a, c, t, g, unknown or other
  modified_base (9922)..(9931): a, c, t, g, unknown or other
gtgaagtggcggcgggggcgggcggtgaggtgggggcgggaacgagcggcgcgggggggctgctccagcacctgagggtgagcgtgtgaggggcggcaggatggcgaggtggaaagagggaagatgtgaggggaaggggtttggcggggcatgcgttcggtgtgggaatggaggaagaatcatgacggggctgccgggcgccgctgtgatgcgtgtggcggggggcgacacactgcatggggtctcggcagttggaggcggcatcggacttgccgtgacccttggctccatgccccatggccagattgacgcagctggtgtgacctgtgtgctcctgacgccagccgctcggtcccctcgtcctatccaccccactcttcccaccatccaggaccgcatagtagggcaggacgccgcatgccaggccgcggcgcgggcgctgaccaggtcgggcgcggggctgcgtgatcccggcaggccccaggccgggctcctcttcgtcggcccccctggctgcggcaaaggcctgctggccgaggcgttgggcgagcgccgtttcggcggcagcgtgctgcgcctggacatgagtgagtgcggccagcggcacagcgtgtcgcggctgctgggcgcgcccccgggctaccaggggtacgacgacggcgggacgctgaccgagcccgtcaggcgagtcaaggtggctggtgggactgtggtgtgtgttggacggcctgagagggctcagggttgtgagtctcgacggtgcgagagtgaggcatgcaatggaccctnnnnnnnnnnttgtgttagacggcctgagaaggctcagggttgtgagtctcgatggtgcgagagtgaggcatgcaatggaccctcttgtctggcagagcggcggcggagacgtcgtcgttcacgcccatgatgcatgagcagcgccgctgcagctgcggcaacctccctcattcaatcaacggtccccccttccaacccccacaggcgccggccccactccctggtcatcctggacagcatcgagaaggcgcacccgcacgtgctcaacctcctgctccagatcctggaggacggaaggtggggagcgtgtgttgggaggtggcgtggggggtgatatgcgtggtgtggagagagcggctgggctgtgacctctgaatgcctaggcttgtcccaagcatggcccccaattnnnnnnnnnngggtggcgtgggggtgacatgcgtggggtgtggagagcggctgggctgtgacatctggctgtctaggcttgtcccaagcatggcccccaattcctgtgatggcaaactattctcctccacatcaccccccccataactcaaaggctggcggatggcagtgggcgccaggtgtcgttcaggcaggcggtggtgatcctgatcagcacctctcacgaagcctctggccggggcggcctcggcttcgagccggcacccgcctcccaggccgaggccgaggctgccgccgcccagcgtgcgcggcgtgagatcctggacagcctcaaggcgagctagatgggggcccagggagcgcagattatgagcctgtggctgtccatggtgaacgatctctggaggacgccatggccccccggacgcccttgcgaacatgaattgtgcgagctcaaccaatgaccccccacacacacacatacaccctttccaggagcgtttcccgcccgagctcctcaacnnnnnnnnnnctgagttgtgcgagctcatccaatgaaaacacccccacacatacaccctttgcaggagcgtttcccgcccgagctcctcaacaggctggacgacatcgtcgtctttgagcgcctggcgccccagcacctgcatgccattgcagagctggaaatcgcggcgctggcccggaggctggagcccctgggcatcctcggcttgacggtgcgtgcggggcatgcctgctccaggcgtccaggaggagtgacacagatgcacccgacgccagaggcatcgttgcgatgccatgccccaccgaacccttccaccccccacccgcaggcctcggcggagctcagggccttcctcgcgcgcgaggcatgcgccgacgggcgcggggcgcgggggcttcggaccctggtctcgggcctcttggccgacgccgtggccgacgcgctgctgacagggcaggtgtccaggggacagggcgtgcacttgaccctggtcgctgatggacaggtcggcgtgcagagcctgccggccgccgtcgcgccgctggagaacaacgtggtccccgccgcacccaccgcggggtcggtgcccagcgtcgagcggcgcgctgaccggggccaggatgcctggaccccggcttagaggcgtcatgggcgggcaagtgcagcgccatcccacccccctcctctccacaagacaccccagttgtaagggagcatgcaaacgacgtcgctctggggaaagaccaccacccaccacctcacgtgtagactggcgaataatactgtagaatgcctgcccaggagacaggaccatctttctctccctccctttccggtattgtgtttcaggaactctccaaccctccaccaccgtgcctgtggccgatcgaactcagacagaaccaaatccatgtacctgcctcacctgtacccatgcctgtcctgcaaccccgccctcacacctcccctcccagcccctgtaccctcgtgccgatgtgatacagcaagattcatgttacatacgacaatcttctcggagatgtacttgcgtgctgggtggaagaagtacactcgtcagtgccggcgggcgctcagagcgtgagcccggagtcgtcgcccttgtcgccccccaggtccctctggctgttgtagtacgcggcccagaccaggccaaacacaatagccagcacccagaacagggaggcgtcgttgatgcccaggatctggccagtgccgtcgccgttcaggcgctcatccaccagcgccagcgccgggtgagtcgccaacaggctgggcagggacacagccgcaccgacaaggccacccagggccacgcgcttctgggcgggctgggcctgggcgcggcacaccatcatgctgcgacctattgggaagggaaggggaggaggggggagacgcacgggtgaggagcgcatggcgtggagcctgggctgtgcattgctgtgtggccaggctttgaaacagagacctgccctgggcacatcgccccacaattttccctgcgcccgcatgtgcacccggctcctaccgcgtgctaccggcgccaagacacctgaattcatgagggaagggaggtgtgagaccggaaacgcatgctgcatgccgggcgcctccatgcgatcccacagaatctgggggcctcacccgagctacggacgggccggaggcccacgctgggggagacgcacacagtctgcatggcgcactcgtggatttctgtcgagtcgatgcgtcgaacgggaacgtggcagcgggttggggcgttggtaatgctgcgatcgacgggggaatgggtgtagatgtggttgctcgtcccggagtatccggggacaatccacggtgatccgaccccgattccaattttgtgccaacggaattgggcgcagtgcatgctccctccccatgctggctggtgaggcacacccacacgaggcgttttgtcgatatctcgacccgcagtttgttttgttttgcaaaaccgacatgggaatgactgggtgacagcagcaggaagggggagagggaagcggaaaggatacagggacagggtgaagggcaggcagcaccaggggaggcggacccctcacatggccagcgccggtgcggcatccacatccacggacatgccctcctcgaagtcctcctcgctctcgtcgtccccagcaatctccctgtcgaatcgaggggagttggcgagagggatgtcgatgggtggttcaagccctctccattgtaccaaagtgtggtcacctcactcccagtcacaagcaactcatctgccccaagcatgcacagagccctgctcgctcaccatccacgttcatctcctacctttcccaccgggacccccccctctttcccccccaaaacaccggggcacctgttggctgcctcggccgcctccagctcctcctgcagcagcttctcctccttctcggacaccgccctggcggcctccttcacccgcaggctgccgcgctgggcctccacactggccttgcaggcctccactgccgccgtcagcacctcgatgccccgcgccttgtccagggtctgggtggtgaggacgtagagcggtggcgccaccagcttgatggacacctcgcactcctcgctggactgtgccagcgcggcgcgcatcgcgcccttgatgtgctccacgccgtcgtaggcgaagcaggtcatctccacgtccgcccggatcttgatgggctgcggcgtcatgcgccgcttgatgttcttcaggatgccatccagcaccgcgggcgtgagcaccgccggagtctcgccggagtgcacctcggtccgcagacgctccagcacgggctcggggtcggggatcatgccgcggaaggcgtcgtaggcatggccgtacaggcggtacaggggccagcccacctgggagtacaggtcatccagctccacgccgcaggtctcggccacatggcgcatgatggaatgcaccatgcgcgacttggcgaaccgctcctcgcatttctgaagcgagggacagggggccaggaagtggtggggagggagtgagacgcatatacccatgcgtggggaatctgggcctgcgcaagacggcggcatgctcggggtcctgcctgcaaggcagcccgcatgcaccaccaagccgaaaggatggtcaggcccagccctcacccccttcaaacagnnnnnnnnnntatcccgcatgcaacaccaggctgaaaggatgatcaggcccagccctcacccccttcaaacagaagcaaccacacgaagcccctccatgtccccagcacacgtaccgccacgtcctcggggttgacacggcgcttggagaggtcaatgtagcccttctccttgtccacacgcaggaccatgaccggctcctgccgcccgaccttgatgagcttctgcaccgagcggatgcggcgccgggacagctcggagagcaggatcatgccctcgatgccgccatactccagcagcgacacgtaggcccccatctcggcgatggacttgacctggaccatcaccacgtcgtccatctccgggtagcggctctcatagaacctggaacggggcatggacccattggaatggggtagatggtgatgtgtatttctagatacattcctcccgatccatggcccagtggaagctcaccggcagtcctggtgcgccattctgaaaccgagtgccgcagccccactcccaggttttcctcccagaatcgaccggatgaatggtattcggcagaacaattcagtcttggagtgccttggctgatcttgtggcgctttacgcctgcctacttccaatcgacctggctctgtgccgccggcgcgctttctgaggcacgacctccgaaggtcttgcatggcatagaggtctgtggcgtgggattcaaaagtcatcacactcagaaaacttcaccaacatcacattattgcctcaatatgtccatgactttcgacagatcccctaggccttcaaggatggtggcgctgggagctgccaccagcaactgctccttggtgtagatgccggtggtcacgcccagtggcacagccccggcatctgcagcggcctggacgtccatgggggcatccccgatgtggaatcgggctgttatggggccatctgtgtgcatagtgaatgtagaagggtaggaatatgggaggggaagtcgatgtaggtgtgctcagttgattaggaagcaggagaaaagatcaaagtccagcgactgcatccatccacctgagccagcatgcatacaagcaggagctctgtgctgcatgcgccaaccccacctgcttgcccggccgccttcatggctgccaggcggatgaactcggcacgatcccgccatgtctcctccgtgttgccgctgcagaagtcgctcccaaagccgccaaagtgaggcgtcgagaagaggtcggacaggcccagggcctgcatcttgccccacccgatcggctccagattcccggtgacgaggcagggcatgaagtctgtgtcttcctggtgaccagcggcggatttgaaggataccacagggtcagcatgggctgccactcagcaacggcgcgctgcacaagactcctggtgtacttacctctgtttccttttcctattcaagcacacagatcatgtcccacactcaatcccgcgccgcatcacaccttgagtgccttgagtagatcgacaacgcccggcaacacctccaagccatccccggcccggtcgatgtttgcagcaaagtagctgttcatggcttgctgaagcgctgggagagaggccatggcctgggagggggcggcgcggccatcgtgctgccagattttagggaacccatcaggtgggcttcacagacagctacatggcaaccatatggaagtggtcccgctcctcacctctgccttgggaattccatgcactacaagcactgccaccaggattaaggtgtcggtggagccgtggtgcgggatcacgtcgattgtggtgtcaatcccaaacacttgtttgaaggcagcagtgaaagcctcccggtgcagctggttggccctggctccaatgctcttgatcagggtgccatcgacatcgaatgatacgagacgtggcatggctgctgctggaccgccgcaagatctcgaaggtcgccgttgtagggacagggcagggctgaagggggacgtcaaaggcgtgttacgtgcgcagagccagggcccagatcgaagcactctcatgcaacaatcaatacaaattccagtgtatttatgccctatgtatgccatctgcctgcagacgcttcccacagcatgtgtcgacatggcgtaaggagcctggacagttgcacactttcccgcgccctgcgttgcggagtagccttcgcgcatgccgcaccctgcaaagcaacccaacgagctcaatgagctattcctgaaggagaaggttgtgattggcgagagatctgatctggctggtttggggatcgtcgaaccccgccaacgtgcccgatgtcaacggaggagcagcccaccacatcctctgacaagccgggcgggcttgcacacaagctgacatcaggtggggacttgcctgacctgcagtgcgcgggagcaggcttcagcgtcctgccgaaccaaccctgctcctcggcacgcctgcgcacagggctgaatgagcaggtgcaggatgtgacgagctccctgtccgcgatcctggatcagggcctggcaactgcctccgatgtggtgcggagtagtactgccgtggccacaagtgaggccaataaagcggcttctcaggccaaggtaggaccctgctgatctgagcctgtgccgccttctcgtccatcgactgggtgaggggcagcctcgtatgccgaccagcagcagcaagcacctgtcctgtgccaccctgcaggacctgtactcccaggctgagctgcagtacaagcagggagaggctgccgcattcggctacctgaaaggtgggcctgggtgnnnnnnnnnnggcctgtgccgccttgtcgtccatcgacggggtgaggggcagcctcgtatgccaaccagcagcagcaagcacctgtcctgtgccnnnnnnnnnnnnnnnnnnnnnnnnnccaccttgccgccatttggggtgcccacagagggcgtgcgaacggtggtggacaacaaggagacgagcatcgccgtggccatcggcgtggccgccatcggcctgcgcggtccgcggcgttttctgtggcggnnnnnnnnnntcaccttgccgccacttggggtatccacagagggcgtgcgaacggtggtggacaacaaggagacgagcatcgccatggccatcggcgtggccgccatcggtctgcgcggtccgcggcgttttctgtggcggcacacactgggccggctgcgcagcgaggaggcggtcttcaagtcggcggagctgcacagcgtcgtgctggcagagaaagtggagggccaggcgctggaactgaagaagctgcaggtgagaaaggggtgttggggttggcagaggcacactgtgaggggacacctggcatgtaggattttgttccctgagcctgtggtataatcaacgccgactcatggatactgcaatgttccatggtctcttttcccggtccctacaggagcgnnnnnnnnnnaaagctgcaggtgggaaaggggtgttggggttgggagaggcacactgtgagggaacacctggcatggtggattttgctccctgagcctatggcataatcaacgccgtctcatggatactgcaatgttccctggtctcttttcccggtccctacaggagcggcttggtctggctcaggcagagtataccagaggcctgagcaagctgaaggccaccgcatcagagctccagtcgctctcctctcgcattgggggcacgcagcaaacggcctcaggcatgtgacaggcttggcgtggtggtgactggggctgagggtgtgcaatggtagcgtctggagggctctgaagtctgcccagcagttgaagtcattctgagccagccgcccaatcctcccttcctgcccaaccaagcaggtctggtgcaggacctgcgctcactgcccagcaagcatgcactctccctgcgctcggaggttgcccagaagctggcagtggcagagacgcagcgcaaggctgtggacaagctggtcctggggctggcgaagcagggcatttaatgattgaacctgctctcacacctcggggtagagtatcagcaaggcatgagtgcccccttacagctctccatctgtacaagctcgatactgacccccaaaatactcggatgctatcattgctactgccttgggccctgctgctcaaacaagctgcttcagaagtcatgggagaacaggtcgggcagcctgagtggctgcagggagccggcagagatcgtcagccaggcatgtgcactgcatagcacgccgctccagtcacgttcagcgccgcctctgcagcgcagaatatgggttgttgcggtcgtatggcgcaggggcctggggcgggggcctgcccctcgcgtcagaggagtattgtggccccccagggtactgcgagccccctccccaggcttgatgcccgccaccaaagcgctgcatgggccgggagggcgccccatcgccccggcccccgtactgcggcggctggtgcggcgtggcatcgtatgctccatactgcggcggctggcgcggcgcggcgccgccgtagctatacccgccgtagccgccaccccgtggacctggcggggggttgtaccctcccccatactgctggccagcgtaggcagggtgcggggcagcctgtgcataccctcctccttggccgtattgctgctggccatactgctggccatactgctgcccgtactgctgctgctgcccgtactgctgcccgtaatgctgctgctgcccgtactgcggctgctgctgcccgtactgctgctgccgtggcagcccggcggcgatgtggcgccgcgcggcgtcgcccacgtgcatgccgtgcgggggtccccctctgccgccgccccggcccggtccgcgggtgtcctggtgccacagcggcttgtcggcctgcaggtcctcggccgtgacgatggcctcctgccgggttgggacgggggtgcaggcatgagtcctcgccttgnnnnnnnnnnagccgtgacgatgggctcctgccggattggaacgggggtgcaggcatgagtcctcgccttggggatgatgccctgggagggcagaaggcccggctccagcgggctgcgcctgacacatgccaccgcgcaggctccggcacacacgtgcctcccccccccgaccccctcacctcctccacggcccccggcagtagcgcgcagacatgcttagcgtgcgggggcaggcggtatgcagcgcagaccaccgcgttgggcgagacatcgggccccagaccaaagggcgcgggcaggaccgcagggcaggcctcgcccccgggggccaacacctcgccgcccatgccctggctcagctccgggtcgagggcgcgggcggcggcccgagcctggtccccgcccgccgcaccgcccccccccccttccgccagctcaaccagctcgggcgccagcgggtgggccccggcgacgtacacctgctccagacggcgcgagttgcggaaggcctcctccggcgtcagcgcgccctccagcgggcgcgtgctggccagcagccgcgcctcgtcgatgaagggcagcagcgccacgccctgccaggcgaagcgcttgccgttcatgtccaccttgaagtcgcgtgggtagaagtccaggatgggggagtcggcggccgtgaacagggggcggaagggggcggggagggc

SEQ ID NO: 36319 - DNA, 2290 bp, Chlorella protothecoides
  modified_base (373)..(382): a, c, t, g, unknown or other
  modified_base (1074)..(1109): a, c, t, g, unknown or other
tgaggaggggcgggggggcggggggggccagaccatagctcgggtgccgccccccaacccctccctcctccgccccttctatcccgaatcgcccgccgcccggcccagccccgcctctcgggcctcctccttgcgccgctgctcctggatggccagcaggaggtggggggcatgggacttggcatgcgcctccaggtactccccgctctgcatctccagcaggcgagagatggtgcggtctttggcaaaccccaggttgtcgtccaccacctgtgttgcgacggtgggggttggcttggaggactgccgtggggtggtgacgcctctcgcctgggcctggccgccggagggggtcaagcctccaccggactgnnnnnnnnnnaggggttggcttggaggactgccgcggagtggtgacgcctctcgcctgggccaggctgccggagggggtcaagcctccaccggactgcgggcgctgggcatggccctgctgcattcacacaccgatgctaaatcaccgccatcgtttcttgccccccacccctccccagacacgcagacacaacaacagccacactcgcgccggccgctcgcctgctccgggccgggcgggcggcccttgcgcctggcctccgcggccgccgccacggtgaccacgttggcaaagaggtccgagggggtggcctccgcggagcagaggaggcgcgtgcgatgctcgtacagcacgtcgatgagcgtgacgaagcgataggcctgcgagcggctggcgcccgtgaagacgggcacgccgcgcaggagcagcgtgtgcttggcctgcgccagggctatgaagtcggccgcgcccagcgggcggccgcacaggtcctcgaagcgcgcgtggaccaggggcccggcgacctccgtcagcgccagctcgcggcccatggccacctggacggactcggggcgggccggctgcccggccgccagctcgacgaagcggcggtacagatcctaatggaaaaagagaaagggggcgggggagctcgaggggtccggggggggggggggatatggggtttggggatgcccagnnnnnnnnnnnnnnnnnnnnnnnnnnnnnnnnnnnntttggggatgctcagagggcaaggcggtgacatgtgggtgcaggggtgtggcccccacccccaccagcccttggccctccggggacccttctgaataccatcctgccttccccattgccatgaatcctcacgtcgtcgcggctcggggtcagaaagtagaggccctcgctgtgcgtggccagcatgcggtagtcggtcgtggactccatgtcatgcgcccggcagcgctcctggggtgcgggggaaggacgaaggtgggctttgatagcccgaagggacgtggtggggccgggccgtgacggcgagtggggcgcatggaaagccgatggcaggccgctgcactggcgggagcaggcagggaccccctcccctccccagctcgccttcagcgccgcgatgaaggggaggaagaggtcgcgctggagcccgccctcgtacagggcgtctgggtggcggttggaggtcgctatcagtaccaggccgttctgtgaggagtcgagagaggagaggggccgggcgtgagatcctccggctttggaaaggcatctgcacagagtgaggcccctctctcgcttccggtcccgacggtcccctcctcagaggggtgcccaccagatggtatcccccaccagccctggctgccagcttggctggagcggtggagatgagcccatgcacactcaagccacccatgcttctgacccaccctccaaagcctctggaacaggcggttcaggatggaggcatctgcgacatccgtcacaaacagctcgtccaggcagagcacgtgcacgatggggccaagggaagagtggggcaggtgggaagggattgcgctgcggggcccggtcaagggccagccccttgcatgcgcagggacaggggtggaatggagccgccattactcccaccccgcagactcccagcccaggagatgtattcatggaaagcatcccttcacccaccgactctttcaagccccccacaacagtccataagcagcggtgaccggcgtatcttggtctgcgcaacgatctcgtcggcaatcttgcgcagcgggtctgccgttcgctggtgttgccgcagtcgtgtgtggacgtctatcatgaagtcgtggaagtgcatgcgcaggacctgcgcgcatcgtggcggtggagcaggggtgtcaggggagggggggg

SEQ ID NO: 36320 - DNA, 61 bp, Chlorella protothecoides
cttctttggctccatggcagggctggtgggagcgctggccttcttccccctgaccatcttc

SEQ ID NO: 36321 - DNA, 118 bp, Chlorella protothecoides
ggagggggtcagcgtgcgcaggcagcgcacgccgccgccctccacgggactcgcgggaacctgcgccaacgctgcctcctgcgccgctcgccagtcctccagcacgccccccggcccc

SEQ ID NO: 36322 - DNA, 80 bp, Chlorella protothecoides
agtgaggggcgggatgagtggccattcctctgcatgaggcggcgcggtctgtgcatgccacaccagcagcgccgctgcat

SEQ ID NO: 36323 - DNA, 112 bp, Chlorella protothecoides
agcctcttgtgcaccagagggcggcgatgtttgacggcgatggggtggtgctgtactgccccggcccacgccctctgcgcaaccccccagccttggtcggcggcgtcctcac

SEQ ID NO: 36324 - DNA, 61 bp, Chlorella protothecoides
gaggccccaggcgcctgtcggactggccccacccagccaatgcagacccgcacatcctgcg

SEQ ID NO: 36325 - DNA, 83 bp, Chlorella protothecoides
ttctgtgtgctgacggtgggcctggagcggagctgcctggccttccttgcgacgggagcgaggctggtggggcgcccaacggc

SEQ ID NO: 36326 - DNA, 149 bp, Chlorella protothecoides
ggagtgctacggcagcaggcttgccaggtacccttggggaatggcgcccctgccgccatgcagcatgcctgtgccctggcatccatcgccgacccaagacgtcacctcggcaccgcgcttccccctggcgcagaatgccctgaacaatg

SEQ ID NO: 36327 - DNA, 79 bp, Chlorella protothecoides
cggctggctgaggcgttcactcatggcaactcgagggtcgctgtggaccggtgacacaggagtcagacagcccggtcaa

SEQ ID NO: 36328 - DNA, 131 bp, Chlorella protothecoides
gctcgcttggccgctgcagaggcggtgagtgccagggtgccgtgtcaacaatgttcacctcaagagggaattcctcagcacccgccaagatccaatgccagcaagctctccccttcccacacatgcacagg

SEQ ID NO: 36329 - DNA, 74 bp, Chlorella protothecoides
agattgagagcatggcggccatgctcctttcgcgggaacccaaataggtggaatccatgggacattcatgtggc

SEQ ID NO: 36330 - DNA, 61 bp, Chlorella protothecoides
tgaatgtgcggtgacaggggttcagaaaaaggggcaatgaaggcacacgggagaggggggg

SEQ ID NO: 36331 - DNA, 61 bp, Chlorella protothecoides
ggaagccgaggaggggctggttgccagcctgaaacgtcggctggacacgctcacggcagac

SEQ ID NO: 36332 - DNA, 170 bp, Chlorella protothecoides
ctgccagccactccctcttcttgaggaacagcggccccaatctagaaggtttgcggtagggggatgcaggtggtgagcgtgtgggagctgagagaagattgaagccatgaaatgcgtccttgcagatcatatcctaccttatgattcctccctcgccagccgctgtgact

SEQ ID NO: 36333 - DNA, 68 bp, Chlorella protothecoides
ttccaacaacgtccaattgacctaccctcgcgagcacaccgaagctcaggacgagaagcgtcacgctc

SEQ ID NO: 36334 - DNA, 115 bp, Chlorella protothecoides
aatctggagagacagcggggagggactgtgaatgatttcgctcaaccagaggagaggtgtgtgtgttggattcctctggtgtgaggagagaccctcacaataccgcgcctcatct

SEQ ID NO: 36335 - DNA, 70 bp, Chlorella protothecoides
tggggtgggtgatggcaggctgcaagcattattctttttgtttcacagtggcatcgctggcctgtgccta

SEQ ID NO: 36336 - DNA, 61 bp, Chlorella protothecoides
ctgccccatcgtgtcactgtctccccttcgacacgccctcttcgccctgcgcgcagatccc

SEQ ID NO: 36337 - DNA, 74 bp, Chlorella protothecoides
ccagctcggtcacgcggaactcggagctgttggggtcgaggaccgtggccagcagggcattgatgctgtggctg

SEQ ID NO: 36338 - DNA, 61 bp, Chlorella protothecoides
cgtgagccagacgtcgctgcttggtggcaaagacaacaagagcctgaaggctgcagcaaag

SEQ ID NO: 36339 - DNA, 88 bp, Chlorella protothecoides
gcaagcccctcccttggatcctgtgggagcttcccaacccctcccatcgtcacatcctggcaccacaccgcccagagcctgcacccca

SEQ ID NO: 36340 - DNA, 64 bp, Chlorella protothecoides
cagtccgtcttcttctcctccctgtcgcccatcttcttctcctcctcacacggtcattccgatc

SEQ ID NO: 36341 - DNA, 110 bp, Chlorella protothecoides
agtgtggaggccctgtcaagcatgcagggggcatgccatgccaggcagtccactcgccccacacagctgcctggggaccgcccccgacgaccgcaccaaccaacccatcc

SEQ ID NO: 36342 - DNA, 111 bp, Chlorella protothecoides
cgagggtttgatccagggagcagccagcaattggcccgcgccctccctgacacatgctctgtcgtgctctggctcagaaactcttggaggactccgacgaggatctactcc

SEQ ID NO: 36343 - DNA, 61 bp, Chlorella protothecoides
tgaagggtatggatggcgacgacggcgaggtgccctccgacggtgtctccggcatccaccg

SEQ ID NO: 36344 - DNA, 127 bp, Chlorella protothecoides
gtcttgctcgcagacatgtcatggaaccagctttactatgaccatgttgaccaagtcaattctacatgtgttctcaagatgttttcccatcgcagcaaatttcttccctttcagttctgggataggg

SEQ ID NO: 36345 - DNA, 134 bp, Chlorella protothecoides
ctgtgaccccggcgtcatgcccctgctgcgttccctgtggtatcgctgcctgacccactcccgcctgctccaccccgaattttgccagtgggtacagggagagtgtgggggcatcgagtccattggggccatgc

SEQ ID NO: 36346 - DNA, 22051 bp, Chlorella protothecoides
  modified_base (458)..(467): a, c, t, g, unknown or other
  modified_base (842)..(851): a, c, t, g, unknown or other
  modified_base (1444)..(1453): a, c, t, g, unknown or other
  modified_base (1793)..(1802): a, c, t, g, unknown or other
  modified_base (2203)..(2212): a, c, t, g, unknown or other
  modified_base (6386)..(6395): a, c, t, g, unknown or other
  modified_base (8221)..(8230): a, c, t, g, unknown or other
  modified_base (8575)..(8584): a, c, t, g, unknown or other
  modified_base (9834)..(9843): a, c, t, g, unknown or other
  modified_base (10424)..(10433): a, c, t, g, unknown or other
  modified_base (11156)..(11165): a, c, t, g, unknown or other
  modified_base (11915)..(11957): a, c, t, g, unknown or other
  modified_base (12229)..(12238): a, c, t, g, unknown or other
  modified_base (14434)..(14443): a, c, t, g, unknown or other
  modified_base (14895)..(14904): a, c, t, g, unknown or other
  modified_base (15432)..(15441): a, c, t, g, unknown or other
  modified_base (16559)..(16568): a, c, t, g, unknown or other
  modified_base (17350)..(17359): a, c, t, g, unknown or other
  modified_base (17618)..(17627): a, c, t, g, unknown or other
  modified_base (18456)..(18465): a, c, t, g, unknown or other
  modified_base (20860)..(20869): a, c, t, g, unknown or other
  modified_base (21543)..(21552): a, c, t, g, unknown or other
tcatctgcatccccagcatcctgccaggaatgcagctacccatcgtgcgtcagacgcctcgcccactcactgaagacactcgtccatcttattcaggttttggttctccaccacagcctggatcatctttgcattctcctcgagcatctgtagagtgtggacgagctcggaattaagagcgctcatacgagcaattctgcatcgtaatgcttgattcacatgatctagaagctttacacctacctgctggatatcagcagtggtcagcgggacagccggtgtcgctcccgttgtggtcggtgcctgcatcgcctaggaagcaaccccaaatcccgcccagaaacgccgagcagctcttggcaagaacaagtgtaaaaagattaacgtgtcgtgaggttgcacctcgagaaagtgattctctccaatggcacaccttgtcttgaacagctcgcacgatnnnnnnnnnntggaagcaaccctaaatcccgcccagaagcgccgaggagctcttggcaagaacaagtgtagaaagattaatgtgtcgtgaggttgcacctcgcgaaagtgattctctccagctgcacaccttgtcttgaacagctcgcacgattttgacggggagggcagcacccgtgatgtgcgtgctgggctgcaccttcggcagcggccagtcggcctgtggcacctttgcggagcaagtgcgggaagtaccttcacgaacagatgtatacaataatcaccttcagatataatatagtttaccactcgaagatgcgcatcaaggggcagcggagctcactttgccagtcttgcgagtaggaaggaggtggctcgctatcggnnnnnnnnnngactaccttcacgaacagatgtataaaataatcacattcagatataatatagttcaccactcgaagatgcgcattagggggcagcggagctcactttgccagtctcgcgagtaggaaggaggtggctcgctatcggtgcatgcacacccaccccgtctcaagagcccctataatggagggctagtgcttctgagcccccaaaacaagcctttataatatggtgaaagcctatctccggtacgagctggccagcagctggggggtgctggccagcaactcggacatttgctacacccacgatggagcccacctcgtcaccgctgcactggaaaatgtgaacatctggaatgtgaagcgagcgctagtggtaggcagagggggtttggatgggtggagggtgggttgggccttgctcacgaaaggcatgcatggggatgaggctcctcgcctggcgcacagccctgtactggagatgatgcattgttatctcaccagaaacctggcattcaccccgccacactcactatgcccccaggtcgagacgctcaaggcgcctgccacccagtctggcaagccggtcggggagatcaccnnnnnnnnnnctcaccccgccacactcaccatgcccccaggtcaagaccctcaaggcgcctgccacacagtctggcaagccggtcggggagatcacccgactggcagcctcccccgtctccgaccagatcgcagcgggacactcggacggcacggtgcgcgtttgggttgggggcaaaccatggcgtggccgcccatgctgtggttctggcgacctgggtcattaggaattatgagtgaatggcctccacgaggccctcacccaaggctgctgctcagtctcatctcacccacctttgcaagcattgggccccagttcaccccccatcaatccctgcccctcaccacggnnnnnnnnnncgctgctcagtctcatctaacccccctttgcaaacattgggccccacttcacccccccccatcaatccctgcccctcaccacggccctcccaacattctgcaggtccgcgtctggtcgctgagcagcggcgagctggaggccaccttctccgggcaccgctccggcatcagcgcgctgcgcttcagcgccgacggcgcgctgctggcctccggcgcccgcgacaccgatgtcgtggtgtgggacgtgggcgccgagtccgggctcttccgcctgcgcgggcacagtggggagatcaccgctctcgccttcctccccgccgccggtgccctggtgtcgtcctctaaggacgggctggtgaaggcctgggatctgggcacccagcactgcttccagacgctgnnnnnnnnnnggggctcttccgcttgcgcgggcacagtggggaggtcaccgccctcgccttcctccccgccgccggcgccctggtgtcgtcctccaaggacgggctggtgaaggcctgggacctgggcacccagcactgcttccagacgctgacggggcacccgggcgaggtctgggcgctggctgtgagcgaggaccagaggcggctggtcaccgggtcgacggacgacctgctccgctggtacgtggtggcagagaccggcggagccggcggcgccgcggacgcgggcgggagcgccgccggcagggagctcctctctccactggggacggtgtcccgccgcgcgccggaccgcgtcgccgctctttcctttggcgctgacggcgtgctgctggcgcagtcggcggggcgcggcgtggacctgtaccgcatgtgcggcgaggcggaggccgcgcggcacgccaagcgccgccggcgccggcgccgggaaaagaagggcaaggcgggggccaagggcggggaggcgggtggtgcggacgcacccccacccgaggacgcagatgacagcgatgaagtcgcggcccaggatgagctggagacactgccggtgctgcgcagcaagcacaaggtgcgcgcggcggcgctcgtccccggcgcgcggcggggcggcacgctgggcctggtcctggccctggccaacaactcgctggaggtgtgggagtgcgcggggcgggcgggtgaggatgcggcgccgcccgcccgactggcgctgctggacgccggcggtcaccgcgccgacgtccgggcgctggcgctggcaggggacgactcggtggccgtgtcggcctccaccgccggggtcaaagtctggaacccacgcacagggtcctgcctgcgcaccgtggaggcggggtacggcaccgcgctgctcttcgtccccggcaaccgccacgtcgtgctgggtaccaaggaggggcagctggcggtcgtggacatcgccgcgggggaggtgcagctggagctggaggcgcacacctccaccgtgtggtgagcaggggttggggatcttctgaggcaacgagtgctttgaatgtgcttctttcataaatttttcggggtagtttccgaaataggagccttgtctcctcaccttgtgctgatgccaaggaggttgggagggaggagtgaggatctgctatgggggacacgaggatcgcagcagcaacatttcagagcctcagcctgccatgcttgtttgaagccttgcctactgacatcaagtttggatggtgacgcctacgcataccgcagcacacaagcaagagcctatgcaccacccactcctcactgaaaactccattccccccatagaaagccccgccacatcccacaaacccctctgaccccgcaggtcgctcactgcgctgccggatggcaacggtttcatcagcggcagcggggacaaggaggtcaaggaatgggtgtggacgctagagccacaggaggatggccctcccaggctgggttttaaacacacacggtgagcgttggggtgggggggggaagtgtctcgcataggcgctgtctcagacggtgcactgagccacagtaaatgcagcaatctgcccggcgcggatgcctatgggtgagcgatgctttgagcgatcgagctgaatgcacacacacttcacgccattccacagcacgctgcaaatgacggacgatgtgatgtgcgtgcgagtaagccccaacgggaagctgctggcggtcgcactgctggatgccaccgtccgcatcttcttcctagactccttcaagttcttcctctccctgtacgggcacaagctgcccgtgctctgcatggacatctcctcaggtgggtgggctggggcgttatttgggttcagagggaggaagagggcggaagggggcctgctcatgtgcctgcgcatgggctggtgcctgcaaaggctgagggctgagggcgggagtggggactgctcaaagtatggcgcagggtctcctttggatgcctgcaggctcgtggagatcaagccgatgtctgctggaatgctccctggcctgccgctgcgtcatgcctgcctcagcccaagctgcgatggcttgcgccctcgtcagctcggcgccattatccggctcgcttgggcaggctcgccctgcctttgcgtcaacccgcctcgcccactctcatgccctcccccgattccacagactccacgctgctcatcaccggcagcgcggacaagaaccttaaaatctggggcctggactttggcgactgccaccgctccctcttcgcccatgccgactcggtcatgcaggccgccttcgtcccgggcacgcactacgtcttcacggcaggaaaggacggcgtggtcaagtactgggacgccgacaagtttgagcacctgctgaccctggcggggcaccacggggcggtatgggccatggcggtgtccagtctcggcgactggctgctcacaggtggggtggggtgtggggtgggagcgtgtgggatagttgtagggacggtggctggttcaatgcagccacatcttcggcctctatcagctcgtaaggccccaaccaccatcactccccccctccaccacacaacccacagggtctgcggaccgctcgctgcggcgctggtgccgcaccgacgagcccttcttcgtggaggaggagcaggagcggcggctggagtctctgttcgaggccgacctggagggcggcgacgaccggcgccccgtcggcgcgcccgcccccggggacgaggggtccgccgcccccgcggcgcggcgcaccctggagagcgtgtcggccgccgacgcgatcgtggaggctcttgacgccgcggctgcggaggaggccgcgctggaggagtggcgcgccgccgcacgctccaacccctccctcccccgccccgcgccctccccactgctcctgggcctggcacccgacgagtacgtgctggcggccgtgcgccgagtgcgcggcccggacctggaaagcgcggcgctgctcctgccctttggcgatgcgctgcgcctgctgggctacgtggccggttggctgcgcggcccggcgcgcggcggcgccgccgcggagctcatggcccgcctcgtggccctgctcctccgcgtgcacctgggccagctcagtgtgaccccggcggccaggggcacgctgaccgcgctgcgcgacctgctgcacgcgcgcctgggcggcgcgaaacgcgcgctgggcttcaacctcgccgcgctgggcacgctgggccgcctggtcgccgagcaggggctgggggccgcgggggtcaagcgcagcgcggccgtggcgggactctgagcgtgacgggcgaggtttggagtgggagctgcggtgtgtctgcttgagtgagcaggctcgtccttcatgccgattgtgtgtggagcgactttggcatgatactccagctttacttccttttgctgtcagttgctaagcacgcttcaatgccgtgtcattcgccgcgggttgacactgccatggaaccggtgccatgcagggccgagggtcgcagaggcgtagaaagtgacgccggaatgaatgacacggcacaggcaccttgacagtgtgcaaatctacgagatgatgatgtgcaagatcacccaagtgtaggaccgtcactatacgtgcagcacagccagccagcacggtcgcggagcaactagcgctgctggtgccagccaccctggcgagggtgctgctgctccaacgcccagcccgctttgatgctactgtcgtcgccctgtcggggccccggcgcggcagggacctgcttgtgaggccgcaggccctgtccctcagctgcggctccgccctcctccgcgacgctcagccagcggctgttgttgcagcgccggtcgatccaggccctgcagtcgagccgccagcggcggccggaggacaggtgccaaacgtgcacgcacctgtgcatgtgtggcggcgggggaggcggatgagttgtgtttgtaacgtatgacctgagaaagcttccgtcattgtctcacacatgagaactccagaaactggtgaagactgcgatgcaatgcagtcgattttagcacacgatccttgtgactggtgcatacacactcatcattccgtcgacaccctgttnnnnnnnnnncagcacatgatccttgtgactgctgcacacacactcatcattccgtcgacaccctgttgacagtgcagtacccattccttgcagtgcaaagcaggataatgtcagcccaccccccacactcgtccaaaacaacacacctcaagtgccaggctgggaagagacccgagccatccgtggccactcgaatgcatcggatatcgcccagccaggggatgtgggggaaggtgaaagtgtcctcgctgccgggacggaaggagcgcctgccccgcgccaggcgcaggacgccgctggaggactgttctcccaccagctccagccgcacctgagttgcattgacaaggcgttgctgggaatcttcgtgctcgaagtcttgtgccatgcccatgctcagtgaggaacaggtgaggggctgcctccgctaagcccagtctcggagcccttgaagcacctgcccctccaaaactctctccaagcaatcgttgccactatcatcctcccaatcacctttgcccctgtgccagcagcacagccccggctggtgtgcactgtgatctggtagccgggcagcagttggtctgggcggggagggggcttggggctgcgctctcggtgggagggggccggcaggtacctgctgggcacctctactccagcccagcattctggttctgcatagaacacaacatgtcctgtgggccgccatgccgttccccctcgaatccacctgggagtcaggtcagcatgggtgagtgaacgcgcggcgtggctcatagacagcgaaagggtcacagggtgcgacaggatcccagcacttgatggggaaagtggctggaacagctgatgcacccttatgcattcttacaagttgaaagcatcatccagctaggcacaaccccacacaaatctcctcaccgttgacagggaaagtgtgtaggaagggcgtccccgtacattggcccgaccttgatccaggccgggtgccagttgagcttcctactgccctccacccacacctccaggctgtgcagggcacccacgtctggacactctaccagctcgaaagcgtccagctggcccctctggaacggcggattgctgctgtgtgcagacggtccgaactgaaagggacctgtggtggtgatggggatggatgggagttcatctcatgttcgaatgtggcaaagggatcacatcacgatcagaaacacatgaggaagcatggtcttggcggactgggcagatgacggtgtccatgtgaggtccaagctgaatcctttccctgcggcggccatctcacagctccctccgcacctgctctccccagctccccctccaggaccacgaagagcctgccggcaggatgcagccccgcaccccgcaagtcagaggtctggacctgaagccgatactcgccagagtctatgccgtcctttccttcgtattgaagctgactgtgctctgtgcgggaaacccactgcaggtgtggatggggtggggtcctgcatgtagccagggctgtggcaggaggaacagccctgatcttagctcctcgcatgcagatgtcagacccactacgtacctgctgacaagggtatgtgacgcctgctccaccatcacccaggtttggctggagtgtgatgtctccgacaaacaagcggcactcctcccctgtccaacagggatgtgagaagaacattggggttcagtacaggagtgcatggtaagcatgcacagcatggcagcagagtcacgccctctgccacgatccaccctgtcccaccaagtcacccccccagaaatcctcttcctcccatgccttggctctnnnnnnnnnngacgatcaaccctgtcccagcaagtcacccccccggaaatcctcttcctcccatgccttggctctccaggtgcagttccacagtctgccagtctgcaggccgctccaggcacagctcggtctcgaggacggtggggccgctctcgtctagcaccgacacatccacggcctgcggttctgcgaggcagcagtgtaaccggggtcaaacaattgctcaggaaggtgaggatgctgggagtttcagtccctgccctgtgccggcatggagctcggacacgagactatgattggctgcctgcgctcgcctgcccaccgtgtcatcgcacctgccccaagccccttcccnnnnnnnnnngtgctgggattttcagtccctgccctttgccagcattgagctggaacacgagactaccaatggctgcctgcgcccgcctgcccaccatgtcatcgcacctgccccaagccccttcccgcgcacctgctgtcacccctgcagcgtcggtgaatatgaggtgtagcaggccgctggcaagacggccttccacctccagcacatcgatcgccacggtgcaggagggccgatccggctcttgcgctgtggttgtgacgagcgcgtgggtcacccagcgagagaaggagtagaccacaggctccgcacctccctcacgcctgagctccaggcgatccacgtgtagacgtgcaccccgcccgccgccctccagccggagggaaagcgcggccggtggggaggcggcggggagctgcaggtcgaactccgcgcagccaccggcgcggaggtcgcggccgggcagctggatggagtctgcgccgccggggtcgctggggtccggccctggctgcagcacgaggctcgccggcgggacgccccgcgccgccatgccctgcgtcatgtgcacggccagctggaaagcgtggagggccgccacggactcagcctcctcctcttctccttctgtggcttcgctggcgggcgatgccgtcggggatcgcgctgctcgcatgccttgccctgcggcttgttttcctaccctgccggtgtttttcactgcagctgctgggacatgctccgccacatctacgctgctctcctcctcgtcgctctcgtgcagtggggagggaaagaggctgacctttcctgcccctgggagcgtggtggatgggccgaaccagagcgcctgaggcgagtcatcctcgctcagctgagcccctcgcacactccagtctggccttgcgcctggggtgggtgcgtggaatgcgcgagtcgggcgcgcaggcgggtgtgcaagtctcaccgaggcagtagaccgagcgggggaggctgcggtctctgcaggcttctcgtctggtgcatgtttggagggccctccacctgcctgacaccggccctgccagagtctttcccccaactccaccagtggtgtcctactgtaggaacctcccaaggcatacgctcagacccgagaccaccaaccgactcacccgtcccgtcgctggcgaggacgacgcggcgcacgcgtccgatgccataggcgtcgaccgccacgctgtgcacgctgcccgccctggcgccgtggctgagggccnnnnnnnnnngggcatcgaccgccacgcagtgcacactgcccgccctggcgccgtggctgagggcctggaggggggtggagcccgtcacgcccaccagccctacctgggtccgagcggtggtgcccccagggggcagcgccgaggtgtggaccgcgacatgcacgaggcgcgacccaccggcggccggcgcctgggcgggggaggtgggcgacaccgccgcgcgcttgggtggcgttccggggacgaagcgcagggccccgccgtcggtgggcgtggccggcacgaggagctgaggctccctgcgggaccccagctgcgcgacctggacgccagacacctcccactcgtggggctggtggccgtgcaaccggagggagacagaagccaaggttgggccaagatctgctgagtggagttcgggaagggggggggaggggtgctgtaggagtaattctgacaatggaagcgtgcatccggatttgactggcaaggggggaggatgaggatgcatgccagccaatgcgggcacaatcacagcagccatgcccccccacccccggccttacctgggccgcggatctggagctttnnnnnnnnnngtcacagcagccatgccccccccaccagccttacctgggccgcggatctggagcttttgggtggtcccctttaggaatgtgccgggtttccatggtacaaaggaggagatgctggccccagtgatggcccggaggacgacggagaggtttgtgccgggcgccaggcccgccggagtgcaggggctggtacagatgcacacctggggttggttggagggagaggtttcatgtgtggcatgtgcgagtctctttttattggctgcaggcaccacccgtcaaattcccaacatccacagtcgctgccaggtcacccagcacaggctgttgcccccgcatcccccgctcgcctcgaagacacagtcccgctcgggcggcgcctggaccggggtcatggagacctcggcggcggcgccgccctgccccccgccttccagcacctcgctgctctcaaagtaccaggcctgcacaaagtggatatcaatggacagtttctctccaattccgcttgggacacttcagccaaacctgcaccgcgggctggaagtacgccatgcgcagcccgcacaccttctcgcatgtccaaccaccgctgtcctgggagcttcagaacgctccactgaacattgtgcaacacccctccgtccctcccccaacagaaatggaatgccaaaccactcctgcacacctgtggtgccgcagcctcgcccacactctccaccacgnnnnnnnnnntttttctctccagttccgccacctcagccaaacctgcaccgcgggctagaagtacgccatgtgcagcccccacaccttctcgcatgtccgaccaccgctgtcctgggagcttcagaacgctccactgaacattgtgcaacacccctccgtccctcccccaacagaaacggaatgccaaaccactcctgcacacctgcggcgccgcagcctcgcccacactctccaccacggcccagtccagggccagatatcccgcggcgcccaacccttgcacgcccaccgccaacgcctggatcttgacggcgcgcggcagcgtcagcgtgtgcgtcagcaccgcgcgccgcagctcggtcctggggccggccggcaggaaggccctgacggggggccctgaacccccgtgcccaagcaccaccaggtacggccgggcggagggccccaggcacagggcctggcagtgcaggctgacctccacctcagccgcctggccggcgggcatgaagggcaggtccaggcggtcgccgccagccacccaggcctggtgcagcgcgaggaatgccagtcttgcgcccggcccggccccctccaccagcacggagtccaggagccagggccctgcgccgcggtcgcagcgcagctccacccgctccagcgcgcccagagggcgcagctgccaggcggcttccgcggcgccgggcgccagctcgcgccagccgctgctcccgagcgcgccacgcaggcagaggctcnnnnnnnnnnnnnnnnnnnnnnnnnnnnnnnnnnnnnnnnnnngtacagctcgcagtcggcgcgcgggttgcgccaggtggcggccagcggggcggtggccgactggcaaccgcgccccagctccgcgtctgcggcgaggtacagcacccgcgccccggcgctcagggccaggaactcgcagtgccaggtggcgccggcgggggacacgcgcgtcacgcccagctcgccgcccgtgatgtcgctcaggtccagtgtcaaaacgacgtccagctcggccacccgacctggctgcgtagcgtgcgcgggcggagacnnnnnnnnnnaacccccagctcgccgcccatgatgtcgctcaggtccagtgtcaaaacggcgtccagctcggccacccgccctggctgcgtagcgtgcgcgggcggagacaggtgcagcgtctggcgctggccggggtccgcggtccagatcgccagggtcaggccctgggggtggcccttgcccacgcagtccgaggtgtagatggcaatgcgggtgggttgcgcgggctgcaggcgtggatattgaggaggtacaggagaggtgttgagaggaggtgcaaggatgctggaaggagcgggaaggaggcgggaaggggtcgcgcatgtctggattgggcagtgaatgcatcgcagactcccctgcctgcagcccaccacaatgaatactaagttgtggaggcccacaacaatcccctggacacccctgcagcctcacctgcaatacagtctgagcaacaataggactggggcttcccgtctgcacgcccgtcgtcgccacctgcaccggctgccgcacaactacgctctccccacacggtggctggcctgtgccaggctgcagcgtgagcgagagcccatggcgatcccccagccagcgccgggcggggaaacgatacgtctcaccgtggtcaccaccgcgcttgctgcgccgcacctcgacctccacccagtccagcttccaggcaggtgccgggctcgaggcgtccatttctagggtgatgctgctgatgccctccagggccgcggcctccacctgcgttgcatgggctcgagggtcaggcagtacacacttgtggactccaccttgcatgggtgcagccttgccccagacaggcgccaactatgagtgaccaggggtgaccaccgctccctgctctcccggtcacccatccccatactaacctggaactcggtgctggaccccggctggaaggcgccgccggcgccagacagccgcagcggccccacgctgcagcccttggcgtcgtgcatgctgagcgccacctgcgctgacattccagtacttgttccggggcatgtggccacgcggatgcggtactgcgccgtgcggtactgcatggcgtcggtcccagtgggtaaggcgtctggcacagagtgcgctgcattggtgggtggccttgcgacttcatccgccccgcccgcagcccgccctgcgagcacggcatcggcggggaacagatctagtgctgacgtgccctgcccctctcgcccccgccgccccgcctggaacacgaccagcaggtccagggaggggcaggcgacacgcacttcctccaggcggtaggcttgctgctcggcggcaggaggagggtgagcttccagggtcaagcgtcgcagggccccgaggggcgcggcccgcaccaccgcatgccccgccgcatccagcggcgcccagggactggacccgcggtccccatgcagacgcacgcggccggcggccagggcgccggaggccgcgaccccggggccccagacctgcaccgagtactcgtggggcgcggcgcgggggtcgcctcgatggctgaccagggtcaacctggtctggcccgggcccctgtcccgggagagccactgccggcagaggaaggcggtgctggcgcctggcaggtttggttgtggagggggatggagcaaggggtcgcccctgtgcctgctggatcagagtccctcattgcacagctcaccagtcatcgtcagggtgagtcctacccgaaacgatgacatgattgccggcccagtccccccttccatgccatgccgctcaccgttcgcctcttccagcacctctgcccagtccaggtgccagtggggggcgggtccggcggcgtcgtggaacaccaccaggcggcgcagcgcccccacgggggccaggcacagccggaacacggcctgcgtccccggcgaaaagtccgcgggctgggcggggaggcgcgtggccggcgtggcgccggcgtcgccgagcagctccagcgagacagccgcagaggtgccggcgcctttgaaccggctggtcgccagcgtgacccgcagccaggccgggggcgcggcggcggcgtggggcgtgaggcggcgcggggaggggagggggccgcgcgaactcctcgcctcctcgctgggagcgtggggggcggaagaggacggcggggtgagcacgcagggcactcagggtcacagcactcgtgnnnnnnnnnnccgcggcggcggcgtggggcgtgaggcggtgcggggaggggaggggaccgcgcaaactcctcgcctcctcgctgcgagcgtggggggcggagggggacggcggggtgagcgcgcagggcactcagggtcacagcactcgtggatggaccacagccacaccgcccgccccgcttccggcccgtgtcagcagtcgacgctgcaggcttgcctgggcaccaggcgcagggtgcgccccgctttcccgggctcctctctcgccttggggaggcacgtccagcgccggccgtcggccaggcaagtcacgctgacctggcgcagcaggcacagcaggtccgggaggtcgctggtgacagacacggcgtccaggctgtccagctggatgccttcagctacttcctggtgacgggtcctgcatgcgacacgggtagcagtgtgtatgcgggggggggggnnnnnnnnnncacttcctggtgatgggtcctgcatgcgacacgggtagcagtgcgtatgcgggggggggggctcatggtactcacatccccagagtggtcgtcagccgaggcttgcgctcgcagatgcgccacacaatcacaacctcaacctgcgagctgaatcagcggcctccctccgcaaacctgtgctccgggatgcgcagctccagccggctgggagaagtgccctggacgctagcgcccacgccagtccttccctccagcacgacggtcagcgccaccgcttgctgcagcgggtcggatagcgccaggtccacccggtacattgcgttgttgagacctgacgtcggctcctcggcacacgccaggcgccgcatgatgcgcctggatgagggcggtggtggttggatgatgtgagcaagaccggagatcaacagtcgcgcgtggcacgggcggcagtcctcagagctaccccaaccgtgatgtggctgccaggtacttgacttccacttcacagcagggagtggccgtcatccnnnnnnnnnnatggcacaggcggcagtcctcagagctgccccatccgtgatgtggctgccaggtactcgactcccacttcacagcagggagtggccgtcatccagtcggaaagatgcgattgcacaaaacgagtctccccctccagggggaactcacccgtcccctcgctccgtgcacagccactggcggcaggggaaaacggcccagttggcgtctgagccgcgctgcctgaccctcacctcgtccagccaccaggacggctggggacccgaggcatcgtgcatcacggtgacctgcacaaatgggcggggcgtgggtcttaggcatggggctatggaggagatggccagacctcgttaccttgccaacttaggctccagcatcggcaatgcctcgcccgctgcatcctcgaggccccaataaggccccaccgagtacccagtgggacgcctcaccgcacgtagtcggccgaggcaggggcatcggatcttcatggtgctctgcgtgcccctctggaaggggacggtgccgggggcagggaccagggtgtgctcccccgaggaggcctccacgccgtgcaactccatgaccacctgcgccgaggtgccggcgtccctgcgatcccccgtcgtcactctgatctcatacacggccggcacggccaggggccgcgctgtgggaacatgggatccggtgcctgtcgctgcccgccgcctgggcggggagagttcttggcggagagggggggctgagggcgccacctgcgggggcggggccggcggcgtggcctcggccggccagggcccaggacctgggggctccagcaggaggcggggcattttgggatctgcatcgcgcctggtctttgtgggagacatggatcggcgaggttcctggaagcaacgcgtccacgccctcgagatcttggacacccagacctgcatgagggagggggtgatgaagcgcggggatcccacgatatcatccatcttgccaagggggttgaaatgggtggggatggcagccagggcagggccttcgagggtgcctgtaaacgcctatctacgcgggatgtcaccagagcacctgacatatttttgctcccccaaacctgtgcgtcctcgggnnnnnnnnnntgagggtgcctgtaaacgcctccctacgcgggatgtcaccagagcacctgacaaatgtttgctcccccaaacctgtgcgtcctcgggggagctggcggcaaagaggtgcacgtgggagccacaggccaaactgaaaacgcagccggcgccggcggccctcgtcctgccgggatccaggtgcctgtcgtccaccaggcctgccccgatgcccggagcgtaaccgcggggcatggcgcgcacggggacccggtcgagaggtatgtagcgagcctcctcctccgggtccggcgaaggagcgtagcacagccgatccgccgccaggacgacctgccgtggagcgggcatgaggacatggggcaatgagagggacgaacaggactcacatcaatctcagggtgccaaaattgtattcgttcaccaccttacccatcttcgccgccacttgcggaatgagcctgcatcagatgccttaaggagccagccggcatggagcgggggcgcaaagccctgcgacggattccaggtggtgtggcgccgatcccattcttccatcagcccatggagaccgtttccacctggatcggggctggaggggcgtacatggcgccaccactcccaggattccatgccgtgagggcaggggtccctgcaagggtgggtgagtcctggtgagcgattctccctgtcgcgattccctggaagcctagcggatggggcaatactgaatatgcaagttaatatctagctctggatatctgtgcaaacgtcggaggcgcaaggtnnnnnnnnnnagtcgcgatcccctggaagcctagctgatggggcaatactgaatatgcaagttaagttctagctctatatatctgtgcaaacgtcggaggcgcaaggtcaaccagtgtgcagggacaccggtccgccggatcccgtcacgagcagattgcgacgagactccccggtcgggtgacaggaccggagacccttgccagcgctcggtgctttttgggtgcttttaagagctgtgaaatcagcctttcgaccgactgagagtannnnnnnnnntggccagcgctcggtgcttttggggtgcttttaagagctctgaaatcagcctttcgaccgactgagagtaagagcttacaccaaaagagatgtctccaaaaattcgtacaacaagcatgggtcaggagggctttggtctacaccactgccccagggtggtcagactcggcccacctcggcgccaagccgcttcacccgtgaccgcagcttcttgttctgccgaaccgtctccagcgtcatctggtcgaggagaacgacgtggtttggttagattcgtgatcctagatttggaggacggctgggtgtatcaatcatcgcccaatggtctgcatctccaacgtctgattttagcaccttcctagtcctcttctccttcccattccaccaacagaccccctcaccgcatcgggcgccactcccccggtccacatgcggtccagcagggtgtcagcgcgcgcgtcgtcctctgtgcgcacgcagatgtcgagcagggcgttgaagacgggcgcactgggctgcaggccccaccgcccctccatcgtgtccaggagggccatgatgctgtcccaccggggcggcttgctcctgcccatgccacgtatgagcacgctgaaggcaatctcatccgggaccagtgcatcgtcggctgagggaaagtgaggaaggggtgggctgtacggcatggctggcgaatgaggaccgctgcattgggaggagatctctccagtacgtgatttcccttgcagcaacagggtgtagtccaccctgaccagctgcgggaccctttccagccaagctctcgacagcctggtgccatgtctgtcacccnnnnnnnnnngagcaacagcgtgtagtccaccctgaccagctgcggaaccctttccagccaagcactcgacagcctggtgccatgtctgtcaccctctgaccacgcaccaaacagctcgttgaagacgttctccgccaggtcagcccgcccattctccacgcaggcatgcagcagtgaggtggccgccatggcgtcgggctgcacgcccagcctggccagggaggccaactcgctgatggcgtccctcaccctccccgagcgtcccagagaacgtatgcgcttggtggtctcaatgcgggccgcctggtcggcgctggaggagccctgcaggttcttgtggcgggtttcagaaggggtgggctccctggcagccccatgcctcatgccaccacctcatggcctcccgacccctttcgtcaccggaccaaatgcacctgagtggcctggactaatgtcagccgtgattttactacactttggcccgccgcatgtcctggagtccaccgagatccgacgtgagggcggaacggatgggcaaggggtgccggctggaggaggggagcagaggccatggcacgccacctcacgcatgcattctgaagcttcaacatccaagattgagtccaagctggccggctcgcagtactcgaagaccagcgcgtcaagctgctgtgggagaaattccatccacgggatgcggcgcctgctgcgactgttagaagactcgctcccccgtgatgctcacggcagtagacccgcgaagagatgtcgaaccctgatatcacaatattcggatttctttctagataaaatcaggtagctccgatccctctgcagcgcaggatcggtgatcgacccccccggacacgtcgttcctcagtgcagggtgatggcaggccccggccctgcccccgagggcgaggcgagcgcctcggccacggcagctaggaatatgcatgggaagctatcgcacctcatgaagaaatacggaagggtcgccctgggcgtccacctctccgtctacgcctgtttcttcgcaggtatgtcgttcctgggacgtcaggactgacgatatgcttcagcccactccagctctagatgaatgcattcttcccatcgaccaccctccttcagggtgctatgtggcggtggagagccacctggacgtgcctggctacctggagaggtttgggctcatgaccccccctgtggagggcgagcccgcgcaagaaaaggggtgggtgcacaaggcgctggccggctccagttcaagcttggcgctggcattcatcgccaacaaggccttgatacccgtgcgggtgcccatcactctcggcctcacaccgccagttgccaagtatgtggacttcgctttttatgatggttgttggtcgtggctgtgcaggggtcgacttcattcaaggagtgcagctgtgcgcatgcatgcatgagtacctggcagtgcgctctgttgctactgaccggcgttggctggttccaggggttgctctcggtgtcttcgccagtgcatgatcaagttgacctctgaacctgccagacctcctgggagtcgatggaactcctttccacttccttctcattcatcccaagatgaagcttggcatctgcacaaccaacttattgcttgcctcatcctgggatgttgcaggtttatccggaatttcagagggcgagcaggatagcctgggagccgttttgagcgtttcgatactatgtcacccaggcgtgggcatgcgagttaaaatggactccctcacaggccattctccctggatgaggaattctggagcctcagtggttcacgatcccagccgattgccgtagccgacccagtctggctgaagcttctgcgcaaagctaatcccttgcccagactctggggtgctttggcagggtactattgcactcttgtgatcatgcatgtaccccggcttggccacatgctgtgcaaactaggttacatgccgccagctgaggtccgagtagtggaggcgacttcaagtgtggtctcctctgcaccagatgtgcatctgctggtgcctctgaatctgacttcgaggagtgagcttgtcaatactgtctcgatgacacatgtcaacaaatgcatcagtgtagggcgtgtatggggaggacgagcggaaggttggtgacagattggagcatgctggtggtctggagatcgctcataaaggggacgcagagggcaacctgcgaaatcacaggttgctcaagatgggtgggggtcggctaaggacgtgcgaccatttgggaagacgctcccagcgacacacacatccatatgcctatgactgtactgccattatgcatcgcctatcaaacccggtgaggttccagcacttggaaatgggtgacccgctctgannnnnnnnnnagaagacgctcccagcgacacacacatccatttctctatgactgtactgccactatgcattgcctatcaaacctggtgaggtttcagcacttggaaatgggtgacccgctctgagtaactgtggggcctcctcaggatgcctcctgccaggcttctcagtacttcttaacacatcaaaggatctccaagaaagggactagctgcgttaaggcccagcgcgccatgtggagcttgcaagggatttaaatcatcctcgtcagtgcaagcatcatagatgcaggctcggcagtgtgctctcaatccaaattcttccagaattgtggtgagctttgccagcactgatgctaagattctcgtccagctgctgactcaaacatccagacaagcaatgcgcattgaaagcatgcatccagaccaagcactgtattcacagtgtatctgcagtgaacgggcacccctttctacaagcgctccctatcgcgcccaaagcttgtagcccagaaaacgaggaccggtatcggcgtcgatccttcaagccctgtcaattggaagtcacataccagtatcggtagagcttttgccagtttgaaggttgaggagcgccggcacgttagccactgtggccatcggtagaccggtgtagcagggcagcagctgcaatgaacaagcggcgnnnnnnnnnnagttcagggctttaaggtgtgccacgaacgttgtccttcgatcctcgctgtcttcggtcggcttccagctctgggttgaatgtggaacatggattgacaagcgagcccaaatcgaattcgacctcacaggctgggcacagcgcacgaccttcagacaatgaccacgtgtaccttgctggcagagaacaagtcgctactccctgtggcgcgccgcttgttcattgcagctgctgccctgatacaccggtgtggcttacgtgctggcgctcctcaaccttgaaaccggcaaaagctttacctatagtggtatgtgacttccaaagggcttgaagggtcgacgccgataccggtcctcgtttgagagtctgggcttcaagctttgggcgcgattgggagcgcttgtagaaaggggtgcccgttcactgcagatttactgtaaatacagtgcttggtctggatgcatgcttttaatgcgcattgcttgtctggatgtttgagt

SEQ ID NO: 36347 - DNA, 74 bp, Chlorella protothecoides
actccagcacctgggtgggatgagagggggggaaagtggggggtgtgggttgagagtgtggtggctgaggccag

SEQ ID NO: 36348 - DNA, 72 bp, Chlorella protothecoides
tgcacctgctgtcccattgcaagatgccatcgtcccaaggccagcagcttatcctttcgcgccccccccccc

SEQ ID NO: 36349 - DNA, 77 bp, Chlorella protothecoides
ttgaagcgctcccaggtacagcctccggccgcacggagcccctgtcaatggcagccaggcttacgtctcccacaggt

SEQ ID NO: 36350 - DNA, 3407 bp, Chlorella protothecoides
  modified_base (605)..(671): a, c, t, g, unknown or other
  modified_base (1087)..(1096): a, c, t, g, unknown or other
  modified_base (1246)..(1255): a, c, t, g, unknown or other
  modified_base (1613)..(1622): a, c, t, g, unknown or other
  modified_base (2941)..(2950): a, c, t, g, unknown or other
gtgaaggtctgcaggacctggttgtcgtacctgtgggtgggtgagtgtaagaccagtgagaagaggacactgcaccctgatgtaattcccgacctcctgcaaaaggaatatgagggttcgcataagcttacttgcagtaggggctagaatcagtcacaccctcgactgtgcgtgcgtagacatccgggaaaaacttcatttggaaggaggccatggcggtgactcctccggtgataccctgcacaacacgtgagtccggagagcacatcaggaaaaattcaaaagaacgcgttagggcttctgccaaattcttggacaccaaacaagcctttgtataagctcacaatatcgtagcctgcacgggaaaggtcgatatggagcgagtgagtactaggtgcgatgacaaggccgacgcacgtagaggcggacgcaccccttgtgcttagcaacatccgcaagcatcgcatccctgttcgtgggaattaaatctgcctgcttaccgaacagcagaccaccgcaggcagccatgatggccaccgagatgacatagccggtcaggcggccgttgtagtgatcgacatttgcgccagcaacgctggccatgnnnnnnnnnnnnnnnnnnnnnnnnnnnnnnnnnnnnnnnnnnnnnnnnnnnnnnnnnnnnnnnnnnntttgttgcaactgagatctggtattgcaaagggaggagagtggttttgttgttgttcaggggttcttcatatagatcccgtccctcgccgaccaccaaggttgaagtgctgacggtgacaattgggtgatccgcatggctgtcaaagaaagtaagggacagccacgctgcaacatcgcctccattacaggacgacgtgggactcgcaacctcggactctatgaagcacataggcaatctgtgggatgatcccagctatattggtgctgccttccctctttgtacgcattctggtgtgctgtgcaagatgcgtctctgaccgggtccggttcaaatccgtcgatctcgttcaacttcatcgcgacagggggtcccaaggtgcgtgaggtaacgtggaggtcgagtatagcatcatgnnnnnnnnnnggcaacggggggtcccaaggtgcgtgagggtaacgtggaggtcgagtatagcatcatgcattgcactctcgagaagacgcatcgggctatcgtatcggtgaatagaccccccctgccctgagggacgcccagcaacccagaggaatcttnnnnnnnnnntgggctatcgtatcggtgaatagaaaccccctgcccgagggacgcccagcaacccagaggaatcttaaatggcagcccacactctattgggtttgggtgctcaaacacaatataacagtacagcggcatcactgcatcaggatcgaggagagcttggtgtcgttgggattaagcctcaaaactgccgcggatgaccatgtgctgctaggagacatagtgtgtcccctggacccactattgtgatgaacatgcaaagttcgcatcactagcaaacgtcctacataccgagaacaagaggtagacgcagcgggtttgacttttggtttgcacatcgaaccaggctcaaacctccaagtgnnnnnnnnnngggagacacagtgtgcccctggacccactcttgtgatgaacatgcaaagtccgcatcactagcacacgtcctacataccgagaacaagacgtagacgcagcgggtttgacttttggtttacacatcgaaccaggctcaaacctccaagtggtactattgcctctggcttcccagtacccctgttgcctgccctctccagcaccacatgcagaagcaacccatgaccagtttcgtggtgcactgtattgcaactccgcccgtcaaaggacgtgttgctcacagcgagcttggagtgagttcaggcgttaacgccatgcttgaatggcaggaatcctgtcttcgctgcccgggatgattgtgtagttgtgttgttgtgaggcgatcaagcagcacagtcagaactgccaagggctttatcatctttgcatggtgtgtgaatgttgacaattgctatggtatcaccgaatgatcgaaagggatcgcaagcggcctatgtggagagaggattcatcaatggtagagtacaatgggagcaagacacttaggaaacaggtttggcaaggcgtaccccaacagagtttacctatctggcatctcaaagtgatggtccgaggaggggtgtgggtaagtagcaccctgtgggcgcaagtggactggattgagatggagctgagcgctcgggtttcgttcatgctctggcaattctgctcagaggcaggtccccatggcttcagccaaggtgagcaaggcaggctatatcagagataaaggagttattgctaggatttctgtggatagggccggaaagaatagctgatcgatcaaagggcatgatgcctgagtgcagaaaattcagctcgaatcacggagtcgctgtcactgggcagccttcttgaggtcaccaatggtggcagcgcgctggtcagccgcggcctgatgtgatgctgcgcgtgtggcatcccatttgatgatctccagggacgcagggcccatgatgcgggaccaaagggggtgacgggcgaacagaatgggcacacgctccaccgagacgcccttggtttcagggataaggaagtagacgaagaggatcatcaccaccacccaggcagcgaagaagaggaagacgccccacttcatggcgcagagcatggacaggaaggactggccgatgacgaaggagaagaggcagttggcggccgcggcaatggacatgcccgctggacgtgtcatcaggctatggatctcggagggcaccagccagcccatggggccccaggaccaggcgaaagaggcgatgtagacgcagatgacaacaagcnnnnnnnnnnaggtgccagcagggagtttgctgtcgccaaacttgctgaactgggtggcaagcacaacgcctacgatggtctgggtgatgaacatctgcacgccagcctccagcaggaagaagcggcgaccgaacttgtcgaccagcaggacagcgaccatggtggaggcggagttgacgcagttgatgatgatggttttgagcagcgaggccttgcggctggaccccagggagttaaacagtacagggacgtagaacgtgattgcattgatgcctgaagtgggatggggagaggggtaaagggctgcttggcacggtgtcaggaaacaagagcttgaaagcgctggcccccaaaggcagcactcccaggaggagggcatgtgcttgtggtattgaaagcaaaacctttgcaccattgcaatcaatgcactgtgaatccaagcccaccagtgaactgctggaagaac

SEQ ID NO: 36351 - DNA, 61 bp, Chlorella protothecoides
agccccctgccggtgagggctgccgccgcagcgccgcacctcgagctgggacagggtggat

SEQ ID NO: 36352 - DNA, 130 bp, Chlorella protothecoides
tggaggcagcatgtgtcgcataggcgggggcagcagagcggcggagggggggtggcgcgaggccagcggagaacagccgggcatggtgccagcccgcgacgcaccgcatgcatgccattgtgttgttggg

SEQ ID NO: 36353 - DNA, 73 bp, Chlorella protothecoides
cgccactgaccagtcacaacccgccgtgtcaatgttgcgtgagacctcctcgtcctgctcgccatcgtcgtcg

SEQ ID NO: 36354 - DNA, 107 bp, Chlorella protothecoides
cccgatgccacggacgacgaggaggcgccggggcgcgttaacatcatacgcctcgctgcgaatgcaaacggcgagcgcagggggtcgccgtttgcatgaccaggtgc

SEQ ID NO: 36355 - DNA, 73 bp, Chlorella protothecoides
agccgttcctctgctggaccaagggccagaggagatccagcctgtggtggttcctggcagcccatgagtgcag

SEQ ID NO: 36356 - DNA, 80 bp, Chlorella protothecoides
agagggtggcgggtcgggggctggagagggcagctggcttgcccctgtgaggcacgagccgggcagagatggccccgccc

SEQ ID NO: 36357 - DNA, 84 bp, Chlorella protothecoides
accttgtttgcatagaattcggcagcctgcgaggcatccgacacatggtctggtgggctgcgcatgcctgtgctcgtggtaggg

SEQ ID NO: 36358 - DNA, 61 bp, Chlorella protothecoides
gcggcctccctccagctcctggcggccagcgagatgtgtgccaccgccgcagacctctgcg

SEQ ID NO: 36359 - DNA, 73 bp, Chlorella protothecoides
cccagcagctggtcagggtttaccgagatgcgacagcgggctgtccgcatcagggtttaacaagaagctgccc

SEQ ID NO: 36360 - DNA, 75 bp, Chlorella protothecoides
ttcagtgatccgtggtgcccaggcgatggtagcgattcatagaattcggctgcagccagggattggccggcgtgg

SEQ ID NO: 36361 - DNA, 61 bp, Chlorella protothecoides
cgggcgcaagcaaccctcacaagctgccagggaggcacgggcatgaggtgttcaggagtca

SEQ ID NO: 36362 - DNA, 65 bp, Chlorella protothecoides
tcacaaagctctgaccagcaggcaaaagctcaggagttcccagcatggaccagccccacctcaaa

SEQ ID NO: 36363 - DNA, 102 bp, Chlorella protothecoides
acgcaccaatcccatctcaacaaaggaggcccccccaatcccctctgcgtacctctctgaaatctccgctggcggggcacgaccagggacgccaggggcaag

SEQ ID NO: 36364 - DNA, 107 bp, Chlorella protothecoides
ttgatcgcaatatgatttagatctattaacgtgacgcaccgttgaaggaagattactcttgatgtgcaagatcactttgcggttcgggcgccgagcgcatgctgacc

SEQ ID NO: 36365 - DNA, 78 bp, Chlorella protothecoides
cgacatcttcctggaccgcgtctaccgcctgcacggtcttcccaccgccttcgtcagcgaccgggacacacgcttcac

SEQ ID NO: 36366 - DNA, 102 bp, Chlorella protothecoides
acagccgccccccggcgcctgagtggcggtggggggaaagggtgaaagggggtggcccaggaccccaccctccggctccggggccaatccaaccccccaaac

SEQ ID NO: 36367 - DNA, 79 bp, Chlorella protothecoides
atgcgtggacagcaagccctctctggcccatccaccacatctgcaggccatgcatgcgtgcaccagccgccaatcaggg

SEQ ID NO: 36368 - DNA, 79 bp, Chlorella protothecoides
ggaagacgcgtccttcttctgggcggagcccccgccatttgttgacgttgagcagggcaagaagaagaagaaggggagg

SEQ ID NO: 36369 - DNA, 9456 bp, Chlorella protothecoides
  modified_base (556)..(565): a, c, t, g, unknown or other
  modified_base (1418)..(1427): a, c, t, g, unknown or other
  modified_base (1721)..(1730): a, c, t, g, unknown or other
  modified_base (2094)..(2103): a, c, t, g, unknown or other
  modified_base (3010)..(3019): a, c, t, g, unknown or other
  modified_base (3497)..(3506): a, c, t, g, unknown or other
  modified_base (4238)..(4247): a, c, t, g, unknown or other
  modified_base (5507)..(5516): a, c, t, g, unknown or other
  modified_base (9012)..(9021): a, c, t, g, unknown or other
  modified_base (9076)..(9085): a, c, t, g, unknown or other
gcgtggagcagcatgcgcgcgtggcgcgggttcaccggcagcgcggccatggcgcggcccagcggggtcagctcctcgtcgccggcgcgcagcgcgcccagcgtggtcagcaccgccactgcggcgcgcagtgcgctgggctcgggcggcgtggggaaggggaagttgtgcacgcgcgccacgcccatggacttgagggacagcaccaccgactcctggggcgagcccaggatctcgggcgccgcgtgcgcggggaaggcgtcgttgaagaccgcggaggagaacaggcggtaggcgtggccagggcccgtgcgcccagcgcgcccagcgcgctgcgcggctgaggcctggctcacccagcccacctcgtaccgggccatgccgctggccgtgctttccagcacgcgctgcttggcgcgccccgcatccaccacgtaccggatgcctggagaccgggggggagatggggattgggggtgcgacagggggggtgaggcagggtgtgttgggggggtgaatatgtttgcagaagcccaggcgggcggctgctggaggnnnnnnnnnntagggtgtgttgggggggggaaagatgtgcgcagaagcccaggcgggcggctgctggaggacccaggcggcgaggaagcctggactccacgccatgcattctgcccattccctgatcgaaagccttggaaaggagaccccacatgatcctgcacgaccccatcgacgcctcaccggggatggtgagggaggtctctgccacgttggtggcgacgatgaccaggcggtggccgggcggcgcgggcctgaagacctcggcctgccccgcagcaggcagcatggcgaacagcgggaggacgtgaacggggccgggccccagggcagcccgtgatggagcggcgggggcgggagcagtcaggccctgcgacgggagcaggcgaagaggggtgggatggttgtgctgacgaggggttccgcctgcctgtggtcagacggtggaccctgcacgatatgcagagcccaggttgaggcatgcacgctggcgtctcctcccacatcaggatggcagggagcgcagaccgcccccatcctcgctcaccagtctcttttcgaactcggcttcagccagggctatctgctccggcgtgaagcccgctccacccatgacatcgacttcctcctcctcctcttcatctatgagaggcaggggagatgggaatgaggtttttgccgaagctgcaagcatcagtcagtgccggagatgcgtctttggcaaaaccagggaggctgattcgtgggatcggagcacagtaggcaatgctcaaacgccttgaaagagtgccatagcagtgtggagtgccaagcctaccccgtacccggtgcctcccaatgcccctccatggaagtagtccagnnnnnnnnnnctgaaagagtgccatagcaatgtggagtgccaagcctaccccgtacctggtgcatcccaatgcccctccatggaagtagtccagctcaccttctccatcgtcaaagtcgtccaggtcctctgcctcggcatctaggaagtcgatggcatctgcgccaaacccttcctctgccgcgtcgcctccggacacaacgtcgccggcctcctccggcggcgcagaggctggcgacgccggctggtttcgccttcggcccttgaaggtgctctcgagctgcttgcacagctgcttgacctnnnnnnnnnnacctcggcatccaggaagtcgatggcatccgcgccaaacccttcctctgccgcatcgcctccagacacgatgtcgccggcctcctccggcggcgcagaggctggcaacgccggctggtttcgtctttgggccttgaaggtggtctcgagctgcttgcacagctgcttgacctcggcctgcccggtaaggaaaaccaggatgccaccggggggcagctgcctgtgtatttgtgccacctgcgttgcattgcattggggtacagagatgggaaggaggggagatgtcgagtgctgagcccagggtggcgagacaagcagaatcccacacccagtgggagccttgaacctcctgggcatcaataccnnnnnnnnnnggcattgcattggggtacagagatgggaatgggaggggaggtgtcgagtgctgagcccagggtgacgagacaagcagaattccacacccagtaggagccttgaacctcctgggcatcaatacctggtgtaatgtagcaagctcatctgctaaccatcctcaggaccgagcctcccgaacacaccgtgcatgctgcaacccatgctgccacagccccactcaccttgcgatgcgctgcacccacgtagtcgttcatctccgttcgacggctgaagtgcaccgtcacagggtactgcctcgccggcacggtgatcaggggcggcgggcgcgggaacaggcgctggtttccgacaaagtcctccaccctgcagggcatccacgggaaggttgaggctcatgtgaccttctgccctgtgtcagagcatcatacacttctggacgccggcactctgacacccaatcaccaaacagcaggctcctggactgccctgcatccatgacacctacatgcacccccccccctcacctcagggtggcgctcatgatcaccagcttcagaggccacaccggaaccccaccagggccttgctgctgctgcgagtgcatctgccgtcgcagggaaacaactcgtgacaggagtcctgaggggtgtttaggaacagggacggggaaatgttttgtagagtgtgaagctccagggtgtgctccaggatatttggtaccacagcatatgacccttcgaatggacacgaggctggtgcccatgagcgacatgcctggctgtcgtgaaagctcggtgtgggtagctggcgctcaaacataagcccccccaggccccgcctcgcagccctcgattccgacaccaacagcacgacagcgccccttcccgaccgatcttacccagcagnnnnnnnnnnatgaaagctcggcgtgggtagctggcgctcaaacataacttcccccaggccccgcctcgcagcccttgattccgacaccaacagcacgacaacgccccttcccgaccgatcttacccagcaggatgtctgtgttgagggacctctcgtgcgcctcatccaccaagatggcgctgtagtggggcagcaggaagtcgtgctgcagctccctgcaagcacgggacagaggtggggcatgaaattgaccggggctgtgcaaccacggcagtctgcgcgtgcagctgcaagcaagacggcgcctgcctgtccaggcctccgtttccagctacaatgtgccctgagcctgtcctgcacctgagcaggatgccgtctgtcataaacttgagcgccgtcgcgtcgcccacgctcctgtcgtagcgcacctgcgcacacacgtgccggggatggaagttgtgtcccttgaccgccaggcaccctggnnnnnnnnnntgcccacgctcctgtcgtagcgcacctgcacacacgtgccggggatggaggttgtgtcccttgaccgccaggcaccctggcccccctccctgccctcccagcgtcgtcatgaggccccttgcaccagcagcaaaccccaccgccctccactcacctggtacccaaccacgtcccccagtcggctgcccagctcgtccgcgacgcgctctgctgtggagatggcgccaatacgccggggctgggtgatcccgaccgtgccagcccgttccgggaagcgggagcagccgaagccggcctcgagcagaaactggggcacctgttgccaagggggatgggtgagaggcatgcggtaatgggccttgatgcaatagaggatgaacgcgacaggacatatgcactgcttcgggacccatacattgcattggaaaacgttccctgcagcaggacagcgtggaaggtgatggccacctcggcgcacaacaacccccatcatgatcctgccaccgtcctcgcccacctgggtggtcttgccacaccccgtctccccggagagcacgaccacgtcgtgctcggccagcagctccatgatctcctgctccatgcccaggatgggcaggccctctctgggtcgaaagagggagggaggtgtggttcagcgagcgccatgcccagccagacgtcagagggctccccgcactctgccgcaaactgaatcacacagcaccccccccnnnnnnnnnntgaaagagggagggaggtgtggttctgcgagcgccatgcccaaccagacgtctaaggactccccgcattctgccgcaaactgaatcacacagcaaaacccttcctccccacagcacccacacctggcagcctggatctcgggcctgcgctcaaccgagactgagcgggggtggggaaggttctcgcggggcacgctgggcgccaggcgcgcgggcccctcctcctcgtcagcaccgcccagcccgtcgcccaggcccagctgctgcctggcctgcgccagcgcctgggccaggagcgggtggggagcggtgtcactcccggactcctcaccacctgtgcgggccttcttgagggccggctgcgcctcttcctgaggagactggggctcgtcccaccggcgcggcgcaaactgcgtgcgcgcgggggcgctggagggccggggtgtcgcctcctcctcgctgctgctgtcgtcgctgctgccgtcctccgattccgagttggggttgtgccgcggggtggggacgtcgtcgtcctccacgtggtgacctgcggcgcgcagggcctgcctgcgcgccgacacctccttcctggtctccttctggccgcgtgcagcgaggggccgcagggcctgcagcgtctccgggtccagggcggtctgggagagggattgcagcacgttgtcacgcgcgctgcggcgctccttctcctcctgcacgcgccgggccttgcgcttctgcgacttgctcagcggcttggcgactggctcagcaggctcctcctccttctgaccgcaggtgccacccatcgcaggtaggatgagggcattgctgtcaaaggggagctcttgcctgcgacaggagggtggggcagacggggggcttggggtgtggctagccggatgtcagcccggggcctgcatgctccctcgccccacaggctcactcagcatcgtctccatctgtcagtccgataggggccttgaactgcttgctagacagggatatcttattcttctgcttcctctgccgcttgctcgtcagtctccgcatggcgaccacgcctagtcagtcttaagactccgcagctaccatgcgggccatgcctattaattaacctcatgcattgcgcaatgttcttagtgtaataccttcttgtccctcgaagcgagtctcgctgagtctcgtcgattcgcttcgtctcgtaaggtgtgcgcgcgcgcgctcgcgcatacttccgggcgttcctgttcaagggtgaacnnnnnnnnnnatgtagtacccttttatccctcgaggcgagtctcgctgagtctcgtcgattcacttcgtctcgtaggctgtgcgcgcgcgcgctctcgcacacttccgggcgttcctgttcaagggtgaacatgtacatgagtgatctgcattcctctccctgtgctgtgctctggtggtgtcctcttgtgagatcaaagatggcctgaatcagattgcttcagagcaggtcgcaggaaggcaaccggatgggacactccagaagccggagcaggtctcctcgcaggacccataggtctcggagtcggtctgcggatcgctacaggcaccgctcaagcagggaaaaagactgtgatgaagaggcggataggcgtaagtatgctggatctacaccagcccagcaccagcaccagagcacaggtggcactgcggcgagcagtgatgcagagaagaaagcggctcgcctggccaagctccaggcgtggaagctgcagcaggcgggaggtgtatccagtgctcagcatccggcccctccagtgaccatggtggtgcaccaggcccaccccatttctcctcccactgccctgccattgcctgcccaaggcggcggtcagggagacgaggacgcggtggaccctctggatgccttcatggcagcagaggtacgggtagcaatacatcggttttctttccataagtctggtggctacttgccaacagatcctctggtcatatcatctgttgggttgcaacacgaccagcgcaaactgtacctgcaggtactcccggaggtcgctgcacgtgaagctgaggagaaaaagcgtgccgaagatgagcgtgccaagctgaaagaactcttggcgaagggcaagctgccaaaggcactggaagagttgatccaggacgatcaggaggagactcctgatgagatcatcgaggcaagtggtcggctatggtcaggacttcagtgcgagggtgtgttgcatgcaatgtgcttcgtatcaagtgtgcagcatgcgagagtgtccctggcgacacccatcactcgcttcacaacttgagctgattgttgggacagcctaacttgtttctatcatccccccaaaggataacttgtgcttttggcttgatccattcgactcctacagataccctccaacaaagtgaagctggtggtcggcccggcaggagagaagatcaaattcatccagcgaaagagcaagtgccgcatccaacacgcaaaggaagaacaggaactggaagttggcttcggcttgggacctctgtacaatctccccatcaagaccaatgaccccaatgcacctgtgagtggggataggtggagcagacggtctatgtcggcattgctggttggatatagagtctcaggctgatgttggatacaggcaacaacatctcactgggatggtgctgatcagtggcatcgctgcctgctgaaggactgcctttgacctgattcgcagcccaagatgaccaagctcctcttatttggtgattccaccgcggtggaggctgcgagagtgctgatcatggaggccatcgacaaccgggaacagaaagtcaagcagcgccaaaaggaatacgataagaagaaggacgtgagttgtgttcttgagttcccttccgtacgcagggatccttgctgagcccgtgaattcggactcttcggcccactgaattgattcatttgggcgcagggccccatgccatctgtggcctcttgtacatcccatatccctctgagtatctccacttccccttcaacatgctgtccgctcgatatctgctccaacaggcaaagaggctgcagcggcaactgtaccacatgaggcatgcccttgactatgagacgctgggcctcccactgggagcatccaaagctgactgcaaagccgcctatcgcaagctggccctgcagtggcatcccgacaagaacatgggtgagtcctgggcagcgcaaatgtgtgggcatgggaggaaccacgaattggggctgccaatgatatcctcacacctgtcattcacatcactcatccttcatcatcaacaatcttccaccctttgcagaccggcgagaagaggcagagaagatgttccagaacatctccaaggcctacgaatcactcatgtccactgacgaggatgccaccatccaacaacttgcacattgagaggtcaagttgtctcagtgttggaagctatgtccctccctggcatgagttgaagtttcaagcagtggtgggcaagtgggtggagagcaaaacatcacaccgtcaaatatcaccccgacagcctcccagcccaccatgttgcccctgcagttcatgccactaggcaatcaggaatctgccgcacacacgttccccgccgaatgaggatcgtggcttggcgcaaagcagcccacaaagggccacgagaggggtgcggagaggggggcaggcatcgacgcaggaggagggcccccaaatgcaggagggcagagctccccagccacaaacaggcggaacgacagcagcccggtgaaagctgctttcacatctcgcatcacgagagcgacatgacacgcaggatttgcaaccgtttggtgccccagtgactctgcagctccagttctcctccacttctcctgtgcctgtgcttctggggttgcagggcgacgtggcagcaagagcaggagtcgactttgatgagttgtcctcgtccgccgcctccaccctgagaacccgtcgcaggcaacagagaggccctacttaggggccagaagggtgacctctgatgacttccccgtagattgagccgaccaattgccggcaccgacaggggtcttgtctgggggggactcaagagtcacgctctttctggaaggccgccatacactcacaatgcaggcaagttttgaaagcatcgatggggaataatcatggaggcatgcagccacatgtgggttatttcgcctacgcttgggcgtcaaagactctggaacagagatccagagcataggcaaaaggagaccgcaagacttgctgtcattgaatggcagacgttcaggctgttcaagacggcggggcatgcgccagccaaagtgtgatattattagtcagtcagctctcccatcttagggtgagagtacttgaagtgccaacatcggacctgtacgccactgcttgagcgtaggatgcgagagctgtcgtcgctgaggtcagcgtttttgtccaggtcatgggatggctctggtaagcttgggtggaggctaataccaggccaccagctgctgagaagaaagcgtaattcacaccttctggtgggttgtctacgaatttcagcgaaaatgagaagtcattgccgttcttcgtgacgctcccgtcgatgttcccaaagattggggggggtggagagggtcccagagggggtggtgaaggattgagcagagtcagcggtgtcgcctcatgaatatagaggccacctacgaagatcattgcggagcnnnnnnnnnnggcataggatgcaagagctgtcgccgctgaggtcagcgtttttgtccaggtcatnnnnnnnnnngggggggggaggagggggccccagagggggtggtgaagcattgagcagcgtcagcggtgttgcctcgtgaataaagaggccacctacgaagatcattgcggagccaaaggagtaggctgctgatagcttcgaatcttggcctttaaaggaaatggtggttgtgttgtcagatgggtgattctcgtacactctgcccagaccggtcaggttcgatgagaacagggagcattgaatgtaaaatggtacatatcctcctgttgtgacaacacaagtgatattaaccaatccatccttgggagcactgaagtcgattgtggcagatgcaggtggcattggaggtggtggagacggtggtggtggtggtggtggtg

SEQ ID NO: 36370 - DNA, 79 bp, Chlorella protothecoides
gcttgcagagtgtatcgcgaggttccttccacagggaccttgattacaacggaggcccgttccgtctcagtgcccctgc

SEQ ID NO: 36371 - DNA, 137 bp, Chlorella protothecoides
ggggcgtgggctgggcagtgcaagggtacaagtggaagggtggaacggtgacccgtcggggtaccaccaccaggacaggggccgactctgcttgaggctgacccgtcggtctcatcattcctccctggatgccacca

SEQ ID NO: 36372 - DNA, 8022 bp, Chlorella protothecoides
  modified_base (263)..(302): a, c, t, g, unknown or other
  modified_base (1242)..(1251): a, c, t, g, unknown or other
  modified_base (1376)..(1385): a, c, t, g, unknown or other
  modified_base (1732)..(1741): a, c, t, g, unknown or other
  modified_base (2324)..(2333): a, c, t, g, unknown or other
  modified_base (2833)..(2842): a, c, t, g, unknown or other
  modified_base (3323)..(3332): a, c, t, g, unknown or other
  modified_base (3675)..(3684): a, c, t, g, unknown or other
  modified_base (4664)..(4673): a, c, t, g, unknown or other
  modified_base (7468)..(7477): a, c, t, g, unknown or other
ctggcggccgccgcggttgacgcggagcgtgcggtgcagcgccgcgcgtcctgcaccgcggcgcaggcgctggagccgctggtggagggcgtggaggccgtcttccgcgtgcaccagttcgccggcggcctgaaccgcgcggccacggaggccgccacggagctcatgcgccgcaccgtgcactgcgctcgcatggcggaccccctctggctccgcgacgccaagtttgcgtaggggggggggaggcgatggtggaagggaannnnnnnnnnnnnnnnnnnnnnnnnnnnnnnnnnnnnnnnggaagggaagggggggaggggtgagtgcgcgccccttggcctgcgggctgctagtaagtatatgccgagcccggcctgtgatccgcgtgtgccctcggtcctctgtccctctgctggacattcatccgccaacagaccacatacggcctccatgctacatgcctcagccatgtgcgtgcctgcggcggcacgacgccgtgctcccactcactgatgtgacacccctgaccttcatcgcgtgacgctgcatccgacccttgccacttggctgctgactgcatggtgctctgtataacgatgagtttgacaaagcgcccttcctctcagaatcacacatctcataccaggtcccaggccgcctccagggcatttgtgagccgcgcaatggcgtaggcagccgacagggggaactgggagatggacaggtactcgtcgacgtacccgtcgtcgatcttgccgtgcgagaaggcccccagcacgaacaccaagggcttgccagggggaaagcgtgccaccgtggtcgcgacaggcgccagcgactcggaggagtgggagaagccgatgcgcagcgcgtccacggggaggtggggcggcaccgggcccttgaccacgcggagcagcttgtcggggccgttggttgcccgaatgctcagcttctgcagcagctgcacgaaaaggccggcaaagcgcttgtaggtgcgtggcagccgcacctggtgcgagcggtgggaattgggttaagggcattggctgatcagtcgggtcatgcctcggggcgggaaattgagtgagggacaccaccttgtgaccactgcatgtgcacttggggtctaggctggtgggcaaaggtaccatatgcagagaattccaaccggacgctgtccatctttgtgagaattcgcaacatgcatccctccccccccccccccccccccccccnnnnnnnnnngtgtgactactgcatgtgcacttggggtttaggctggttggcaaaggtaccatatgcagagaaatccagccggacgctgtccttctttgtgagaattctcaacatgcatcccttccacccccccnnnnnnnnnnaccttggggttgacttggatgagcacgttcttggcagtgtgcacataaatctccttgaccttgcctgccttgttcagcggggagtccaatatcatgagcaacgcctgcagggtggcattggaggctcgagggttggcggctgtgagggcagatgtctaccatgcactccggcgccagagcggggatgggactcacggggtggaggtcatggctacagaaccatgtgcctcaaagggtatgcacagtccaccataccgcacgcttcacccactctgtaaatccacgagccgggccaacagagtgccgtgccagcaatcctcactgagcccacctgatgggcgatgtcnnnnnnnnnncagcggggatgggactcacagggtggaggtcatggctacacaaccatgtgcctcaaagggtattcgcagtccacaataccgcacgcttcgcccactctgtaaagccacgagccgggccaacagagtgccatgccagcaaccctcactgagcccacctgatgggcgatgtcgggtcgatactgcgcggggtccctcccgtgtcgtttaaggaaggatgtgtggtcgtcacagttcagcagctcgtagcccttgcccactttggcagtctcgagggtggctccttccagcacaaaggtgaccgactgctggcttgaggtctctgcggcagcctcgtcctcctcccgtggaggcacaatgccgggggccatatgtactggttcaaaccttgttcaagcacctagttctcgccgcgtgtggaagagtgaagcagagagaggtggcgacactataggcgcatgcgctggtgattggccggcagagccagcttccctgagctgctgcttgtgttttcaagagtatcttcacgttgccagtgtatttctcgcccaaatgttcctgcttcgcgctgaaagggcaatgcagnnnnnnnnnnattttcaagagtatctttacgttgccagtgtgtttctcgcccaaatattcctgcttcgcgctgaaagggcaatgcagtgctccatgagtatcacatggatgcgcgctcgcagtgccacgtcgatggatcacaagccaacacaaggatgtaacatgaagcacagccttcgaatcagcgatcaaaaccaaagtctcgagcactgaatatatgtggggcgcgttggctgcaatcgctggggcgagcatcgcactcgccttggtccaccaggctgtcgaggtcgtgaaggggggtggcaaggatgacgcatcggtgaagcagagtgcccttccgcctccagacaaaaacatgaagaaaagccctggtaagagtcagactttcatgtcctgggggatctggggtactgcttgacatgtttgggtgtttaggccgtgccaggagggacactgctgctgctgctgaccttgattgaggcatgctcagccacccagcgcacgaccccnnnnnnnnnngagccctggtaagggtcggactttcatgtcctgggggatctttggtactgcttgacatgtttgggcgtttaggccgtcccaggagggacactgctgctgctgccgaccttgattggggcatgctcagccacccagcgcacgaccccgcagatggaacctggcgcgcccccctgtgggagtccaagaacgcggcagaaatgttgaaggctgccaagaaggctgctcgcaagtagtgggcgggaggcattgatgatgaggtgccaacttgccagcagccagcagccgggcaggcttacgcggcgcctgaaacacaccacgcagcgaggcaacgctgtctccccaaatatccttggtcctcagcgccgcacagaccctccaaacctgcaccagcgctgcaacagcgtgggcgctgcggcgccgggccaggtggcctgggagcccatcactcccaagcagctggctctgaagctgggagtggcgnnnnnnnnnnggcgtgggcgctgcggcgctggggcaggtggcctgggagcccatcactcctaagcagctggctctgaagctgggagtggcggcatccaccggaaagctggacctgtctggttgcggactgcggcatgttccccctgaggtctttgacatcacaggtgggttcctaacaggctgaaccggggggtgtactcatcatgttgttatcagcgtcagttaccatgtggcagtttggactgtgctgcagttgtctccggacggagtaactcgcctcgcctcttaccggctgtagtttattatggatactacaaacacgtcaacgccgcaacttcctccagatctggagnnnnnnnnnngtgttgtcaccagcgtcagttaccatgtgacagtttggactgtgctgcagttgtctccggacggaataccccgcctcgcctcttaccggctgttgtttattatggatactacaaacacatcaacgccgcaacttcctccagatctggaggagctgtccctggcagggaacggcatcgaggagctgcccgaagccatcgcctcccttccctgcctgaccaagctgcagctggcgggaaatgagttgcgccgcctgcccacggcattgacgaccctgcaggacctacgcggcctctggctgcatggcaacgcgctggagacgctgccagaggacctgggcgcgctggaggccctggagctgctgtccctggcggggaatgcgctgcgcatgctgccgtggtcggtcggcgacctgcacgccctgcgcgagctcaatctggcgggcaacgcgctgacggcgctgccggggtccatcggcggcctgcgtggtctgcagacgctgagcctgctgggcaaccggctggaggcggtgccggagacgctgggggcgctgggcgcgctgcgcgagctctggctccagggcaacccgggccttggcgcgttgccggaggagctgggcggcctgacggcgctgacacacgcctccgcggccgactgcggcctggcacgcgtgcctgggagcctcttggcgttgccgcgcctccacacgctgagcttgtacgggaaccggctggcgacgctgcctgccgaggccctgcagcaggtgtactacgaggatgacgaggaatcgatgacgacgatggctgacggcgggggccttgctcatcctgtgttctgtgtggggtgtgggtccagcgggggctggggtccagacgtggccggggatgggatgtcttctgccactcatccaatgccggagccgccgccaatggtcagcactgactccacacatcgtgcaaccctcagggcacctccctgcggnnnnnnnnnntgggggctggggtccagacgtggccagggatgggatgtcttctgccactcaccaaatgccggagccgccgccgatggtcagcactgactccacacgtcgtgcaaccctcagggcacctccctgcggcgcctgtggctggagggcaaccctctggacgcgggcaccctggcgtccctgattgctggcgccagtatgagccaggacgtgacggtgggtcttgacgagtcgcagctgcagcatgcggcagcaagcgtgggcgccgtcccaataccagcaaacgtccagcgctctgagattctcgcccccggcccgggcctgttcaagctcgtgcgctgggctggtctggccgggatcccggcggccgcgcgaccctctgccacccagggtgcgccgctcgccgccgccgaaaccctgctcgtcgcctttggcagcgcccccggcgttcccaactgggcgggtgcgctgaagaaagtggccgcccggccggaggtggccccgtttgacgtgctcttcgtcgtggacgccgcccgcgcctggtaccatggtgagctcttcgggatgggaacaggtggggggacggtggcgcagcccgcacgccctgagtcacgcgatgagctgtgtgcatgctggggtgcaagcccagccgctgcccatccacaccgtcaccgtcatgccaggcggggacgcgggcatcgaggagtacgcgggccccctgcggcaggcggcctcgtgctaccaccgagtggtcctgctgggcgacagcatgggcggcacggcggccctcctctttgccggacaggccaccaaggtggtggccttctgcccccaggtggacctggcgcgctcggccatccgccccgccggccccgcgccctggcgcgccgcgctgcagcgccgcgtcgaggaaagtgtggcagcgtgcaggggcgtcgtggacgtgcacgtgggaacctgggagcacgaccaggagcaggtggggcgtctggctgggtgggtggaggcggggcgatgtggacctgggccccgtgggaggacggctcgtgcagggccgggagccgccccccgccccaccccatactccaccaccgtcacatgcctgaccacaccctaggtgcaaggcctggagtccgggtcggtggtggtgcatgttcacccggtgaacagccacaggctgagtgcggagctggcgaggagtggggagctcgaggtgatcatcgccggctccctgatgccagcctgaacccttagctgctcggcccagggcatgtcctggccgaccgagtgcaccatgcatgcgtggcacgcgcagctgccctagctcctctggcagtgaaagctcaacctgcggcccagcatgagaaagggtggtgttgtgtagacctcgagcccctgtgatggatgccatgatagccttacgtaatgagggtgcgcagcatgagcgaggattgcgcctaccagcccagctttgaggcctcggcccccatcccagaccactcatatgtgagtgctcacatcgaaactcaatcgcgtcccgtcactggtccctctcgccccactccgctctaggatgcccgcagtcagcccagacgcctgcctcgccacatgcgcgactgtcggggcatagggacgttgtcattcggcatggcagaaaccgcttcctcgcggccggagtctaccgcggagctggcctccagcggggctgatggcgtcacccacagcgtgcggtgccgctggactctgaccggcttcaacacatccaagcagctctggtcgccatacttcacggtggctggctccgatggccgggagcacgatgggcgtgtgctcatctacccctcaggtgctgggctggggtgtggggaagggtgggggggggacgcaggggcaggggcctagggcagaccagcttgctccttggatgccaggtttgcaggccatgccctggagcatagtctctgtgtgcaaccttctcaagtgtccccctcaagaccccacgtccttgccgtcaccacccgctgccctcttattcatgccgagcaggggatagccaggccctgcccggctacgtctccgtctacctccagctgagcgaccctgggaacagcagcaagtgggacgtgtttgccagctaccgcctcagcatcggcaccgaggcccagaaggggagggaggtgctgtcacgtgattcgtggcaccgcttctccgcccgaaagaaatcccatggtactgcgaagggcctggtggctggtgacattgaatggaaagcccgttgcggtgttggatgcagtggaagtacagctctttgcagcacttccacatcagtagcggcctcgaggtggggtctgtcactcagggaccccccctttctgaagagccagtagcacccaccccccacccaaaattgtctccccgcccctgaccgcaggctggtgtgactttgcgccgcacgccgcgctgacggagcccggcggggcggccgggtcgctgccggagtcggtggagctgtcgctggacatcaccatcctggcagagtccacctccttctcgcgcgacccggacctcagcgggcgcgtccccggcgcgtcggacccctgcatggccggcaagttcctgtggacggtgcagaacttcaccgccttccagcccctgctgaagacgcagaagatcatgagccccgccttcaccgccggtgcggggttttgggtgtgggaggggcgcgagtgaggtggtagagtcatgcaccctgcatcccccggaccccccactcaccaccccccacccacccacgcggcgcnnnnnnnnnngggttgtgggaggagcgcgagtgaggcggtgtggtcatgcaccctgcataccccggaccccccctcaccaccccccacccacccacgcggcgctcttcccccatcaggtgacatcatgctgcggctgtcggtgtacgtctcggccctgggcgacggcgagtggctcagcctgtgcctggagtccaaggacggcgaggtgaagctgcagcccgagcgctccacctggtgcctcttccgcctgtcggtgaacgcgcagccgggcgcgagcgcgggcgcgggcgccgacgcgggctcgccaccgctgcgcagcgtccagcgcgactcctacggccgcctggccgccgatgtgcgtggcggggagaacaccagcctgggctggaacgacttcatggccctggccgactttgcggcaccgccctacctggtgggcgacaccgctgtgttcgcggcgtcgttccaggtcatccgcgagaccacgagcctgacgcgcacgctggagccgcgcggcggctggggcggcggcgtgccaggcggcggcggccccg

SEQ ID NO: 36373 - DNA, 504 bp, Chlorella protothecoides
cgcggcggcgggcgtcgcggcgggcaccgcgggcgcagcgccggcgctcttggcggggccggccaggctctcggccgcgcgtttggcctctatttcggcctcgcgctggcgctggcgcgccgcgatctcgtccagcttgcgctgcctctccgccgcctgctccgactttgatggggagagaggaccccgacagtgagcaaaccggggttgtgccggggtggctgcagacccggcaccggggcgctggccgacgcagcctggctcccaaggcccaccgcggctggtcagcgatgagagcaaggtccacacatcccgcctgctccccgccgtttccccacaaacaaacagggagtaccatcgtcgacacagtctgacccaccctttcccacccactaacctccccccccacccccatccacacccacacacctctgccttgcgtcgctcggcctccagcgcacgcgcggtctcctcctcggccttgcgcttctcctcgatctgcag

SEQ ID NO: 36374 - DNA, 69 bp, Chlorella protothecoides
gctgctgacgccatcgctggctgtgggggaatttagagacggggtgggaagagatcgcgggcaggggag

SEQ ID NO: 36375 - DNA, 61 bp, Chlorella protothecoides
cacgagtgtcggcgcagcacaggcaggctgggcaccccgagcggtcggttccccacacatc

SEQ ID NO: 36376 - DNA, 61 bp, Chlorella protothecoides
agtcagcgcttgcgcatggtcgctctcccatgcctccagcccctcctgggaccaccacctc

SEQ ID NO: 36377 - DNA, 159 bp, Chlorella protothecoides
ccacttcttgctgaggttgccaagcgatctttgttccgtcatggagttcggaccgcaaacttcttcatccgctgactccgtcgccgtcacgggcgccaccacctccaattcacccctgcctctctccatccatcctctgcagtctcgcggcagcgtgcg

SEQ ID NO: 36378 - DNA, 77 bp, Chlorella protothecoides
gctggcgatgtgacttgccaagcgcagaggcagggatggtgagtttgcagccataggctacccacacgaggcaaggt

SEQ ID NO: 36379 - DNA, 72 bp, Chlorella protothecoides
gcgcagagctgaaggcgggagtttcgggctgccaacctcccaagcccctgctccttcgcagtgcgcggccgc

SEQ ID NO: 36380 - DNA, 9109 bp, Chlorella protothecoides
  modified_base (457)..(466): a, c, t, g, unknown or other
  modified_base (1210)..(1219): a, c, t, g, unknown or other
  modified_base (1850)..(1859): a, c, t, g, unknown or other
  modified_base (2558)..(2567): a, c, t, g, unknown or other
  modified_base (3672)..(3681): a, c, t, g, unknown or other
  modified_base (3765)..(3809): a, c, t, g, unknown or other
  modified_base (3909)..(3918): a, c, t, g, unknown or other
  modified_base (4462)..(4471): a, c, t, g, unknown or other
  modified_base (4830)..(4839): a, c, t, g, unknown or other
  modified_base (4996)..(5005): a, c, t, g, unknown or other
  modified_base (6280)..(6289): a, c, t, g, unknown or other
  modified_base (6430)..(6439): a, c, t, g, unknown or other
  modified_base (6525)..(6534): a, c, t, g, unknown or other
  modified_base (6735)..(6744): a, c, t, g, unknown or other
  modified_base (7415)..(7424): a, c, t, g, unknown or other
  modified_base (7892)..(7901): a, c, t, g, unknown or other
  modified_base (8305)..(8314): a, c, t, g, unknown or other
  modified_base (8690)..(8699): a, c, t, g, unknown or other
gtgtagcccgccacggagcgcagcgcgggaccgcgcgggtcggcgcgcacacgcgccagcaccgccgccgcgccggccacgtcgccgcactcggcgaacgcgtcgatggccgcgttgtaaagggctggggggggggccaggcgcagcgcctccaggcgcgccaggagcgaggtgaggtagccgcgcgcgttgttgcgcccgaagcacaccaccagcgcgcggaggaggtgctcgttgcccagctgtcctgctgcctccagctccagcaccagcttccaggcctcgtccaccctgtgtgggggtggttggatgggaggtgtgtgtgtgtgcgtgtgtatgtgtgggggggggctgagagtgcgctgcaataccgaggtccacaaggcgctccgtgagtcgcggggcagcgcggcgccacgacgacccggcagccagggtggggctgccatggaggtgnnnnnnnnnngtgtgggtggggggggcgtagagtgcgctgcaataccgaggtccaccaggcgctccgtgagtcgcggggcagcgtggcgccacgacgacctggcagccagggtggggctgccatggaggtgggatttccgtcagagaccgccgtggagcaccaaaacgcctacctgcctgccgcacccctgctcggcggagcctgatccttgtcttcttccatgcaccaacaccccacacacacaaaaaaccaacccccccagggtcacatgcctgcccgagtatccgtaggccttgaccagcagcgtcacgtactggctctgcatgggggccgggtgccggcccgactgcagcgcccacatcacacgcagcacgccctccacgtccccggcgtcggcatgcaccgaggccctgcagggtttgagtgcaggggagggagggggggaacatgaggtgagcaaacgagactggcgccggatggtccagccgtggccggctgcaccgaggcgtcaggggcgcagaattgggcatgcggacgctgggcaggcaggcgatgcggggcagaccagaagtattgcgtcgacaagataaacacaagactgtcagggagtcaccagacgcatcacaaagcaggcacagtggcctggagcctcgcgagcattcgtggccggtggacacacatggaagccggtctcgcaccaggcccaccgcctgcacgccctctgtcccctgttctcaaggaaacctcgacatnnnnnnnnnntgtggccagtggacacacatggtagccggtctcgtaccaggcccaccgcctgcacgacctttgtcccctgttctcaaggaaacctcgacataaacaacccgtaccagtagaagtagggcaccacgaagttgtggggaagggcccccctatcccgcaggtccaccagccggtgcatggccgcatccagctccggcctggagccacgcaggatgtttatcatggaccgtgccgtgttgctgtccgtcggcactcccctggcctgcatggcacccagcaccgtccgcgctttccttggggacagccagcgcagcgcggcgttgaagtcacaggtcctggcggccggtcggtccagcagggccaggcagcccgccacatcgccggcctgggccagcgcccggatgcgctcgaatgtcgcccgccctgtgctcgactgtgttggggcagggcggcgcggcccctgctcaggaccacgggcgccgccccttgcattggcacgtggagggctgcctgcagactgcgcgacgcgtcgcagcgaccccctgatgacgtccacggctagcaggggctggaccctggagtagccgacggtcccaggtcttgcgccagtgggcgcggggcctgggctggatgnnnnnnnnnnacgcaggggctgggccctggagtagctgacggtcccaggtcttacgccagtgggcgcggggcctgggctggatggccgagggccagagccagcgcgtgcatggacagggccggcggattccgggccggagcctgcccctcgggacccgaggcggccggcggtggatgatccagccaggtcaggggacgcagccggactcgccgcgccgctgggggccgcactgtgcagggcgtgtgacaggtaggcggccagggctggcacagggccccccctcagccatgctggccaggtcggatggggggaagcccagggctcacgcagcaggcgcctagcaatgcgagacatggaagggattccctgggactataacatggtctgggtgctgctgcggaacgaccaaatgcagcgggtggggccgtggggctggcaccccggctggccgctacgcttgccagtggcccaggtggtggatgcttcagatgaaaaaattgagattaagagctcggatcaggaacctttcagactgcatatcgaaatcgtgcagtttgtgagtctacagcaccccacacgagttgggcgcgagtgggaaaaccttgcattggtccatcacccggaaccatagtgacacctccagactcacattctgcgttcgagcggcttcagccctagctcatttataccatagaggcacacattgtnnnnnnnnnngggtggtggatgcttcagatgtaaaaattgagattgagagctcggatcaggatttttcaggactgaatatcgaaatcgtgcagtttgtgaagctacagcacccccatccgagttgggcgcgagtgtttgatggggaaaccttgcattggttcatcagccggaaccatagtgacgcctccagactcacattctgcgttcgatcggcttcagccctggctcatttataccatagaggcacacattgtgttatttccaccagtcacttgtcagacaggggtgccccggtggcccaccgcgcccctggcgcacccaccatgttctacctgctggagttgaaccgggagctggaggttcagccgcggcattttgggccaaaactagcgcaagaagtagagaaacgcctcagacaggaggtaagcggtctgggagggatgcaaggcctcaccatcatgctcggattgcccagtcttacaacacaatgcccgatgggacggatcactacaggttgagggtacctgcagcggcatatatggctttgtgttggcagtactgaacctggagagcctgggaaaggcccgaatccgcgagggtgctggatcggcggtgttcaatgtcacctacaagtgcatcacctttaagccacacaagggggaggtgctggacgtggtagtgaccacagtgaacaaggtagggggtaaatgagaactgaagttgtctttcccacttgttattggctgctcccgtgggatcttggctcaagactgacttcgacgcagcaaggaaattgccgtgggtgagtccctctccaccgccaacacccccgcccaatgacacagatgggcttctttgcggaggcgggaccgcttcaggtcttcgtgtccaaccatttgatcccggaggcttttgagttctccagcatacacgagccgtgctacgccaccccggatggggagcagaggatagccgccgcctccgatgtgcggttgaggatcgtgggcacccgcatcgatgccaacgagatcgtgagtcggtgggctacgcttgtggatttttgtggctcagacggtggtgcaagggagtgccacacgagcgatctacatgtggnnnnnnnnnntgtgagtcggtgggcaacgcttgtggatttctgtggctcagacggtggtgcaggggagtgccacacgagcgatctacatgtggnnnnnnnnnnnnnnnnnnnnnnnnnnnnnnnnnnnnnnnnnnnnnctacaaatgacctgagtccctgggcttggaatatctctggtgcggccggcacgcaggggggaagcacctgcttccctgcctgaggactgcagctgcctcnnnnnnnnnnccgctgctttcagtgcatcaggcagtgtgaacttcccccaacccacccacagtttgcggtgggagacatcaagggcgactacctgggagtattacaaatgacctgagtccccgggcctggaatatctctggtgcggccagcacgcatggggaaagcatcagcttccctgcctgaggactgcagctgcctcgaatcagaacaatgcagctccttgtacctcgcatacgcggcgctgctggaattgccatctgcgcacgaccaacagtcgcacgtgctggacctcccatggacccctgcgcatcacaccactcgcctgcaccccacccctgcatcaccctcgctggctgtgctcggcctgcagctttcagacgtgcatttgggtgtcgacgcacgaatctcgatacacacagtgtgagacattgccttgggtcgtggaaaaaaacggtctcatgaccctcactctcgcagcacagggcgcaccaggtcctggcggcccccgactgaaggcgaccttcacacggccttgccgcccgcctgcccgccnnnnnnnnnnaatacacacagtgtgagacgttgccttgggtcgtggaaaaaaccggccgtatgaccctcactctcgcagcacagggtgcaccagggcctggcggcccccgactgaaggcgacgctcacacggccttgccgcccgcctgcccgccctccacccacgccccgtgctgctcgttgcaggtacgcagcgcgcgccagaccgcggagttgcacttgaaacccgacccgaatgcgatctgccagatgcggtcgcccttgcgcaggccctgcttggtctcaatgttggccagcacataccttttagggggtgggttatgaggggagggacgttaggtgggggatcagagggcagagtgacaatggnnnnnnnnnnggggagtggggtttgaggggagggacgtcatgtgggggatcagagggcagagtgacaatggggtccacacacggtgaggctgcacgagtcattgagaaaacctaccagaaccacccccaaagccaacacacacgcacacgcaccagatggaggcggnnnnnnnnnntggtgaggctgcccgagtcattgagagaacctgccagaaccaccccccaagccagcacacacgcacacgcaccagatggaggcggagctgatgttgccatagcggtagagcgtctcgcgcgagggcgcggcgttcctggtgcccagctccagctgctgctcgatggcgtcgatgacgccgcgcccccccgtgtggatgcaaaagtgctggaaggccagcttgaagtccgggatgtagggcttcaggcccttgcgcttcagcaccttgcgcgccaccaggttgaggaagaagagcagctgctcggagaccggcagcaccagcgggccgagggtggtgatgttggccttgagcgcgtggcccgcgatgcgcatgagctcgcgcgacaggtgcaccccgcgctgcccggccccatcctcctgctggtacacgcagccgtagtgcgcggcgtcctggcccatgtgggtgcggaccacatgcagcagctccagcttggcgcgccagcggtccacgcgccggttgctcagcagcatggccgcgccgcccaggcggaagaggcagttggggatgagcatggacttggcgttgccaaagtaccagttctgggtgatgttctccgtggacaccaccagcgcggtggagcgggggtacacctgcagcagctcgcgcgcgagggacagcgagatgacgcccgcggagcaccccatgccggacaggttgtaggtgatcacgttgctccgcatgccaaagtggttgacaatcatggctgtgtgtatgtgtgtgtgggggtggtggtgagggggggggtgggacacaggcaggcaagtcgggggtctcaggcaccaagcacaaaggggcatgggtcccttgaccagccatcaacacacctgacagggagggcgtggggttgaagagggagcagttgacgatcaggatgtccacggccttggggctgatgccggtcttggccaggactcgctccaccgactcaaacaggacctggttggcctcccctcgcgccgccgccatggtgggctccggcgggttcttcatcacggctgtgctgagtggcaggtggggggcaggtggagggtttgtgacaaacaggccacgcaaagccacgccagggaggggctggtgcaaagcatgccacctgcttggccacggacggacggcagcacaggtgtctgaccgtacacatgaaccaaacccaacctacgaacctccaaccccaccccacaaatcctcgcaccctctggcaggtacgtctcctcgccnnnnnnnnnnacgtacacatgaatacaacccaatctacaaacctccaaccccaccccacaaaaccacgcaccctctggcaggtacgtctcctcgcccagccccgacctctccaggaccttgcgctggaactccaggctctcgggcgtgaannnnnnnnnncagtggcaggtggggggaaggtggagggttctgtgaccaccaggccacgcaaaggcacgccagggaggggctggtgcaaagcatgnnnnnnnnnntacttgtacgacaccttgagactgcggagggtgagtcgaggagaggcacaggggctgggctggggtggtcctgggtccaggcacgcagcgtggcccccaagtttgctcgatggccctcaacccagcccaatgcacctatcattgggtttgaagcaatggtaattcagcaagtacaccgggcgtttccgggtgaagatgtannnnnnnnnnggcgtgggccccaagtctgctcgatggccctcaacccagcccaacgcacctatcatcgggcttgaaacaatggtagttcagcaggtacaccgggcgtttccgggtgaagatgtaggcggcggcagcaaagatgagcagcgagcagccggcgatgaaggaaacctgcacgattgagtgtgaggcatgctctggtgggtgaggacacctccattaagtgacaggcgcctttacattatcatcgctgcccaggccgattgctagcattcaaagccatctgaacgcaaaaccacgtttcgcattcctctggcactccctgggtggccctgcggggcgagcgagaacgctggcacaccccatgccagcgagcgccctgcatgcatgcctccctgggacccctcgccacatctggtgccacgcaccaaatcaaaggtgaggtttgtctgcttggccaccacccacatgtcgttcagatcgccctgcttgtacatgtttgccagctccagctgtgcttggggaggcgggccgtggcatgaggaatggcagggagatgtctggtctgaaacgcccaacatctgctcagggtctcttctgttcagaggcacttgcagccacactcaccagacccactgccgccagggggacggcggccagggtgaggaagtgggtgcacnnnnnnnnnnactgtgcattgggagggggcccatggcatgaggaagggcagggagatgtctggtctgagacgcccaacatctgcccggggtctcttctgttcagaggcacttgcagtcacactcaccagacctactgccgccatgggaacggcggccagggtgaggaagtgggtgcacagggcatggtagcctgccatggggcgggttggattgaccaccgtgcgaccctattcggcatgaagggccggaacgggaggcatgcggcacgcgagggtgcagggcgcgcaaggggcaaggtccatgggatggagcacaggtgtcggcacttttgaaagtctacggcgtgttgcacctgctcgccacccccctgctcacctcgcttgacgtatttcagggtgataggcccactgtgacgatagtctgcatcatggggtgggtgttggttggaatcacattgggcctgcacagcgtcaaagnnnnnnnnnntaccccgcttgacatatttcagggtgattggcccactgtggcgatagtctacatcatggggtgggtgttggttagaatcacattgggcctgcacagcgtcaaagcaggtgatccgcccggcctacggcctcccggctgattccagtgcacacctgggatgccccgcgtcgtggaggtgtcctccggtgtgtgtgtgccattctggatggccatggcgcacggcctctgcttgcgcccgcgtgagtcgacccgatccgctcgcccctgctgtcgagcctgtgaaggcgaccctggagggcgcaggtccgctcgtggtcctctctacagacttttcactcgccgatacgctcacacacgctcactcccgtgacaagctgatggccaccccgtcgtgcaaccccttnnnnnnnnnngcaggcttttcactcgccgatgcactcacacacgctcactcccgtgacaggctgatggccaccccgtcgtgcaaccccttacacgagtattcataatgggatcggggtggcgggagtgccccggccgcgccccgggcctccccgctccgggtcgcggcagcaaccctccccggccctcctgccgtcccgtgcgtcacacgcgggtcagtgcagtggtgagcaatgcgatgcaacggtcgagacttcggcggccaggcacggctctcacccggcgacgggggaggtgggcgcggaggtggccggcgcggcggggggcggcggcccgcgcgccgcctgcggccccgccccggcgtacccctgacccgcccgtggcccnnnnnnnnnnacggcggggggcggcggcccacgcgccacctgcggccccgacccggcgtacccctgacccgcccgtggccccgcccccggcggcatgcccatgggcggcgggggcgggtagggcatgagcaccatgcccggggccacaggaccgcgcgcgccgcgcggcgcgccgcccacgatgtagtagccgccgggacccacgggcggcgcgccctccatcatcatgccccccggccccaccatgggcccgcccatgccgtacgcgcccggcggcagcggccccgccatgtaccccgccggcgagcgcggggggccgtggtagtcggggccggggccgcccgggcccaggccggggccgtacccctcgccgccgggcatggggtagtacccgtggtggggcgggggcgggccgcgcgg

SEQ ID NO: 36381 - DNA, 84 bp, Chlorella protothecoides
cccttccattcccctcgccccctacccccctggttcgccgattgaggcaaccacctgcgccagcgacatcccgtcctcgggaat

SEQ ID NO: 36382 - DNA, 61 bp, Chlorella protothecoides
cacctcccgagtctgagcgtggtggggcgaacatgaaggggggtgagagatgtgcagagga

SEQ ID NO: 36383 - DNA, 61 bp, Chlorella protothecoides
ggtgaggatggcgagccagagagccaatcgccagggcacgagccgggagccaccagagtgg

SEQ ID NO: 36384 - DNA, 64 bp, Chlorella protothecoides
cgagggtaacttgtggcggggttgaccaggacctgcagcgaggccggcgggatgcggagtgtgg

SEQ ID NO: 36385 - DNA, 69 bp, Chlorella protothecoides
ggcccccatctccagctgcgcctgcccgtgctctgtgaagggagcgcatctcaatgcaagctgccagcg

SEQ ID NO: 36386 - DNA, 97 bp, Chlorella protothecoides
agcaagagggttggtacggttggagcgacgggggtgtcctgacacaggccccagagaatgacactgtatgcacaggcaacgatgctggggttgcgaa

SEQ ID NO: 36387 - DNA, 77 bp, Chlorella protothecoides
ggtcgaaatggcgagagggtgtgagccgtgcggtgcactctctgcgggagtctggagcgctgcagacccaggggcag

SEQ ID NO: 36388 - DNA, 72 bp, Chlorella protothecoides
tcaccctcgcccatccccagccccgaggagtctcccagccctgaggcgtcaccctcacccatccccagcccc

SEQ ID NO: 36389 - DNA, 73 bp, Chlorella protothecoides
tggcttcagcctccccagtgcgctacacacgtatatagacagatgcgcacagccactgacacgtttgatcccc

SEQ ID NO: 36390 - DNA, 63 bp, Chlorella protothecoides
gattgaattcaaggacgcaatctaggagccatatgtgcactccatgtgcgtgcgagggtcagg

SEQ ID NO: 36391 - DNA, 122 bp, Chlorella protothecoides
cagagcagggagctggggtgggtgtgagcccagcatatgcatgactgtcggtccaggctgcagtcggccacaggacccccccctgcctgcctccttctgatacaggggatgagggtggggac

SEQ ID NO: 36392 - DNA, 82 bp, Chlorella protothecoides
ccgctcccccccccccccccccccccccccgtccaccaatttgaccgaccctttggaccccgccctcccacctgcaggacgc

SEQ ID NO: 36393 - DNA, 73 bp, Chlorella protothecoides
tttgccaggggcgctcccgaaacatcgcggtggttggggtgccgaggacaacctccgatctcgcgcccaaccc

SEQ ID NO: 36394 - DNA, 132 bp, Chlorella protothecoides
ccggtgagttccaacccgtgggctgtcggggctgctcggggtgcggcgtagatctaccgagctgcattgacggcctgctgtccagtgctgggacgtgtcgaaacaaccagatttccagctctcggtgtcaaa

SEQ ID NO: 36395 - DNA, 79 bp, Chlorella protothecoides
cttggtggcggagatggtgctggtgtgcgctgcccgcttcacgcgcattacctccaccagcttctccccgggggccaag

SEQ ID NO: 36396 - DNA, 79 bp, Chlorella protothecoides
gctttaatggtctcgcagtaggtggactggcaggggagaatggggagatgagtcaagttgggtgtgcccagtctacgtg

SEQ ID NO: 36397 - DNA, 118 bp, Chlorella protothecoides
ccttccgcgagcacctactggagtaccatttattgaaggtgacagcgaaactgtgctggatggggacaggtggccgaggacccacgctgttcgtaggggagtgatcccgtagtcagtg

SEQ ID NO: 36398 - DNA, 75 bp, Chlorella protothecoides
ccccagagggccccttcaccatggccgacatagtagttgcgtcacggccacagtccacggcacctactacaataa

SEQ ID NO: 36399 - DNA, 72 bp, Chlorella protothecoides
ctgcaattctcatccaccacgtccgagcccccatctgtgaatgcacccttggcggtggatgggaagccgctc

SEQ ID NO: 36400 - DNA, 61 bp, Chlorella protothecoides
tggcgacaagctgcaagcattcacagatgagtcctcgttcctggactccgtccaatcaacc

SEQ ID NO: 36401 - DNA, 61 bp, Chlorella protothecoides
cgcgagggcgccagggcgaatccaggccccactcccgtcaaggcaagccgaataattctgt

SEQ ID NO: 36402 - DNA, 100 bp, Chlorella protothecoides
ggggtaagccttcctcggcgacccacctagcgactcaggaggctcatagactccgggggcttggtagctacgtatctgtcatgctacaagcggcgctgag

SEQ ID NO: 36403 - DNA, 73 bp, Chlorella protothecoides
tgaagggcggaatcgtgagggagaggatgaaaggctgagtgtgcatgaatgggtggggcgggacactcggtgg

SEQ ID NO: 36404 - DNA, 64 bp, Chlorella protothecoides
agtatcacactcacggctgactgaggcggtcagccatggcaacacgagggtcgctgtcgacgag

SEQ ID NO: 36405 - DNA, 77 bp, Chlorella protothecoides
cgctgcggtgaggccagggacacaatcttttccaatctatgcatgcatatttacagtactcataatgcattggtcca

SEQ ID NO: 36406 - DNA, 168 bp, Chlorella protothecoides
gggggtgactgccaggtccaggcctgattttgccagggcggcagactccactgggtcccgggtctcgatggactgggaggattttgggggggcggaagggggagagtgaaatttgcgccatggaggaagtgagttgcagattccttgtttgggacgcatttcccatgt

SEQ ID NO: 36407 - DNA, 61 bp, Chlorella protothecoides
tccaggaccggctgcacctaaatctaccataactgacaatgcctcctttatcacaagcacg

SEQ ID NO: 36408 - DNA, 101 bp, Chlorella protothecoides
ccgcgtgttccaggacgcggtcaagtccggtggcgcggcggcgctggccgcctcggcccgcgtcatcttcctgggcgtcaagccgcagggcctgcccgagg

SEQ ID NO: 36409 - DNA, 113 bp, Chlorella protothecoides
tgtagcgcccctgtgcaaaccagctggttgggactttgacaatcttctttctgccgatgtgagacattagtaggtgcactttcaaaccttgtacacaaccaccctcctccccc

SEQ ID NO: 36410 - DNA, 433 bp, Chlorella protothecoides
cgacctcaccatctgcggaccggctaggactgttgtccggtgggtgcaaaggcagaaaacccccttgacacacagtttagaactattaatgataaaaaaccacctaaaagaacgagctgtacggcatcgtgcgggttgcacaggaccgcacatccacgtgtataccgggcgttcatccggccaccgcatggctcctcacacggctcagaccggtctcagagacagagtaggctggagggttattccaaaattctttgttgtttcgagagtatgacacaaaattatcacgaagatgggatcgagatccaacatttccattcaagctgatttttttgaacgcgaggagattatcgtgcttctactgcagtgccggggccttgcatgagcgaagtaggcggacaggtcatacggcgaagcatcatcagctctcaaa

SEQ ID NO: 36411 - DNA, 61 bp, Chlorella protothecoides
ggtcgcagcccggcagaattgccacatccttgagggcggtggtattgagacagatggcaca

SEQ ID NO: 36412 - DNA, 61 bp, Chlorella protothecoides
ggcatcgccggcctggcggtcgccctggacaccagcctcaccgatggggtggaggtcgacg

SEQ ID NO: 36413 - DNA, 106 bp, Chlorella protothecoides
ggatgggttcatgaggatgacagggttggggtggaacacgccacaagggtatggcactgggtcgggtgaagggccgaggggcgacatgcacagggatcaacgcatg

SEQ ID NO: 36414 - DNA, 79 bp, Chlorella protothecoides
ggagctcatacgatcctaagacggtaatgaatcttacactatagtaatcaatacaatatacgtccttcttccctggatg

SEQ ID NO: 36415 - DNA, 68 bp, Chlorella protothecoides
acacagactgagcctcatcaccagcggctgcagcggccgaaaggggacgggccgtgcgcccggcaggc

SEQ ID NO: 36416 - DNA, 61 bp, Chlorella protothecoides
cacatcgcccaccgtctcctctggcttgccaggcacccggtccttcatcggcttgtagtcc

SEQ ID NO: 36417 - DNA, 61 bp, Chlorella protothecoides
ggcccacgtcacggggagctccaggaacccaggcggcgtgcccagcacctgacccggcacg

SEQ ID NO: 36418 - DNA, 108 bp, Chlorella protothecoides
ttttgtatgtggggtgggctcctgagggagtgtgtctggtagaagccaggggtgtcagcgaggtgcagggcgcagatgcagcagcacacccacaactgccatggcgcg

SEQ ID NO: 36419 - DNA, 65 bp, Chlorella protothecoides
cgggatgcgcagcatcgatgtgagaggacaccaagcggcagtctgctgcgggtgcgatggcatgg

SEQ ID NO: 36420 - DNA, 78 bp, Chlorella protothecoides
aatcgattctcgtgtttgggttctgcgactcggaatcgggtgcgtgcgcttgaggcagtgctcggctggtgcaatcgt

SEQ ID NO: 36421 - DNA, 61 bp, Chlorella protothecoides
tcaggggtatccccctcagaactaccaggccggctacccaccccagggctacccacctcag

SEQ ID NO: 36422 - DNA, 77 bp, Chlorella protothecoides
cacctgtccccatcgcacaggttggggctgtgcagacaccagctgctgctgctgctgctgcacggggacgtacccag

SEQ ID NO: 36423 - DNA, 87 bp, Chlorella protothecoides
gcagcaggtgaacgagggagatcacatctgggccagtgcgggactgctgcattcccggcacctagccctgttggggtgtgaagctgg

SEQ ID NO: 36424 - DNA, 108 bp, Chlorella protothecoides
gcggagccggagatcaagtgacgagggacaacgttggagatagcgacgcggggcatggcagaataaaaggaactcgggacatggaacgcagagtagcagggggctcgg

SEQ ID NO: 36425 - DNA, 79 bp, Chlorella protothecoides
catggtagcccttgctgacaatgcctgcattatgagtcatcggaggagaagctcccgagtcacggaccggagatgccaa

SEQ ID NO: 36426 - DNA, 121 bp, Chlorella protothecoides
ttctgctattgctccgccgggatcgcactcaaaagtgcaacgtctccgtgacgatctcgcgccctcacaagccaagtagcctggctcctccggaagatgttgctgttacgctggacagcag

SEQ ID NO: 36427 - DNA, 108 bp, Chlorella protothecoides
ggccattcaaccccaagctgccttccaggagtgtagcctttctctggaccttctggatcccttgtcttgacctccccacccaaccccttccccctccctccttccacc

SEQ ID NO: 36428 - DNA, 129 bp, Chlorella protothecoides
ggccgcgctggcccgcctccccgcgctggagaccctggtgctgcacgggacgagggcgcgggcctcgggcgcggtccgcctccaggcccagctgcccggcctggcggtggtgggggtgcccgggatagc

SEQ ID NO: 36429 - DNA, 72 bp, Chlorella protothecoides
gccatgccctgcagtcacaagggagactgaaggctgtgatccctgatcattgccaggggcatgtccactgct

SEQ ID NO: 36430 - DNA, 161 bp, Chlorella protothecoides
ttccgcggcaccgccagcatggctggcctcctggccgacatgaaggtaggtaccgggagggatctgcggagtggcagactcgccacgcatggggcctgctgctggggcgatgcgtcagcgctgctacctccaccctcgccttgagtctgactctgtggctc

SEQ ID NO: 36431 - DNA, 74 bp, Chlorella protothecoides
tacggggcctctcaccgcccgtatgccggctgtgattccgctgtcggagcagggagccaggcagggcccacacc

SEQ ID NO: 36432 - DNA, 77 bp, Chlorella protothecoides
tggcttgccatggacacttgtctcctctcggcacacgactcacaatctccacaccaacacacccatccacaggccca

SEQ ID NO: 36433 - DNA, 7711 bp, Chlorella protothecoides
  modified_base (2397)..(2406): a, c, t, g, unknown or other
  modified_base (2870)..(2879): a, c, t, g, unknown or other
  modified_base (4164)..(4173): a, c, t, g, unknown or other
  modified_base (6004)..(6013): a, c, t, g, unknown or other
  modified_base (6489)..(6498): a, c, t, g, unknown or other
  modified_base (7075)..(7084): a, c, t, g, unknown or other
  modified_base (7539)..(7548): a, c, t, g, unknown or other
gcagcgcggccgccccgcccctcgccggcctcgtcggcgccggcggcggcgccctcctcccacaccgccttgttggacaggcccagcgccggcagcgcggcgcccagggcctgctcgggcccggcgtcgaggctcgcctcagcctcggcgcctgcaccgctgccccgccccgtcagcgccgccagggtggcggtgaaggtccgcggcgcggtgaacacgcgcaccaccttctcctcgctgcagctcgcgtagcagggcggcgcacggctcgactccccggcaacctccccagaagtgctagcctcagcagcagcttccggaaccacggccaggccagagaagtcgtggccgtggacctgcggccgcgcgacctcccgccagcgatgtcctcccgccatagcctctcgcgttcctccacgcgcagctccatccccgttttccaccccgacgcagcgggcccagcatcgggctgtctggtcctcggagaccgtgagcaggcagtccccggcccacgccgcgtccaccaccgccgccacatggccagtgggcgcggggacgggatgccacgggccctcggccccaggggcctgtccgtcgcgccgccagacatgcagcgacccggtgtacccgtgggcggcggcggcgctgccgcagggcgaccagaccccggtgtagtaccccaggtggttggcgccggcgtcgcccagggcggcggccgacatccacaggcctatacttgaggggggggcgggtgagaagtctggtggaatggatgcagggcggtatccttcacacacatgtgcagcagtagtgagagaggagggatgagcaatcactgggcagagcttggggtatacaaccaaaccaagcgggcacaaagccactcggatgagggactcggtgcgatattcaatgtgcaggagcatccctgtgtgcttgctggtctaggtcccggcaggcacacataaccaggagtcggagggatggcccggctgggggtcgctgtcccggcgattttgacatgcagggccactgggttattgggccaggcatgcttcgaacgccggaggggacgggatccttcccaacttgcatatagccaggggtgcagtaggagccccggaataccgtaccccgtcccagaggcgccgccaccatgtgccagcccagctcaccagaggggtcgggctgccacagcatcagggtgcggtccatggaggctgagagcaggcagggcgcgcgcccctcgtccccggccggctgccaggccaccgactggacccaatcctcgtgtcccacctgcagtgttacccaggcagcaaggtttgggggacgactaaggctgccgctcctgaggctaacattccacccgcagggactgcagggcggccatgagtgcagagacactggcggttgcaagagtgttgtcgcatcttcccagcatcctgatgcaagcccaggattcctgcccagccctcaatcatctttctcatgccgcaaccatcccccatgcaccatggcccctcaccagcagcgcctccagcatcacttccagggactcggtgccgctcagcgccagccgcgggcggggcgcaaaccgcgtcaacagcgcctcggcttccggctcgttcccgggggccgcggcgggggccgaccccggtgctgccagggaccacacccgaatgtagcggtcctgggaagcggaggccaggagcaggcgaccgggagcatgggtccaggccaggcccctgacccagtcggcgtggcccttcagtcgcggacccgggaggaagtcgccgccagggccccggacgtacagagaaaccgagcagtctacgccgccgacggcgagcagggcagagtccccggcgctggcagggccatgcgtcagcgccacgctgtgcacgatgggctgccccgcatgcagcgttgagggctgtgccggggcctggacctcgaccagcgcgccattctgcagcgtcagcgaccagtgtgccacgcccgcacccccggagctggcacagaggaggaggcggtcttcggctggcaggagcagggcagccagggacgacacgggggtggtcgcggccgggagcacggccagctccaggggggagttttcgtgaaggctccacagacggatggtgccgttgcagctgccgctcgcgagcaggctctggccgggggtgggcaaccacagcaagcaccggacctccccggtgtggccgaggagggaggtcaccaccctctgcgcctgcgcagtaacgatagaccaccgattttgatttctctgacatagattggatgacgtgcaattgctttgcacgagcctctgcaccgcaatgccgggcagaaggtcagtgtgtcggcgcctcacctgggggtcgtacacaaggnnnnnnnnnngacgatagaccaccgattttgatttctctgatatgaactggatgacgtgcaattgctttgcgcgagcctctgcaccgcaatgcctggcagtaggtcagtgtgccggcgcctcacctgggggtcgtacacaaggatggtgtgttgggcggcgtaggcgatcagacccgaccgtccccatgccagggcctgggatgcacgattgcacccggctgcatggtgctcctgctcgatgtgcacctccatagaacgcctcgtgggcctccgggtccctcaggctggcatcccgctgtcctcaccgctgtattactacaagaaaacaacgtgataaaacatccatgagctgggtttatgcagactgtgatgtgccatcagcatgtatgtgccaggacatatgcctgcgagcatgggcgcccggacttgtagtacctcgccttcgggcgccctgggtctgctgataaatcaannnnnnnnnnatgccaggacatgtgcctgtgagcatgggcgcccgaacttgtagtacctcgccctcgggcgccctgggtctgctgataaatcaacgaccagagagccgggacggatcaggggtcggactcgcatccgaaggccacacaggcttggacttcagtcacgagacatatctttgagccgtcgggcgtccgatctgagggcggacctcgagatgtcgacgggccagtggcctcccatgtaccccggcatggctggagggcccatgtaccaccatcccgccatggggtggaatgtgatgaacgcacagatggcaccccagatgccggccttccccccaggacatcccatgtacccgcccgctccccccggccaggcagcccctccctaccagcccgccacgaccagcggcgagctccgcaccgtattcatcacgggcttcccgcccgacatcaaggagcgggagctccccaacctcctccgcttcctgcccggctacgaggtgggtggtgggcggcatgatctggtggggatccttggcagttacaagggtatcatggagtggagtggctgctcccgggtcgcacgtgcggtgtttgctcgcgggcctgaggccgcgtcccaccaggggttgaagcttgcggttgcagcgcactcctggcgggttcacccctcgtcacgcctgccacaagaacccctgcacgcaggcctgccagctgcacacccgcgccggcgcgcccctcggcttcgcgctgttcagcagcacccacgcagcgcaggcggctgtcagggccctcagcgccctcgcctttgaccccgagcaccccctgcgcgcccagctggcgcgcaacaacatgaacgagagcggcgggccagggcgctgggcgggccagggcgccagcgccctagccggaaactcaagccccacgcgcgatcacccggcctgcaacacgctgtacatcggcaacctgggagacgctaccgaggagagggagctgaacgacctcttcgggtggggcggtgtttttttgggggggggagaggggggtcgggcggggtttggtgtgaaggcatgagcagcaccactgccagggccagcagagcgctccacgcgcagggcccaaaatgaatggtcattttaaactcatgggtgctgcattgtccctgaaaggcgtgcagcgatgtgctcgtggtctcaggcagcatccagccctccactcaccccccccccatctcaccaacccgacgcccgcagctcctatgctggcttccagcgcctgcgcctcctgcggnnnnnnnnnnggactcatgggtgctgcattgttcctgaaagacatgcagcaatgtgctcgtggtctcagacagcatccagccctccattcaacccccccaactcaccaacccgacgcccgcagctcctacgctggcttccagcgcctgcgcctcctgcggggctcccgcaccgtctctgcctttgtcgtgtttgaggacacggcgacggcctcggcagcccgagagggcgcgcagggctcctcggtgccctcctcggaccgtggcccgctgcgcatccagttctcgcgcaacccctcctctaacaagcgcgacgcagcgagcgcgcagctgccgcaggacggtggctggatcgcgggcagcgtgcagcggccgcggcagggcgactacgcggcagccggcgtatgaagcggcgggggcggcagctggcgctcatagggtcgagggttccgggaggcggaggtcgctaggatggtgggcagcgcttgcagcacgacagcaggaagtctccggcagaataccgagagattgccaccaggggtgccctcgccggtgggccgcacagcctgcgtccctatcaggtgtggccaagctcacgttgggctccacaagctcacgctgggagctgaggcgctcagccatgtcaccttgtcatgacgtgcttggcgctcagcccagcagacttgctcacccatgctcggcacccggctcggcaccctccttcactcacccccgcacgacgcaattctctacgacaaggagtcagctctaggacccgacatgacccaccatgctggaaagcgcggtgtgcaggtctcattgaaacggttctccccaggcaccccagtgccccaactgcagttgccgcctcctccacccatgcctgctgcattcccattaaatgtcactgctgcaactgacacccagcggatttgcagaagggtcccacgccgcgaatttgcttggtgcaaggcatgcacgctgcgcagatcccaggtcagctgatgggggtgtcgggagtcggccgatcccactgcaccttcttggtgaccttgtgccagtagtagaccttgccggagccgtcgcgggtggcgccccagccctctggcaggccctgggtggggtcggcggcgggtggaggtcccgctggcggcgggatggcgaccgcaggtgcgactgcctgggcggctgctgcgggtccggggcgggctgctgcgtcagggccgcctgcaggaatcaagaatgagaaggctgtcattgcattgaaagatgcatgcgcttgagatgctggacctgtgggcacggattggcattgggcacactcttggtagtcgcactggcgactgctcaccagtgggtgggaacacttccgagggttcccctgcagcacctccagcaacgctgggggcctgctgtgcaggctcaggctgggggttctccagctcctcttgtcgtttctgctcggggtcgggtggcagagcatgaaggccatctggagcgtacaggtttccaaaactctacaggagccttgcaggcagtcctgcaggtacatccacgctgccagctggccccccactcaccctggcccaagctgctgcaacctccgccagctttgcgtggtccacctccctggccttcttgatggcgtcgatgtcggactggaacaccgtgggctggatgcggaaggcgacatcgccgtacatttgccgccagttgatggtgccagtcgtgcactgggcagcctggtgccccatctggaaggtcgaggcggggtgggaggggtagggcagccgtgtacgccaccatgtgagaattggatggatggccctgcatcaagaagccnnnnnnnnnnaggaggggtaggtcagccgtgtgcgccaccatgtgaggattggatggatggccctgcatcaagaagccaaggtcttctgcatgctgccggctcagccgggcgagacacccacacactcatcgctgcagtcacctgcccgcagatgttgcaggctgagggatgccatgagggatccctccgtagcttatggtgaagctccattgggtctacgtactagtcgaaacaccggaagaccaagcgctgcagtctgtcgagggggatagggaagaccgtgctggttcgaaggagagttaacgtgctaaagccgacgagataaggtcacacgcgtagtcgtaggagtgtgagcttgaacgcagctcggtaaggactggtcatgggactccaggtgcaggcgtggtcccgggtgcaatgctcgcgttatagcgcccgatggggcagagggaggctcacgcttcggtgccaggtggtgccctgtnnnnnnnnnnggcgtagtcttaggagtatgagcttgaacacagctcggtatggactggtcatgggactccaggtgcaggcgtgggccagggtgcaatgctcgcgttatagcgcccggaggggcagagggagtctcacgcttcggtgccaggtggtgccctgtgaaataataccgatgtccaagccacactcgggtccctatcgcatcgtgaatgccatgaggatttctctcaaggtcaattatttcaggtgacgccaccattgcggcgcgaaaacacatgtacagggcaatcgcatgtccagcatggatgcggtcagtatgccagggtgctcttcttggcctgcaggaaggcgtccagggtcttgaagaaatcctgggcgatgacaatgtccctgtgccggccctcgcgcgacaggctgtacaccttgaccttccaagccttgactgcaggcatgcaaggggagtgggtgtgaggcgaggggtctcacaagatggagcgatcctccatcgattgaagcggccactggatgacgcgcgtcacgctgagtcagcttgcgacctgcagggacccgtgcccagccccgccnnnnnnnnnnccgattgaagcagccactggatgatgcgcatcacgctgagtcagcttgggacctgcagggacccgtgcccagccccgcctccgcccccacaccctgtccggcctgcaactcaccggcagggtcgatctgctcgtcctggtagtgcaggtacgcccccgccatcctctggaaggtgtccagcaggtcccccgacgaggcccctgggaagggccacttcttgaactgccacgccttgcccgagcagaacaccgcgaccacgcggtcccagtccctgcggtgccgtggttcctggtctgtcacctcgtaggccacgggcttggcacggcccatggtccgcgagatgatgaggcggtcgctcttccgcacgccctcggcctgtcagggtggcgaggttttgcgttttttgtgggcggtgtggttccatgatatgcttgtaagcctgcagaacgtgggannnnnnnnnngttcatgtgggcggtgtggttccacgatatgcttgtaagcctgcagaacgtgggatccctgccaagctggtcgaccatgcgccactgcctggcgccccttcccccccgcccacctctccccccaccatcacctcattccaccctccctctcctcccccccccc

SEQ ID NO: 36434 - DNA, 75 bp, Chlorella protothecoides
cgcggtgaggtgcaaggactggcgggcaggcgagctttggtatcggggaggctgcaggcgagaaacgcttgtgag

SEQ ID NO: 36435 - DNA, 61 bp, Chlorella protothecoides
ccatgggcaccgtggacgcctccatgaagatcgagaggcccgccgccctgcagaccgacac

SEQ ID NO: 36436 - DNA, 1166 bp, Chlorella protothecoides
  modified_base (178)..(295): a, c, t, g, unknown or other
  modified_base (423)..(555): a, c, t, g, unknown or other
  modified_base (705)..(714): a, c, t, g, unknown or other
ccccgctgcccgaccagcgcgcgtcccagacgcagagcaggttgtcgttgccgccggaggccagcgaccggccgtcgtgcgcccagcgcaggccgcacacctcggagcggtgcgcggaaaggcgcacggagaagggcggcggcgcgcgcgggtcgcgcagcaagatgccggcgtcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagccccaggccaggcagcccacgcgcgcggcgtggccctccatgctccggatcctggggttgggggggggggatgcggcgaggatgggggcgcgacaggggctgggggggggggggcccgggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccccaaatccatgaggataaaccctgttgagtatgtgtaagcagcacacaagcacacacacacacacatcgacccacacatgcatgaatagccgcctgggctcacttggtggcttttgccacgtcccagatctggacctggccgtcgnnnnnnnnnncgccccaaatccctgaggataaaccctgttgagtatgtgcaagcagcacacacacgcacacacacactgacccacacatgcataaacagccgcctgggctcacttggtggctttcgccacgtcccagatctggacctggccgtcgtccacgccgaccgccaggtagctgccgcgcccgctccagccgacggaggtgaccatacggtcgggccccaggtcgaccaggagcgtgaccttgctggtgagggcggaccagaggtagacggcggaggccaggcccaccgccagcgtgttggccgagctccagtccaccaggttgaggtagaagtcgtcggacagcccaggcgcgtccagcaccttgaagggcgcgcgcgggatgcggcgcagcggccgcgcgggcgaggccagccccggggtcgccgcggcgaggtcctcgccgcccagcgcgccgc

SEQ ID NO: 36437 - DNA, 61 bp, Chlorella protothecoides
gctgaccgccgacgggcgctgcaagtccctagacgccggcgccgacggctacgtccgcgcc

SEQ ID NO: 36438 - DNA, 73 bp, Chlorella protothecoides
cgtccagctgcctgtaggtggctgatcgcccgatctcactcagcatgtcttgaatcaaacgtatataatctcg

SEQ ID NO: 36439 - DNA, 6612 bp, Chlorella protothecoides
  modified_base (378)..(387): a, c, t, g, unknown or other
  modified_base (810)..(819): a, c, t, g, unknown or other
  modified_base (1020)..(1029): a, c, t, g, unknown or other
  modified_base (1774)..(1871): a, c, t, g, unknown or other
  modified_base (2066)..(2075): a, c, t, g, unknown or other
  modified_base (2145)..(2154): a, c, t, g, unknown or other
  modified_base (2216)..(2309): a, c, t, g, unknown or other
  modified_base (2536)..(2545): a, c, t, g, unknown or other
  modified_base (3031)..(3040): a, c, t, g, unknown or other
  modified_base (3279)..(3288): a, c, t, g, unknown or other
  modified_base (3648)..(3657): a, c, t, g, unknown or other
  modified_base (4526)..(4535): a, c, t, g, unknown or other
  modified_base (4723)..(4732): a, c, t, g, unknown or other
  modified_base (5024)..(5033): a, c, t, g, unknown or other
  modified_base (5574)..(5583): a, c, t, g, unknown or other
  modified_base (6432)..(6441): a, c, t, g, unknown or other
ccgcgccgcagcgcccggcctcgcgcgagtcggccggcgcgcgctccgtcgcgcccggcggctgggacgacggcgacgaggcagccggggcctcgcccccgggcatcccggacaacccctacctcctggacaccctgcgcctggcgggcgggggctcggcctgggggtcctggaggggcgcgcacgacggggtggccacgagcgaggcgggcgggggagggcacgagggcgaggagagggcggcgcgcccgggggacgcggcgtggtggagtgccgtgcccgcccacgaccgctccgataccgtggtcgagcggggggaaggggagggggccgccgcgccgcgcgcgccgccgccctgggccgactcctcgctgcccnnnnnnnnnncaccgtggtcgagcgaggggagagggaggggcccgccgcgccgcgcgcaccgccgccctgggccgactcctcgctgcccaccatgcagctgtggggtgaagggcgaggagcctgagacgggacgggcccggggcgcaagcgccgtccagtccctgcaatccccatggactgaccttgggatggattccttgcacaccgcgccttgctcgtgactctcgccgatccccctggtgtgtatgcccgagccggggagctcgctgaacactttgagaatgaattctgcctgaggttgaagctgggatggtgactggcacgaatgccaaggagaaggcccttgggtcctcttgctagctgctgcgctggccgtgtggctcatacacatccttgtgcgtgcaggaacaccccagcacccgatcatggccnnnnnnnnnncgggtcctcctgctagctgctgcactggccgtgtggctcatacaaatcctcgtgcgggcaggaacaccccagcacccgatcatggccagggaacctgggggtacagccggggtgccaccctttcccaccattgatcgctatgcatgctacccctggtgcccctttgcgttaccatcctgcgtcggctcttccagcggcccnnnnnnnnnntcagggtgccaccctttcccaccattgatcgctgtgcatgctgcccctggtgcccctttgcgtcaccatcctgcgtcggctcttccagcggccccattgcaatgcacgctgactggctgccattcctcatcctgcccacctgcagcctctgtcacgcagagattcactgtcagcattccggcatcatcagttggctcaatccttgatcctaatgtggtcttatcatttaattacgtgcccttgcctgggctgatgcctcgtggacttcacgatggcaccgatgggcatgtgacccaccaatgagtaactctattcagtgcctgaggcgctcctttccacccagtccctctcatggacacataccggcacagccacggaaccagccttcgggtgaagctactgcttgagggagaattttccacaggaagtatggctggtcgatctccccagggatcgccatgttgagaccatgccgggttacctgcatgatcgagactgcctcgacttccaggtacgttcctcttcatgcctaggtgtcgtaaattctggtatgcaggggtcaagacttccgggtacatcatgcactcactacatgattaggtcgagctttcaaccccgacttccactctcacttcactcccaccattgaaggcaccagcaccagctgtatgatcacaagagggcctcgaagcgtcctctcacggtcatgacaccaaccggatcgcacggagggaggcttgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcatgtaacctttgcaacggcggtgtaggggccctcatgcgtctggacacggaggcacactaccgcctggcagcgctgcaatcagaggctggcaggaagctgctggtgcgagtggggcgggcacccgaggacctgagctccatagtcctggtcacacaatcagggtgagccaggggctgcagcctgtgctgcnnnnnnnnnnctcaaccccgacctccactctcacttcactcccaccatcgaaggcaccagcaccagctgtatgatcacannnnnnnnnnccgctcaggattgcaagcggctgcaacagcctcccctccaggggaggagttctgggcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaccgcctggcagcgctgcaatcagagcctggcaggaagctgctggtgcgagtgggccgggcacccgaggacctgacctccatagtcctggtcacacaatccgggtgagccaggggctgccgcctgtgctgccacaagacctggaccttgcccacgtggaaggaggagtaccacctacctggtaccagctcttttggcccgcgctcatgagaagacctcacgcagnnnnnnnnnngaggaggagtaccacctacccagtaccagctctttgggcccgcgctcatgagaagacctcacgcagtatggagatgggcaggcagctcgggcaggggcaccaggtaatggtgacacaccaccttgtacccctccctcttccccaaaacaatgcaggttctggatcaaatcggaggccattcttcgcattgcacagggcctgcctcagccgactgccctggcagccacagccctgaaggccctgcccatcttcatacgtgacaaggcatatgacgccgtggctgggagccggtatgccctgtttggacagccagatgcatgcaggcttgaccatccaggctaccaagacaggttcctgcggaaatgacccaccagcctaaagctattggaattattggctcccagtgttgatgaatcctggtaagggcaccggggttgcacctcgtggagtactacgagcctgagacagccgcacgtggcttcctcnnnnnnnnnnaagcacgggggttgcacctcgtggagtatcatgagcctgagacagccgcacgtggcttcctcgcgcgccatgtcgtctcggaccccagggcgcatcgtgggcgcgatctaaacaccaaaggtggccattgcgtagtatcatcgacaagtggaatcatgtacaaggtctcgtgaagcaccctgctccctgccctcctgaagcgcttctcgtggagctcaaacgcagctacttgcgccctnnnnnnnnnngctctctagcacatacaaaatcctgtaagagcgagaagaagtggctgcagccctcatcatcgcctggccaggtggggtgtgagctgcatctgtcacgaggccagcacagctgaggctgtgcgacgtcgatggacatggaatgtctcacctgaagtgactccttctgcagtaaatataggctcacttgacgtcagaagctcactatcgccggaatgacgagcttgggatctcaaacacccactgacaagcttgcagctggccgtcgtaaggtggggattgggttatgatggagggtaactatctatgaaacaatgcctctggaagctacaatttacttgaacttcccttggcctgcttccnnnnnnnnnncaaggtggggattggattatgaaggagggcaactttctatgaaacaatgcctccggaagctaccatttacttgaacttcccttggcctgcttccccagttggaggagttcaagcggaagaagcaggcagccctggctgccaaggcagcgggtggcggtgtcctggcaatgggtggcggtgccccgcttgctgctcccgccgcatcaccccaaccacccgctggagagccccggccacctgcccctgctcctcaacagactggagtggtcaggtcgcttaccttccagcaccctactgaggcagttcctcctcgccagctgtctgcagacactgctgggctccgccagctagagccagcaccagggccgaccgccgccgcagctgccccgccagcaatggcagcggcggaaagtgtggatgcaccatttgcatctgctggtcctcatgagatcttgcatcccgagaaacagcgcgaacagcaaggccccgcctccacagatttagcaagcacatcagccccgccgccgtcctcccaagctctccctgcccagtcccagacgagccccgcccccacacatcctgacgctcacgaggccgaggccaggatcgcggcgctgcaggccagcaacgccgccctggcgcgccagctggaaagcatggaggctgccatgcgcgaaggtcaggaggccctggagcggcggctgcaggactcggaccgcaacctggacaaggtgctgagggagctggaggccacagatgcggagcgcgcatgcctgcagcgcgagaaggccgacctcgtgggtgagcaaaaggggaaggaggggagatgtgtgctattgatgcgggcttggactgtgttgttgtagctnnnnnnnnnngaaatggggaaggaggggaggtgtgtggttttcgatgcgggcttggactgtgttgttgtagctggttgcggcaatatgaatgtgagggctatattggtgcagagcccgtcggggaatcgccattgcctgtgaatcactcacgagtaccaagtcggtgctgctgccactgccggtgcgcaggcgaggcnnnnnnnnnnactcgccattgcctgtgaatcgctcacgagtaccaagtcggtactgctgccactgccggtgcgcaggcgaggcagtcatgctgcgggcccagacggaggccagcgcggcgctcagggacggcgctgggcggctggaggctgaggttggcaggctgacaggcgagctggaggcgctgcgtgccagcgcggcgcaggggcaggacgctggcgaggaggccaaagccgctgcggctgccgctgtagaagaggccgccgctgcctgtcgcgaggcggaggaggctcggcaggaggnnnnnnnnnncgcgaggaggccgaagccgccgcggccgccgccgtagaagaggccgccgcggcccgtcgcgaggcggaggaggctcggcaggaggcagtcgaggccctggggctggctgatgccgcgagggaccaggccgttgccgcgagggagcaggccgacgagtccgaccaagcgcgggatgcgatagtggcggagcttgtcgcgtcgcgcgaggaggcgacgcagctcagagaccagctgaccggcgcggagggagccctgaccaaactagttgagctgcaagaacagctcgattctctcgagcgcgaggccgaggaggctggagaggcggcgggatccctgcggctggagctggccgccgcgcgctcggcagcggaccgcgagcgagcgtcgggggaggcggcgcggggggattttgctgaggctcgtgccgagctggaggccgcgagggcggctgctgcagagcgcgagaccaagctggagcgcagcctggaggctgcacatgcggaggccgacgccgcgcgcggggccgtggaggccgcacttnnnnnnnnnntgggggaggcggcgcggggggatttcgctgaggctcgggccgagctggaggccgtgagggcggctgctgcagagcgcgagaccgagctggagtgcagcctggaggccgcacaagcggaggccgatgccgcgcgcggggccgtggaggccgcacttgcggaggcggcggcggccgccgagcgcgtagaagacctgcgcatcgctggcgccgacctggcagccgagctggcggaggagcaggcggcggcggaggcgctgcgcgcggcggtggcgaccgccgaggagagggctaagagcgcagaggcggaaggacatgcagcgcagcagcaggtggctgccgcagaggagagggctgcggcggcggagcagagggctgtgagtgctgagcaggcgctctcggccgtagaggagagggctgctgctgcagaggaggcgctgtcggccgtagaggagagggctgctgctgccgaggacagggcagcagctgcagaggaggcgctctcggccgtagaggagagggctgctgctgcagaggacaaggctgtggccgctgaggaggccctcgcggctgcagagcacagggcagcggccgcagaggctgcggcggtggaggctctcggtcagggcgccgcagaggcggaggcgcgccacgcagcagaggtcgccgagctgcgccagcagttggaggtgcagcgtgcacagcatgacgccgagtgcgaagaactggaagaggcgcgccaggccctcgcccgggacctggcggccagcggtgaagagctggagggcctgcactctgagttggaacagtccaagacgcaagccggcgagctggcggggcgcctggccgcgnnnnnnnnnntctcgcccgggacctggcggccagcgttgaagagctggagggcctgcagtctgagttggaacagtccaagacgcaggccggcgagctggcggggcgcctggccgcggcggaggccgccgcggccgccctgcccgcgctggaggcgcggaccggcgagctggaggccgccct

SEQ ID NO: 36440 - DNA, 76 bp, Chlorella protothecoides
cgcagcacatgaccctttgatgtccccccatccccccacacacacgcacacctgctgctcgccctccgacaccgag

SEQ ID NO: 36441 - DNA, 68 bp, Chlorella protothecoides
ggttcaggaggacagaaatggcccagcacagacacgtacatgcatgcatgcatgccattgtggcaagt

SEQ ID NO: 36442 - DNA, 66 bp, Chlorella protothecoides
ccccccccccaacacacacacacacacaccttgtagagcatgctgcgcaggatctcggtggtcatg

SEQ ID NO: 36443 - DNA, 87 bp, Chlorella protothecoides
tatgtcggccggtttccattcgtcactctcaacccccacccaacccaccccccgcttttcctaggtgagtcgcggtccgagggtggg

SEQ ID NO: 36444 - DNA, 83 bp, Chlorella protothecoides
ggccaggatgcttgacactttgaatgagaacctgatgcagctgatgtgtggcagccctgggcgccgccacgccttcccgcccc

SEQ ID NO: 36445 - DNA, 61 bp, Chlorella protothecoides
tctgagggaagctccctggcacattattcccccccctgccagtgctggccttatccaatcc

SEQ ID NO: 36446 - DNA, 3905 bp, Chlorella protothecoides
  modified_base (1662)..(1671): a, c, t, g, unknown or other
  modified_base (2639)..(2648): a, c, t, g, unknown or other
  modified_base (2791)..(2800): a, c, t, g, unknown or other
cgcgccctggtcgcgcacgcgctgctggaggcggccgcgcgcggcacgcgccacgcctacgtgcacgtggccgccagcaacgcggcggcggtgcgcctgtaccgcgcccagtgcggcttctcggacgagcagcgcgagagcgagggctttgcgcgcgcgcggcgccgcccccggcgcctgctcctgcaccgggctttggtcacggagggtgtgtgatggagggacccgccccacgccgtgggcgcggaggatggcctgtccccgagaccacccatccctcgtctggggggcccatgctcctctccgtgcagcaagaaaccgcccttgttgccccacaaaccattccgtccgcttgcactgacgctcttctacacacggcaatacgctctcgtcaaaagggggccgaggcggcctgggcgggcagggccaggcacacagaggagccgagcggcctcgctcccacctcaggaaagggcccgcgccggggcaggtgggcgtcgaggctgtcgcgcgctgctggcgaagcagccgcggtccaaagggcaggggacaggaccgtggggcatttgtgccccccccgcgcggatcggtggccctgctcgtcgaggaagaaagggcgggggggggcggcgccctgcacggcgcaccgcgcccccgtccccccccctcctccccttcaacgccggacggcgcgcttgatgacctggctggagcagtgcacggcgccgtacatggaggtgatggggctgtagtcgatgcactgcacgtcgccgtggaagtggggcgacttgacgatggcgcgcgcggtgtcctggtgcaccgacacgatgcgctcctcgcccagattcaggcagttgcagccgtagaggagctggtgcgcgggcgcgatggggatgatctcgtacccctgctcgcgcatgtagcggctgaactcgacgtcggtgcgctccagggcgtagcgcccgtcggcgccgcgcacgtactcgtccaccaggcggcgcgtgggcgaggcgtcgcccatcatctcctccagcatgatgcagaggttgtcggagaggatggagaacacgcagtccaggtgcatgcggtcctggtgctgctcgaagtcgtcgcgcacgaccgccaggcgccgcgtgcccagcaggtcgccgtccatgagctggcgcgcggcggccaggttggagcgcaggccgatgcccagcagggccaggtcgcggccggcggggaagaagtcgccgccctccaggtagccgggcagctgcacctcgcccaccaccggcacgcccagcttggcgaagcagaagcgcatgaggctgacctccagcgcgcgctggggggagcgcaggctgcccatcaccacgccgcggcaggtggtgatctgctggtcgcgcgtgtacaccaggttggacaggggctggaaggagtaggtcgcggtcaggcctggtgtttggtgcagggggccattgggttgggggggtgggcgggggaggggccacaagagcagggtggccccgggtaacaacgggcatggccgggcggcagcggccatgcaggggaggggaccccacgcgaccagacccggttcaccacgatcacacccatcggtgacatcgcggaccccttcccccctcccacgccaacgccaccgcacccgtgtcgcgnnnnnnnnnntacggtcacacccatcagtgacatcgcggaccccttccccccttccacgccaacgccaccgcacccgtgtcgcggtaggagggcgccaggtgcacggtgggattgatgaggatggtgtcgatcagctgcggcaccgacatgtgctccagcaccttgcgcttgtactcgtccgacaggtagtaccggtccgcctcctcgatgtcctccatcctgccgtccttggccagctggtaggtcagcgcctgcaccgcaaagtcctccaggtccacgcgcgcgccgacgtggtcctcggtgccataggccaggatctcgcgcaccgtcagcacgcgcacccccttctcccgcatcacgttccggaactcggcgtgggcggtctttgccgcctccaggttcacaggcttctcgtacagggaggcgcgggggtggagcccgcccatctgcagggaggtgccctccggctcgcacacgatcacgatctcggcgcggtcattctccgactcctggacaccctgtggatgttggccaagcaaggaggcggtcctcgggcacgcaggcgttcaccaagtggtacggtgcccccggaagccagccactgccgtgcccagctccgcagggcgggcctgctacaccccgcctcccgggtcacgacaccgccatcatggcacgcatgctccacgcaggctaccttcagattgtacttctccttaaggagggcgctggccttggggcggggtcccgaagtgtgggcagccttgacctcgggagcgggcgccacagggaccccgccgttggtcttgctgatgggctgcgttggcgccggggccaccgccagcatgtccttgaaggactgggagagggtcattgaggacggaattttgctggggtttcggaagggtttgggggtagggggatggggctcggtgcgaggctcgcagagacctggatcggtcgttaaatatctgggtttnnnnnnnnnncccccgcccccacggcccccagggcgcttccacagcacatggagacacttgaataccggattttattacatgtgaattagattataggaccatctgcgagagcggcacgccagaatcagggaatggggagtgtgcaatcttgnnnnnnnnnnagggaagggggctcggtgcgaggctcccagatacctggatcggtcgttaaatatctgggtttcgtacgtgaacaatagcagtgactgaaatggcgtttgggcaaggcggcgcggtctcttgagttccgcccagaggacgaggccgcggctgagcgtgggaaggggccgcctccccccccggcagccacatgcaccccgcccccacggccaccagggcgctttcacaacacatggagacacttgaataccagattttattagatataaattagagtataggaccatctgcgagagcggcgcgcccgaatcagggaatggggagtgtgcaatcttgcaaagatggcgacgacaggtttggcgagcatggcatgcgcacggtccggctaccctgaagaatcaaatccagttccgccaccatattacccgcagacgtgtatgagcgttggctgcgccacatgcaacgtattgtctaggtgggttggcatggccactgcagcccaacagtcccagctggggagtgctctcataggctttgcacaaggaccaccagggcacatattgtgcggacggtggcccaaataaacaacagtgaggatcacgttgatgtgctcccagcgcttcactcaccttcttcctggactccatcccacagccctccttcaacacagctgtgatgcgttgccatctctgccatggctgtatcgcctgaacaatctttggtctatgtccctcttgcgtccctctcctcttccttggactcccgtcgatgctgcctgtgccactcaagtttctgctgctcccctgccggtagcgtactgtcgagagacatctacaaaacagggccctgagttgcatccaccccagcttttgcacaagactgcttaacaactagtagccttccactcagacaaggccgcagggagtctacaggattccttggagctgcaccctgttaccctccacttcccaggactttttcgaccacgctgatgtcaaacaagggtcctcctttgacttgtatgtcccaccagtccatgcatggaattcgaatgcagaatctgccagatcaaggggcatcactggcatgcagttgcttgtgtgcagg

SEQ ID NO: 36447 - DNA, 127 bp, Chlorella protothecoides
tcgtcaccttgccatgggcccgtgttgggatggtattcttccgtaacaggctgggcaatagcgaatcatcatttggtgacacactctactccgctcaacatgcatgcacactccaccaaaactacct

SEQ ID NO: 36448 - DNA, 121 bp, Chlorella protothecoides
ggcaaggtctcggcagccctctgcttcgaggatcgcagcatgggagagacccccaggcctcaatctcgggcaccaaacgccccacacaccgaaaacgatgccttccatgcccgtttgcagc

SEQ ID NO: 36449 - DNA, 93 bp, Chlorella protothecoides
tcggcgctcccgggggtgcccgatgggaaagggtgggtggcgctgggtgtgttgcgtgagatttgagggggccatccaccatggtttgccacg

SEQ ID NO: 36450 - DNA, 67 bp, Chlorella protothecoides
accgccatcgcgtcccgcgctgagctgagaacagaccgcgccatgtctggtgccttcttgctagact

SEQ ID NO: 36451 - DNA, 73 bp, Chlorella protothecoides
gtctggataatccatctccagtctgtcggcatcaagtccccaccagccgcggccctgggggcaagcccgcctg

SEQ ID NO: 36452 - DNA, 64 bp, Chlorella protothecoides
aagcttccaaaagggcaggtgctgcgcatgacaatcccctcttcagagctcgacctcagccatc

SEQ ID NO: 36453 - DNA, 66 bp, Chlorella protothecoides
gcacggacgccgtgtactcgatctggggaggggttgtttggagggggggggggggggggggggggg

SEQ ID NO: 36454 - DNA, 67 bp, Chlorella protothecoides
ctcgtcatcgtcatcgccgtcatcatcatcctcgtcctcctcctccgcactgtccccctcgtcctcc

SEQ ID NO: 36455 - DNA, 143 bp, Chlorella protothecoides
gtgaggtgacgcagcctgagctctgggtcccatgtacaggctccgctgagccgtcagcgctgtagtgccacgtctgggcagcccagattcccatgcgtttcctcgcttccctccacctgcccaggcgtccccaccgagcgcct

SEQ ID NO: 36456 - DNA, 450 bp, Chlorella protothecoides
  modified_base (95)..(345): a, c, t, g, unknown or other
agttgcaaccgtgcacgaaggaggcccttctttgtgctccatagacgtgaccctaccacccatgcacctcttgatacatgatcacacacgcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctggggctgaggcgcctccctacgcttcccaggggaccctgtcaagaacatccccaggatcgtgagggacgcgggggccggagccctgatcactgactttgg

SEQ ID NO: 36457 - DNA, 61 bp, Chlorella protothecoides
gcacatcgtgccctctagccccccttgcccacctgccgctcgagggtcaggatccgctcct

SEQ ID NO: 36458 - DNA, 69 bp, Chlorella protothecoides
cctcctttccctgcgtaacgcacacctggccccaaccttccccccccttcctccaatgtatcaacacat

SEQ ID NO: 36459 - DNA, 64 bp, Chlorella protothecoides
tcctggggacgcggcagtgcacctgcatgtgatatgtggagtgtcctttttttggggggggggg

SEQ ID NO: 36460 - DNA, 196 bp, Chlorella protothecoides
agtcgctgcccaccgggacacagccggcgccgcacacacccatgcccctcgcagccacagcccagggcattgcatgtcccccgccacaggccatccagcgtcacaatcgccccacctccgccctcccttcccctcctctccaaaacacactcacacacatattcctgctcaccctggcctggtgcaggtcctccgc

SEQ ID NO: 36461 - DNA, 120 bp, Chlorella protothecoides
tgaagcagccttgcctcgccgtctcacccctcccccccagtcccttatcatcacctcagcgtgcatggtggccagcagcgactgcttgatctgagaccgcactcccgcatccagagacat

SEQ ID NO: 36462 - DNA, 61 bp, Chlorella protothecoides
caggcatgcattaccgccccctaccaaaagagtctgcaggcagaagcagccctcaacccct

SEQ ID NO: 36463 - DNA, 61 bp, Chlorella protothecoides
tgcgtgcccctctagagcctctggcctcttggcctgcatcctgcaccgatgtggtgcgatt

SEQ ID NO: 36464 - DNA, 87 bp, Chlorella protothecoides
gtagcagagcgacgctgagccagggtcgacgggggtgctcgccctgcacacagcattgcacagatggaaccaggtgggggctggctg

SEQ ID NO: 36465 - DNA, 101 bp, Chlorella protothecoides
tgccctatcaggcagacacaatcatggcaatcgcgaagcagaccatgccgttcctcctgagggaagatcccgggcagacgacacgagccacggtccatccc

SEQ ID NO: 36466 - DNA, 78 bp, Chlorella protothecoides
cccgagctcacagcatcctggcgtgggaaacagagggggtggaatgtgcaccttcctggtgcataagcaacttgcgaa

SEQ ID NO: 36467 - DNA, 66 bp, Chlorella protothecoides
cacctggttcttgtctgggcctcatgcaagcagatgtgagagagttcgattgcatctcccatcaaa

SEQ ID NO: 36468 - DNA, 109 bp, Chlorella protothecoides
agggccacggcctcctcctgcttgcctgggtgggaggaaaggggggggcgggaacgtgggatttgtggcgccaatgtcagcgccaaatagccaaggtatggtggcgcgt

SEQ ID NO: 36469 - DNA, 125 bp, Chlorella protothecoides
gcgcctcgggcgggggcccggcggccgactcggcggggtatacccatgctgcggggatccagtctgtgtcggggcggtacaccagctgcacctcgagctcccaggatcccacctgggccgaccac

SEQ ID NO: 36470 - DNA, 61 bp, Chlorella protothecoides
gaagtattttcactctttacgcgaccacctacctgtcgttccgacgcctatatcgaattta

SEQ ID NO: 36471 - DNA, 95 bp, Chlorella protothecoides
ctctggacctactgctcaggccctgctgccaggtgcagaagttcacacagtcgacaacttatgctggcccattccacaccatgatcagacactcc

SEQ ID NO: 36472 - DNA, 66 bp, Chlorella protothecoides
gcctcaaagctggaggccacaaagggcgtgtattcggcatgttcaaagctcctgggcaggcgtgtg

SEQ ID NO: 36473 - DNA, 61 bp, Chlorella protothecoides
ggttagggggaggggggttagggggaggggcgtggcgaccaactgatttgcatagaggagt

SEQ ID NO: 36474 - DNA, 89 bp, Chlorella protothecoides
tgtaggagtggctcaggaacagagaaagaccggttaacagagggggcgcaccatgtcaccgcttctccacgaccagcacgcccatcatg

SEQ ID NO: 36475 - DNA, 118 bp, Chlorella protothecoides
gcaccgcctgggcctgggcaaggacgacgtgctcctgcccgacaacgtgtcagagctgagcctggacgacaaattgagcctgatctcgggcggcacctccacctccggcaaggagagc

SEQ ID NO: 36476 - DNA, 61 bp, Chlorella protothecoides
cggtgaggctgggtgcggcgtcgtgggtggtccccccagctgggcggcccctggtcgcccc

SEQ ID NO: 36477 - DNA, 61 bp, Chlorella protothecoides
aagcaatcaaggggaggagaggtaaggtttacagattcattgtccatctgtttaggcactt

SEQ ID NO: 36478 - DNA, 65 bp, Chlorella protothecoides
gtcagagggggatgaatcgtgtgcaagtgtgtgtgtgtgtgtgtgtggaggtaggcaatgaggac

SEQ ID NO: 36479 - DNA, 61 bp, Chlorella protothecoides
aaattttgccgcgcaaactttccctgtgataccctgccacacgagcagcattccgacacaa

SEQ ID NO: 36480 - DNA, 133 bp, Chlorella protothecoides
gtcaggcgggtgcggggggcggtcgaggatggccacccgggaaacgctgcgcgagatggggtgcaatgcccggaggggcaaacacggggggaatgagaggggggatgctcccctgcgattcactcggacgtcc

SEQ ID NO: 36481 - DNA, 86 bp, Chlorella protothecoides
tcaggccccgcacagcagcctgcaggtgtgacggccagggcacgcaggattatcgaattgtatttggacggcagatatcaatgcct

SEQ ID NO: 36482 - DNA, 62 bp, Chlorella protothecoides
ctgctcccaaacccaccccaccttgcactgccggccttccctctctgcaggccgaggattgg

SEQ ID NO: 36483 - DNA, 95 bp, Chlorella protothecoides
gcgcgctgcgcgcgccgcgccgcccgcgccgcgcgcgcctgcaggccctgctggatgtcgcgcgcggcatgctggcgctggaggcggcggacccg

SEQ ID NO: 36484 - DNA, 62 bp, Chlorella protothecoides
gcaccggatccatatgcatgcgaggctcaggcagtgtgcgtcgtgtcgcgaactcagccgtg

SEQ ID NO: 36485 - DNA, 79 bp, Chlorella protothecoides
cagcacctcgcaggagaccaccagggcatcacggtgcgcggggcccgccgtggcgtccagcagcgagcccaggcgcggg

SEQ ID NO: 36486 - DNA, 129 bp, Chlorella protothecoides
ctgggtcatgcgcagtgtgggccgctggctcgcatgcatgggcatccactgatcctcgctccccacacccactgcagtgcggtttgggaagtacaccggcctccgcacgcaggacaaacgtgtgcagat

SEQ ID NO: 36487 - DNA, 411 bp, Chlorella protothecoides
  modified_base (113)..(299): a, c, t, g, unknown or other
aacccctttgtgcgcgagcgaagcggacgctgcacgacagacagcggactccttcaattattgtcccacgagtttttcaggcaagagatctggcttatgcgggatgtcttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatgctcagaatttctcctgggaggtgctggcatgcaggacagcaactgtgaaggcctgtcgagtcgctcccacgcggccaaaaggcccatccgcttccgagttccgtgt

SEQ ID NO: 36488 - DNA, 105 bp, Chlorella protothecoides
ggccaagatcaatgcatgccgtgcaggccaggggggccaacgccccgtcagaagagccagccccccactctgaccctgctcacctcccagcgagtagtcgtcgac

SEQ ID NO: 36489 - DNA, 162 bp, Chlorella protothecoides
caacgacgcgctgcacatcttcctggagttcgtccctggtggcagcattgcctccctcctcgccaaattcggtgaggggggtggtggagggggttggcgagcatgctattagggggatgggctgggccagagtggcaggcgagggccgggaattgggcgatg

SEQ ID NO: 36490 - DNA, 61 bp, Chlorella protothecoides
ctcaggaagctcacagagacgtttacacattggagccatcaccgagcccctttccctgcct

SEQ ID NO: 36491 - DNA, 121 bp, Chlorella protothecoides
tggctccaagaggttctgccacaacctgcgtcaggacaacgagaaatgctccctggacaagctgaggacggcggacacggtggagctgaacaccgaccccaaccccccggcgcccccggca

SEQ ID NO: 36492 - DNA, 11280 bp, Chlorella protothecoides
  modified_base (120)..(129): a, c, t, g, unknown or other
  modified_base (1300)..(1309): a, c, t, g, unknown or other
  modified_base (1665)..(1674): a, c, t, g, unknown or other
  modified_base (2117)..(2126): a, c, t, g, unknown or other
  modified_base (3592)..(3601): a, c, t, g, unknown or other
  modified_base (3868)..(3877): a, c, t, g, unknown or other
  modified_base (4345)..(4354): a, c, t, g, unknown or other
  modified_base (4455)..(4464): a, c, t, g, unknown or other
  modified_base (5087)..(5096): a, c, t, g, unknown or other
  modified_base (5293)..(5302): a, c, t, g, unknown or other
  modified_base (5400)..(5409): a, c, t, g, unknown or other
  modified_base (5890)..(5899): a, c, t, g, unknown or other
  modified_base (6089)..(6177): a, c, t, g, unknown or other
  modified_base (6938)..(6947): a, c, t, g, unknown or other
  modified_base (8076)..(8164): a, c, t, g, unknown or other
  modified_base (8577)..(8586): a, c, t, g, unknown or other
  modified_base (9165)..(9174): a, c, t, g, unknown or other
gcggccgcggcggcggccacgtcgctgcccccgccggcgcccacagccggtgtgcccgtcagcacgcctcccgtggcagtggccgcgacggcacactgagaccacccacgcttgagcttnnnnnnnnnnccgcccccgccggcgcccaccgccggcgtgcctgtcagcacgcctcccgtggcggtggccgcggtggcacactgagaccacccacgcttgagcttgaatgtcgcccgatactgatgcgcgggtgatgcatgacgccctacccctgcctgtaatgtatatgctgctgtcgtactggttgtggagcatgccgaggtgctctcaccctcgtcagccatgtcgtaggcgaagggtgggctgggacgactgcatgcatggctcaaggatgggtgcaggggcgtgagctgcggccgtgcgggacatgaccaccgaaaccctcgatccagtcaagaacttggtgatcgaaatccctgattcatcatcgattcttggagatcgtgaacgctgtctcccaggatcgctcgggatcgtgggagctttggtccatcggggccatggcctcggcacggagtcctcgggacgacgagcttgccgacgacctgctggagtacatcaatgacagcgacacccaattccatgccgtcgagcaagcaaaggccaggctggatgccgcagggtacatgcgcctcagcgagaggcaaagctgggacggtctgagtcctggtgggaggtattatttcactcgcaacgactccacgctcgtggcctttgcggtgggagcccggtacgagccgggcaacggcttctacatcctaggggcccacactgacaggtgggctggcgtcagaggagcagcttgaggaggttgagagggattgcagttgtggtgggaggaccaagcacagagcgctggtgacttgcaccctacaccttccctcccccacacatgcaaacgctttcgcctgctgcagcccctgcttcaagctgaagccggtgtccaagtgcaccaagagcggctatgccatggtgaatgtggagccgtatggcggcctgctccagcacacctggttcgaccgggacctctcagtggcgggccgcgtgctgatcaggacagaggaggggtccatgcagcataagctcgtgaggcgggcttgtaacttgggatttcgctctcagtcccccatcagtgccagccggggattcgcgtccccagcactcgacgccggcatgccccagcccaagggctgccgagcggctctacactgactgagttgaagcctcgaatacctctggnnnnnnnnnntggccccagcactcgacgccggcatgccccagcacaagggctgccgagcgactctacagtgactgagttgaagcctcgaatacctctgggtccctgcaggtgaaagtgcccaagcccatactccgcatccccatgctggccatccacctccaacgggatatcaactccacaggcttcaaccccaacaagcagacagagtgcacgccactcctggccctccaggtgagcagggatctgtgtgaggagcaggaaggggcgagcagccgactgtggtggagacaggtgcctggggcaaccgcatgacgcagcactcaacggcgcctgcctgacggtgagtacccacgtgcccccccccnnnnnnnnnnggggtgcctggggcaaccgcatgacgcaggactcaacgtcgcctgcctgacagtgagtacccacttgccccccccctctggccatgccaggctgccctgcaagacagcgagggccccgcagtgtcagagggtcggcaccacccctggctgctccacatcctagccaaggagctgggtgtgaggccagaagacatcgtcgactttgacctcaacgtgatcgacacgcaggctggcgtgatcgggggtgcgtcgggcggcagtgggatgtgggtttgttcatgctggctgtggtcgtgggatctcgcagcactctgggaggtgcaactcgagaaaggtgtaactggctagaaatgcagtgtgggcgcgtttcatacccattcctggagcctcctcagcccccgaattccagcgccccttacttcgctcccgccatcccacccacnnnnnnnnnncgggaggcgcaactcgagaaaggtgtaactggctagaactgcagtgtgggcgcgtttcataaacattcctggagcctcctcagcccctgaactctagcgtcccttacttcgctcccgccatcccacccacgccgtgcctctgtgccccaggcgcggagggtgcgtttgtgttcgtgggccggctcgacaacctgtgcagctcgtacctgggcctgcgggcgctgctggacagcgacgtcagcctggcgagcgaggcgggggtccgagtgctggcgctgtttgacaacgaggaggtggggtcggcctcggcccagggtgccgcgggcccggtgctgcaggacaccatcgcacgcgtggcggcggtgctgggtgggggcgcggagggggcggtgcagcgcgccctgcaggcctccttcctcctctcggcgggtgcggcgcttggggcatgcatgcgggaggggaggtgtagggtggagcagttcatcatggctggaggggactgagccagcaagggtatcttggaatgtcttggtgtgggggaaagaacttgagagcggggcaggcaagggtttttgctcggttgcaggccctgtcccaccaatcgggattcgtaagccaagctcctgcaggtctgacggcattgtcagcctttggtcacgttcaacttcccatttccccaaagcacctcctttcttcaacccctcccccccaagacatggcgcatgcgctgcacccaaactacccagaccggcacgacgcagcgcacgcgccgcgcctgggcgatggcattgtcctgaagcacaacgccaaccagcgctatgcgaccaccgccgtgtcggccaccctcttcaggtgggaccgggggtgcggagggcttgatcgctttgaaccatccttggggagggcagcgtcgcagtgcataggccaggagaggggtcagggctggtggagtcccatgaagcatggttgtgactgggctagggtgtgctgtggtgctggaggtcccccacatccagtcccccttcccacaatcaccaactctgcacagggaggtttgccgccaggccggcgtgccgacggccgactttgctgtgaggagcgacatggggtgcgggtccaccatcggccccatcctggcctcggggctgggactcaggacggtggacgtgggcctgccccagctgtccatgcactccatccgggaggtgggtttggacggagtctgggcaagcatgggaggcgagggggtggagtggtgcctggcctagaggcaatggctggtgtggggactgtggaaactactcctctctctgtgccatcgcgtcggacctggcatcggacccccatgcccgcgtccgaccatctcggcgcgctcagatacctcgccgcccctcctttcctggcgccgcagatgtgcgccgtcgccgatgtgggccacggctacagggctttcctcgctttctacnnnnnnnnnngtactcctctctgtgtgccgttgcgccggacctgcatcggccccccatgcccgtgtccgaccatctctgcgcgctcagatacctcgccgccccttcttcctggcgccacagatgtgcgccgtcgccgacgtgggacacggctacagggctttcctcgctttctaccagaccgtcagtgccctggacgccgcactcgagggtgccgacgcaggcctggcctgatgacaactgcctgtactccaatccatgggccagtggcctgggttnnnnnnnnnncgccctggacgccgcactcgagggtgccaacgcaggcccggcctgattaccactgcctgcactccaatccatgggccagtggcctgggttctgacaagcgtgcacacatgtgagaccggccagccgaggccggctgggacacaggggagttgagctgggaggaggggggttttggcgaggcccgcccaggggcagcagtggtcctgggtcaggcccggggcaggggcccagccggcttcagcaggtgccggtactgatccacgtggtcgaggatcagcaggcgcggcccgggcggcacgcgcacctccgccagggagctgcgtggcacgaagaaagagggaatggagagtggatgagagcgatcgccacccgagactccagccggcacacctcggccacgtcgccccgcctggcagcccggatggacaggagccctatcgcatacctggagtcccagaggccgatggnnnnnnnnnnagggagttgagctgggaggagggggtttggacgaggcccgcccaaggggcagcagtgatcctgggtcagccccggggcaggggcccagccggcttcagcannnnnnnnnnggggaatggagagtggatgagaacaattgccacctgagactctagccagcacacctcggccacgttgccccgcctggcagcccggatggacaggaaccctgtcgcatacctggagtcccagaggccgatggtcctgtcctccagcagccccttcttgaagttccgctcgtacttctgtggaggcgtgagcggggacactggggctgaggagccggcctgggcgccgcgccatgtgcagcctccccctccgagccctgggtggccgagccatctggccagccccctcaccgacatgcccagcgtgtcgagcatcgccttgaccttcacatagtcgtcatcgacggcgcgggagcatcccgcaaatcgctcacccagctgcgcacatgggaaggaggagagcatgtgggtacagcgcaagcacgcaccggccgggccgacttggccagagcccctccaagggcttgggcagcagaatctggtgcccaaaatcccacactgctgtcatcacgccatcttcggcatctcctcaacctccagcaggcatcagacccgccacggtaccttgtaaaatgccccctggaacagggcgaacaccacgcctgcagagaacgccgccatcagtnnnnnnnnnnccagacccgccacggtaccttgtaaaacgccccctggaacagggcaaaaaccacgcctgcagagaacgccgccatcagtgggttggccgtgccactccctggttgagcgccgggcttgcccatgccgctcacaagggagaagcacaccccagatccaaaggcggagacgagcctgggaggggtgggagcaagggggnnnnnnnnnnagcgggccgacttggccagagcccccccagggcttgggcagcagaatctggtgcccaacctcccaccctgctgtcatcacgccatcttcggcatctcnnnnnnnnnntaggcgagggttagggctgtacgcacgccatgcatacataggaaacatggcatggccggacccgcagccccgaccatcgtgctaggtgaggtctgctggcatgacaaagacagcacgcgaccctgccccctccatgcacacaccttgccctcagcatgcaactcacgcgttctgaacgtcctccacccccctgacacgccgcatgagcgtgctgatgccggcgttgaccccggtcatcacggcaaaattcctggcttgctggaatggggtcccaaggctcatgagctgagcggggttgccggctgcaagggatgtgcattgaacgggggttgtggtgacacgcttggtgcaggaaccagggcaaatagttagtaaccccgcttttaacaaggcaccatcagtctgtcagtacaggctgctgacgctgccccccatgtaatgcccccacctagccccacctgcccctggcgctgaggccgtnnnnnnnnnncgctgacgctgtcccctgtgtattgcccccacccagccccacctgcccctggcgccgaggccgtcatctgagacatgctgcccatcagcgctccaagcaaggatccctgcgcacgagacaaggacatcatggtggctatgaagcaaaactgggcgccattcaagtatcatttggcaggtgtttccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggccgacacgacatccacccagatcgcttgcgttgccgtccaggcatcaaagtgtgccttgatgaatgcgggcgtgcccaggcccagcttgtgacccttcaagaaggccagtggcccggtctcgggcagctgaagcaccgacatctgcggagagggccgactcctccacaactcgataccgaagaatacacgcggaagtgatgcgatggaaaaggagtgcacctgatcgcccctgttccaaaatgcatgcaggcaggtgcctcgcgtggcctggggatagcttggccgggcgcgcgcggcagggtcccgatctccgctgattcggaggggggtttgacccaccctggccggccaaacggaccaccagatgttgaggtggcatgcttgatccaaagatggcacctgtcggttctcgagcctcgtgcaggaagccgacgcattttgcgaaaataatcttgactgctgcctgcgttgaagagtcagtcaagcacggctggcatggctgcacctgtcctttaccacccttgacccccactccctcttccatgactcagtggtgcttcacatccgcgactccatcactttgtgtacaggaaggctgcccctgtcgccaggaacgcggccatcaggctgaagatgctgccatagtatgggtacgcctgggcgggtatgttgtgggaagagggttgtcgcttttgctgtgtgccttgccgacatgcttcaccccgccaggcttgcaggaacgcgcgctggcaacnnnnnnnnnntcatgacgcagtggtgcttcacatccacgcctccatcactttgtgtacaggaaggccgcccctgtcgccaggaacgctgccataaggctgaagatgctgccatagtatgggtacgcctgggcgggtatgttgttgtgggaagagggttgtcgcttctgctgtgtgccttgccgacatgcttcaccctgccaggcttgcaggaacgcgcgctggcaaccctggcagcctcgtcgtcccagccctccaccaggactccgagggtccagttggctcaccccagtgcgatgagtggagggtttgcactgtgcccccttcaggcacgctcactctccatccacctccctctccggaggaaagctcccgttcccatcccccaacagaaactggaaacgaatcaccgttccccacctggaagatgaagcgttcgtactcgttgtgggcgaagggccggatgggcaccgtccggctcagctccagccccgtcagcccccgacgccggtagctgagcacccacttgaagacgccgtaggcgtcgggtgcggtcacgcgcgcggagaaggtgccggcgccgtcgtgcgtcagcgtggcgcgcacgtgggggtccagcatggtcagctccacctgcacgtcctccgcggcgtagggcgccacctcgccgtcggtcaagcggtcgatgcgcaccgagaactccacctcgtccttcacgcggtagcgctcgggctccacctcgccccccaccacgcggtggctgacggagcgcacgatcagcacgccacgctgactcagcgcccagcgcgccagggcgtccaccgccgcctcgttggcgctggagcccaggctgtgtgggatcgtgagggagggggtgtggggggagctgaggatcgaggcgcaggtcgtgcaccggccatggcgattgaagcgcgagggtcagcgaagggagacacacttggatggaggctggccagacctctgggcaaatccagccggcgcttgctcgacgcgcacctcttcccctctgggctggtggcctgcgcgctgaagaaggcgtcggagagcaagtccagggaggccgtcaccgcggcgcgggcgttgttgcgggcctggccgcgggaaggagggtgagctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcactccgggcatgcaccacgtcacgagcctgcctctcggcgcctccaccaacttctccacacattttctcttcccctgtcgccatgaggtccccactcgaccaccagaatgccccccacctggatgagggccacgagaccgaccccccgcccggccaggcgggcgacggtcacggccttccccggctcgccgccgtaggcagtgggtcccgcattcagggccacaaaggccgtgctgctctccggggagacggagaggccggcgccggagaacaggacggggccctggagatttgggggttggggttcagcaccggggtctaggtttggcgcacaggtttgcctggcggccggcatgcagactcagggcaggctggattaaagagacatgggaggaggccctctgtcccgnnnnnnnnnngtctaggtttggcgcacaggtttgccttgtggccgggcatgcagactcagggctggctagattgaagagacatgggaggaggccctctgtcccgccgaccacaaacatacaggcaaggcagcactgtcgagcgtcaaccctcatccccttcaaattctcacgtggatgccggcggggaaaacgtggcggttcaggcccacgctgacgtcagcgtgcacaacgtcgtgtgccgtcgcggccagggcgccgtcgtacgcagagtggtccagcacgcgcgcctcggccgcgtccacgtccacccccagctccgaggccagctcccgcagctccgggcctgccgccgggtccagggccaggatcacgtcgtgcccagcgtcgaagaactggaggaccagggcgacgtccagcgccccacccaggcctgcgggggtggcagggcgggggtggtgcgggtcaagggcatgcacatgcagattgttgatgggtggggaatccatgcccccagacacggtgggccaatggacccaccgaacccccggaccccctcactcctcacccttcctgccccctaggatgacnnnnnnnnnngggtgggtggggaatccatgcccccagacaaggtgggccaaaggacctaccgaacccccggaccccctccctcctcacccttcctgccccctaggatgaccagcttgtcgtagatccagtctccccatcggaccaggcgcaggctggcggcatcgataggctgcacgtccaggtcgtggccctgcgcgcgcagaccccccaggaaacgggagtgcgtctcggccaagctcggctcgtccatcaggaccagcaccctgctctgggaggccgaggtcgcgagcacgcagcatgccaacagcattagaggcatgatcagtggcctagccatcgccctcgggcgcctggggcgcagacgagtaccctgccggcacctgattacggccgtgtctgatcagcccgcaccggcgagcgggcacccgaatttattgggaaagccttttgtgaaatgagatcctgcaactgagtgtgcgatgcgctggggcgtcgggatggagatggcccagtacgccccctgggaccgcgcgcccgccgctgctgatgcttcaaacaatcgtcgtcgtggcctgtcgctccctcacaccctcccctctcctctgctaccccgtcaactcgtgccaacaagaagttgcactcgcatcaggccatgccccccaggaggtggtacgcccacaagtaacaaacaagaagatgtattcgtgcggccccggcttccctcaggcggccttctggatgaccacggcgttggccagccccgcttgctcgatgctcacgccgtcgtcctccagcctggccgccgggaaggcggtggccagctgcaggctgggccccaggtccggccgggccgtgcgcaggaagcgcttgatgtcgcccacggtgtgggtcaggttgaacttggccaccagccgcccgccgtcgctcaggcgcagctggatggaggtcgtgggcgcgctagcgtcggggccctcccaagcccccccgcccggcgcgggctggctgggcgcgggcgcagcggcggcgacgggggcggggtcgggggcggtctcgccccccagccggttggcctggccggtgaaggctcgaccctgggtcgcttccgcctccacccagtcctcgtccttcctcagcaggttgacgttcacctggggtggtggggtgtgcagcacaggtgcaatgaatggcgtgggcacagtgggctgcgcgcgcaggggtggcccagggtgccccaggcttggcacggcggcggcctcagggtccgccccctgacgcttcctggatgctgcgatgggagatcgtggtgctgcacggccaccaagcgcgctggtcctcccccaagatcctcatacgcccaaagcgctccccaccaaccccagcccttcatcctctgcccgacctagccacactcacaggctgactaggatcagcaggctccagctcagcggggcattgaccccgcatgatggcctgcatgaagtcggcgttggccgggtcggccatggcccggccctcccctgaaggcaggcacggtgggggagagggtgtgctgtgagggaggagttcccttggcttctaaagcgccagcaggtcctttcctgggcaggcacaccgacggggcatgcccggaccatgggggcggaagaaaggaaggcggccaagggtcagccctccctcgtgacctgggctgccgggacaggaccacccctgccggggtgctgcaacacccccagctgcgccagtaccccaagaatcctctcagccttctccccctctacccaccgtcatccactcggaagtagccgttgcggtaaaagtagatggccaccgtcctcacggccagggcccctccctgcgaggtgctgggcccagcgaccccgccggccagcgtgcgccccaggccggcgaagcgggggcggccctggaccgcgggcatgtcgctggcggtgccctggcgcgcgcccgcggctcgcgcggcctcgaaaaccccttccacgtcgtccacgtccccggcgccgggcttcggcgcccctcgaaccacctggccactgtgggtgtggcagaggtgggaaggggtttaaaggaggggggggggggggggcggggggggggggg

SEQ ID NO: 36493 - DNA, 77 bp, Chlorella protothecoides
gaggacaagggcacggccgccggcgggtcgagcccagctgccggcagcgcccagccagctccggggagcataaggtg

SEQ ID NO: 36494 - DNA, 90 bp, Chlorella protothecoides
aatctggcccatgctgcagggctgtctcaatgggagcttgctgctgctcagtactctccgactcccaatcataatgctcctccttcctgg

SEQ ID NO: 36495 - DNA, 111 bp, Chlorella protothecoides
ttctgcagcatgcttccagcggcctgccagacccacctgccacgcctgttgttggctttcccctctgcccctgatgtgccctgaccctgttcagaacgagagccgtcatcg

SEQ ID NO: 36496 - DNA, 134 bp, Chlorella protothecoides
acagcccccttcaggagctgaagctgcacaagacgggtgcgggtcgggaacactgcacctcccatccgctacatcgcagctcgggttgttccgctgattgggaaatcggtgaatgatgcttgcctgagcctggt

SEQ ID NO: 36497 - DNA, 61 bp, Chlorella protothecoides
ccgcctcgggcgaggcagggcgtgtgtggtttgagcccgacctgggcaaccccgccttcat

SEQ ID NO: 36498 - DNA, 72 bp, Chlorella protothecoides
tggtagggaacccagaacgctccatcacaccctagtatcccgcattacagtcgcacatgctgtggtcaaccg

SEQ ID NO: 36499 - DNA, 126 bp, Chlorella protothecoides
tgctcgccgagaggcggcttcctgcacaggcccatgcttggcatgcagtggcaagcacggggcaggaggaatggctgctggctgtcctcgcgggcgccccgtctcatgctgcattgggaacaagtc

SEQ ID NO: 36500 - DNA, 61 bp, Chlorella protothecoides
agcggttgagctcgcgcttgaggctggagggggtgtcgcggtggccctgcaggaagtactg

SEQ ID NO: 36501 - DNA, 77 bp, Chlorella protothecoides
ccatgtcacctttggtgaaggcgccggggtaaaaaaacagctcgggtccccgccatctctcctcccccaactggatg

SEQ ID NO: 36502 - DNA, 107 bp, Chlorella protothecoides
ccccgcgtggctgatgattatatctacttgtatttgctactcttgagtgtctcaatgacgatacctattccaccaagatcgctgaagccacgcgatggtgacttgtg

SEQ ID NO: 36503 - DNA, 92 bp, Chlorella protothecoides
gcgcagcttcacgcagtgcttgactgcagggaccgtggggtgtggaccaatcttgcatgggtcacgagcctcacatcaagtggtcactggaa

SEQ ID NO: 36504 - DNA, 154 bp, Chlorella protothecoides
tacctgcaccttgagatctccagtccgcagccgccagcagcccgctcctcaacccactcgaaaacttccatccgatggccccctccgattaaccagccaccaaaccccttcccgccttccctggaccccaggtcctgtcccgcctgtccttcat

SEQ ID NO: 36505 - DNA, 118 bp, Chlorella protothecoides
aatgttggactgctgtgatcacgactctatgtggagcgacggcacccacttgagttctcctcctctatccaggatgctgaggcttttttgtggaaggatcttgaacacctctttgacg

SEQ ID NO: 36506 - DNA, 139 bp, Chlorella protothecoides
gtgggtgggtggggagcagattggggagggagccgtcggggaggcatggcctgcatgagtgctctgagcgcggcccttcccgacctgacagcagtcgcattcacagtaggacggccagcctcatccctgcgcagacagg

SEQ ID NO: 36507 - DNA, 74 bp, Chlorella protothecoides
ccagcggccaagaggcgagcgagtggtggctactttgcgggacggggtttccccacattctctgttgagcacgt

SEQ ID NO: 36508 - DNA, 62 bp, Chlorella protothecoides
gcccgtgcattcagtgccgacctcgcccaatcccccatgcggcgagggtcccgagactcgcc

SEQ ID NO: 36509 - DNA, 140 bp, Chlorella protothecoides
agggaggcaccaccagctcagagggtcacacacacttgaggagcagaggcaatatctggttagccctgagttggccacactgaaatgcccttcttacggcgtggatccaaataggacggaacacaggcacagtgtcagca

SEQ ID NO: 36510 - DNA, 537 bp, Chlorella protothecoides
  modified_base (188)..(197): a, c, t, g, unknown or other
  modified_base (276)..(329): a, c, t, g, unknown or other
ctagcctccgctgcgggatgggaaggacatcgtgtgggtcagaggcacgatcgtatggtcacgcggcaggtatcagtttcgcccatcaacctccccccactcatcctcgactcggtttctaggcagattcaaagttgctctttcaatgttgctcctccgatgttgctcctcgttgagtttgtactggnnnnnnnnnncctccgatgtttgtactgggagtaggcaggggtgcgttaggaagggtgtggcaacagactagcaaccttgcgagcaggnnnnnnnnnnnnnnnnnnnnnnnnnnnnnnnnnnnnnnnnnnnnnnnnnnnnnnggggggtggacagtgctgacccgtcatgagccaacatacatcgcagaccatagctcgctgccacaccaacacgggcgactcacccgttcattatgttccgctgcggccaattttggagagggtacggaagcaggatgacaccatcgtcgatcatcgactgcaaggtgacgagatcagcaggaatcgacccgtcacgagcgaccagatc

SEQ ID NO: 36511 - DNA, 61 bp, Chlorella protothecoides
ccgccgccccatgccgcgcatgtggtccagtccctcgtcccagcgcccgcagtcctccagc

SEQ ID NO: 36512 - DNA, 74 bp, Chlorella protothecoides
ccctcgtcccagcgcccgcagtcctccagcaggacatcgaggtaggtggtgtcgtcacccgccgcacgcgccac

SEQ ID NO: 36513 - DNA, 61 bp, Chlorella protothecoides
aagaggctagggtgagggctcacgtatgctttgtgggtggtgggaggggttgcgcatgcag

SEQ ID NO: 36514 - DNA, 72 bp, Chlorella protothecoides
acagcgcccagctgttcccccccttcccactcacctcccccaacctcttgcagactgtctgcatgtgaacga

SEQ ID NO: 36515 - DNA, 61 bp, Chlorella protothecoides
gtgtgacgactacctccccggcatctgccgcaggggggtccgacatatgttcgacagcgct

SEQ ID NO: 36516 - DNA, 61 bp, Chlorella protothecoides
tccatgttcatgaaccaggaatattcaaaaaccaagcccagccactgagggaacagtggaa

SEQ ID NO: 36517 - DNA, 78 bp, Chlorella protothecoides
ggccctgtccccacccagtgtgggtctcgctcgggtagcaagcaggcagatacaagcacgaccacgccaaaagccccc

SEQ ID NO: 36518 - DNA, 164 bp, Chlorella protothecoides
gacgaggcagatgagcaaggggacagggtccagccagaccgcagagcgacccgccacccgtcgcccacaatgatgtgtcgccaacccgccaaggctcagtcgccggccctgcaccggttcccacccagactccggccggatctgttcaacctcgcaccctgcgg

SEQ ID NO: 36519 - DNA, 91 bp, Chlorella protothecoides
tgaggagaggccggtggggcaggcatcctcctacaagaatagcagcgtgacgatccaggagctggaggcgacggcgccgccaacacccgac

SEQ ID NO: 36520 - DNA, 61 bp, Chlorella protothecoides
tgctgcctggcttgaccgctcttttctcccgctcacacccctccaccaactccactacaag

SEQ ID NO: 36521 - DNA, 92 bp, Chlorella protothecoides
acagtcttcgatccactgccggacagggatcaatcggggttggggttgagctgcgggggggggtggcggcgagcagggggcccaggagtgag

SEQ ID NO: 36522 - DNA, 238 bp, Chlorella protothecoides
ccgaaacctgactggcatgtgaacattctgcgtaccgtgtgatgtgagagggaactgggggggtgggatgatggagcagaaagaaaggggacctctcactgtggattcctgcatgggaggcagaaggcagcagaggagatgcccagtcgaggcacgagcaggaagaggaggggcggcgagattgctagcctagcagggagcagcactgtgccgggccaggccggcctgattgcgtggc

SEQ ID NO: 36523 - DNA, 61 bp, Chlorella protothecoides
ctcccgctctgctgccccgagccgcacccttccttcgagctgtaaccgctgcacttgcatt

SEQ ID NO: 36524 - DNA, 69 bp, Chlorella protothecoides
ggctccaccccacccgcgcacgacacccccaccccaagtcacctggtccgggattgtggtgctgaaccc

SEQ ID NO: 36525 - DNA, 12511 bp, Chlorella protothecoides
  modified_base (242)..(251): a, c, t, g, unknown or other
  modified_base (802)..(811): a, c, t, g, unknown or other
  modified_base (1395)..(1404): a, c, t, g, unknown or other
  modified_base (4146)..(4155): a, c, t, g, unknown or other
  modified_base (4518)..(4527): a, c, t, g, unknown or other
  modified_base (4624)..(4633): a, c, t, g, unknown or other
  modified_base (8478)..(8487): a, c, t, g, unknown or other
  modified_base (9122)..(9131): a, c, t, g, unknown or other
  modified_base (11305)..(11314): a, c, t, g, unknown or other
cgccagccgggcctccagcgcctcgcgcgccgcggtcgcggcacgcagctcgcgctctgcggccacgcgctccgcggccatgcgctgcacatccgcggggcgcaccgtctgcaccgccagccgcgcgcgcagcgaggcgcactcgcgctctacgccctccagctccgaggcctgggccgccacgtcgctgcgccgttctgccaccttgcgctccagggaggccttgtgggactgcgcgtgtnnnnnnnnnncacgccctccagctccgaggcctgggctgccacgtcgctgcgccgctccgccaccttgcgatccagggaggccttgtgggactgcgcgtgtgagggcgggttggtgagtgtacatgcaagtgggaggggtgccaggggagtcgagtggcatggcagagacattgagaccgccgtgctcagggaagggaacggtatcggcatgagcggcattgcggtgagaaccagggactgcaagaatagggcaccccatcgatgtgcagggagtggggaggcatgctccagtggagggcaggcaacacaccgccccaggcagcaatctcaagcccgggtcgtgcctccagggaggcgatgagcttcaggaacttctctttgtccgcctgtgtctcctccaggcgagccctggccgcaaccaggggggacgggctgtcccgtgcagtggcaatctcctgctccagagactcgttggcctgaggaggggggtgggggatgaaaagagatggaatgcaggttggatgagagcagcagtagggcaggtgacaggagggatgacnnnnnnnnnnaggggagatgtgaaaggagatggaatgcaggttggatgagaatagcagtagggcaggtgacaggagggatgacagtgcttcagcatgccgggggcgctggtgcacagcatgtgtcccgacaccccctcactcagaaggcgctcaccgccaccaccctgcacacaactgtgagctccctcgacacccccacaccatacactcggcacgcaccgccaggagccgctgcgtggccgaagtgatctccccggcccgctcatcaaactcggcggccttggaggcatccaccgcctcacacttctcgtcgtccccagccatgaagtagcggtacgactgcgcgacgtactcgaagaaggcggcgtcggcgccctcctcgggggaggcctgcgccggggagggtggcatggacaggaatgaactcgggtgactccgcggcgcagtgactggggtgtggccggtcccggtctgtgtgtgcgtctgatgggatcatggccaatgtagcccacaccagagtgctgtgcagcaggactggcacggcgttctctcagtggcacgcgcggcacccatgcctgaacaagtctaccctnnnnnnnnnnctgactggggtgtggccggtcccggtccgtgtgtgcgtctggtaggatcatgaacaatgtagcccccaccagagtgctgtgcagcaggactggcatggcgttctctcagtggcacgtgcggcacccatgcctgaacaagtctaccctcaaggtcgcaccatctgcacggcgtgctcggcctggtcctggtagttcagcagctccacgagccaggccagggcggccaggattgaaggccaggtgtgcggggagcccaccgcggtcaggttggacttggagatctggaaagggtagcggaggcgcttgtacagcaccggaacctcctcctccagcttgacggggcccttggcggtcaaggggtccaggcggcgcaggaggaagagcatgatgttagtgaagtccttggtcgtcgggctggccagcacctgcggggagggggcggggaaaggacggtggggagagggggagtcccttacggcgggcaggtggttgcaccgaaccatggaccatcatcccgggcaccacgcactttggggttgatctggtactcgtagttgtgcgtagcgaggtatgtgatgatggtgcgggcgcagttggcctggtactgtttgtcgccaacggggcgggggtcggacttgagccccgaggccttcgtcgtggtgtacgcggaggagcggcgctgcacgggtcccgcgagcgacatcctgctcatggctttgtccaagggaacttttgacgcccaacccgtggcctttgccgcatccttggtgaagcgcccgggtgcgagcgaggcacgggagttaagcgacccggggctcaaagccccgagcgttttgcgccgatccatttcctcgaagtttgctgcgaaatgactgctgttccagtggcatggtcgcaggcgtttgtcgctcggcggagagtggggccttcccgagcgcggagtgctcagctgtcgccgatggctttgaaaaaagaaagccggaattcttgcaggattgctatcagaagcgcacccaccctctctacagcgatgcaaactcaggttggatgaagaattcaagtctgaagctcgattggatgcacaattatgcccatgcaccgtgctcagctgattgcctgatgcccgggatcgcctagtcttggatctcaccccgctgctggacatgggtcattacctgtcggaattggaggagattgtcggacccacaagtgtgaatgcatctatgctggccttcgccataccacatgagcttgtaataccacgagtaacaatcaatcgtgagttgcgatggtgcagctagtctccagccacggcaagacgctgaaggtcgtgccctccctcccgagtggcgagcccggcctccatgacggcatctccgcccggctatgggccgccacgtctgcattggctcaagaatccatgtcaacaccttttgtcaccggtatcgctgatggcactttgccaaggttggacgcggtggggggccgggtagcccaccgtgtacgcaccccggcagcactccgtcgacaatgactttccctcgcctgccacaggtcgaccttccagcactacctagcacaggatacgaactacctgatcatgtatgggaacgcgtatgcgactgccgtgaacatgtgccgaccggaccagcagcacgtggcagcagccctcttggaagtcattgacaaaatcaaccaggaggtcgccaagcataccgaggcgagtctcacagggtcttcctgcctctctgagcagattgcagggtctgagtgcatatcgggcatcgtttcttgagagcagggcatcattgcataatgcatgaacactctccagagactctcgcaggattctgggccagatgcttctgctaccactattactctggtacctgcaacgaccgcctacacctccttcctgaggcgcatcagctcctgtcccacggcggtaagtggttgacggcgaggctcacagatgtcatgacggctcatcagtttgtagggaggattgataggtcattcataaaggctgcagggctcaattgcctgagaaagcctgaggcttgtacacgtgcatctggcggggtatcatgtaacccctttcatgctccgaccacagactctggcagaggtcatggcagctgtgatcccatgcagccgtttgtacggctggattggtcggcaactggtggccaaggcgaccctagagggtaatccctacaaaggtggggcaagatagaaggtgtgcgtgggacagattgagaaaattctctgatcagctcaccactctggtgctagccacgacgaagatagcctgccctgcaacggcacaatggaccccgtctcctatcccttaacagcttggattgatacatatggatgcgaggagttcaaccaggcgtcaccaatcctcgaggccatcctggatgaggtgtatatacccggcacatacggtaagatttctgctttgccttacggcgcttggctgtcgagagagacctcttgcctgacgtgagcctccaccacctcgaagcacagagcacctgctgtccatctacgaagaggcaatgagactggagaggaactttttcgctgcacagccaacttaggcagactcgcgaaagggacattggtcgtccggccggaagaaaggggcggggttcgcgcgagattgtgtccatgcccttcatggggggcagcaaggcaagtgttgggcgcgccgacacctatcccgccattatgtgnnnnnnnnnnttgtgtccatgcgcttcatggggggcagcaaggcaagtattgagcgcgccgacacctatcccgccattatgtgcatgcaaccgtgtaattcaccctgcatttccaccagattagacctgtctccgctgatgttgaggcttttgtgtggcgcggaggagggctggtgagccccatccctccgtacgggtccaccaggacatgaggacccggatctccgtccagctgtggtcggacagcatgggactggctcacgagtccctgcgcacaccctttgtcatcagactgtctgatgggacgctggaaaggtgagtacggtcgttcaaggcgcacgagatgccggccggtgaaggtgccggaacccgnnnnnnnnnnatgcaagcagagcagagctttgtcattcacatgcaggtgaaaaatgggagtagtaaaggtccatctgggggttgcaagcacgaaacagggcttgaannnnnnnnnngcagcttcctccactatctgggccaggatactttctaccgcctcgcatatgccgatgctttcaaggctgcgctacgactttgtcggcctgaggacgagcatctggccctcaggctcagaacagctctcgtgcaagcagagcagagctgtgtccttcacatgcaggtgaaagatgggagtagtaaaggtccatcggggggttgcaagcacgaaacagggcttgaaataagttatgtacggatcgcatggcctgacggatgtcctcaagccacctcccaccccccttcccagagggctgctggcttcgatctctcactttgcaagcccgagcctgccaccttggcatatactgactttcttcaagcaacccacagccatccagatgcggtacgttgctgattctagctctatgcagtaacgcgagacaatagaggcatggtttgaggttggagtgctcaagtgacattcagtgaacatgcgccccatccccacacactggcgtcccaccgcctgcaatgtgcagactctggcagacatcatgtccgccaccataccctgtgcgcgtctgtatgcctggattgggcacgtactcttgcccaagcagatggactctagcaacccttacatgggtgaggatgtggtgctgccagggttgatgagcacttcctggcagggcctttctcaagctgacggctttctgtccctgatctcccccagaatggattgaaaactacagccgcaagtatgatgaccgacgattccaagacctggaagccattctcgacgaaacctttgtcccagagtgttatggtgaggatgggaggaggaaaggcagtgggcctggtgctggatgctcaatcatccactctatagcaggatccagatcctcctccctcccaccatggacagaccgggtgtcgtacctgtactcagaggccatgcggctggagagggaattctttgccgcgcagcccctgactggtggcgaatgtcccacgacccataccctcaagcgccaccccaaaccagcaagggctgggttgaacgcccactgctcggcactgtagcccttggcttccgaccacacgcattcggattgctcacctgacagtccgagaagaattatcttttactttttggaaaccagcttacagtgcatggagtttcccccccgattttcaggcatctgccacaggatgacgcccctggcattcatcaggtcactctctttcagcacactcttccattgcatcgtagccagacagatcagcacacaggacgctgctctgtcaatacctttgggttgtgcgatgcatgcaggaccctgcaccccgactcaggtgctgcgccctatcctgctggcatgaacgagctgtgcggcgcacaggaggtccagttcatccaggagcttcacgcgaaacgagcctgggcccctgacctgccctgcctcgtccactgcggcccgctcagcggccactctgcgcatgagggcaggaaggggtttcgaggcatgcctgagcgaaagacaacgccagagagcaggccagcagtgcatcaaggggagcttgctctggcatgcgacgcggctcctgcaagggtacaagacaggcgcacgaggggtctggatctcgattcttgtctgcaaccccaggggcaaccgcccatgcccgcggtgcctccttggcgggaccgcatggcagctgcacaccaacacccagatgccctccccgcacccaaagtaggccagagcgtgcgccgttgcttccagggcttgctcagggcctgccacggccacgaatgccgcgatgagggccgtcacggagcaccccgtcgctgtgactttttgcaggagggggtgcccattcccgaccaggagggtgctggtgccgtcggtgacgacatccactgccccgctcacagccactatgcaaccctggcgggccgcaagggcacgggccatcggggcggcggcctcagaggggtggctgctgtccacgccgcgtgtgcgttcgccgcccaagcttgccagggccatgatctcagaggcatttccgcgaatgacagttgggcccagtgccatcagatccttgcacagctacagcgagtccggtcggggcgggggtggaatgggaattgcggcggcatcttgcgttggggtaacggggctgatcgcgcagtggaagggacatctcgtctcatgcgggagtcacgtggggcaggggcggaatccggacgaaccaccacttgtcataatggtgcgaacccaccgaagttctggcaggggtggccccgcacgcgacggggtccagcacccatggctttctcaggcgccctgcagtcaaggcggccagtttcatgccgcctgcccagtcctccgacagtgtcccgacgttcaccagcagggcagaggccaactccacgaacgactccacctcgctgatcgagtgagcctgtggacttgaaatgtttgtttcgactaagccgggtggatacggtatctccaggcttaacctgcagtgcccacccagccgacccctccgcaccatggccggcgatgcccctgcagcgagcagggtgttggccatcagatccatgctcacaaagttggtgatacactgcaccaagggattctcctcccggcacttctccaacaggagcgctgttgcccggcctgtgagccccatgagctcaggtacggcacgggaggtggtggaccgggatggacactccctccacagatcagatgctccttgccgatcacattgccacggatgcattggggaaacttgtaggtggtggtagtcttccgcctttccaggccgctgcagtgggccttgcccaacaccatcgaggctccggcacgcgcgcgaagtgaaacccccccgctgaacaccgtgcccccggccagcattgagagaggcaggcatccactgcgatcgctgtacaattcctcaccacgcagatatgatggtcactcaaccgccctcggacagcgcgacgaggtcggttcggcccgcccagccacagccttccggggagcccgcgcccaatgggggggtgtcctcgcggctctgggaggacagcaaggatctcgcctaccagtcactgctgcatccctttgtgctcgggatcgcccaaggaaccctcccgcggtgagtctgcgtggatggcgcggggcgtgagcggccaacacacgggccggtgcccccctcccttgagctgcatggcccggcctccccacgacaatggacccgaccgaggctgggccctcaccctagccgacatgcaccgcgctgcctgggtgcgatcgtccatccgccccggggtttgggttccccctgcacctgccgcccccagcgtccgcacccccctgccctgcaccgcgcagggagtccttccagcacttcatcggccaggatgccaccttcctgctcagcttcgcggaggcctacgccgcagccatggaccgctgcgccccggagcagcagcatctggccgaggcgctgaaggggatgctgcgcggcgtgcgcgatgagctgcgactgcacgaagcctacgccgagcggtggggcgtgctgctggagcaccagcagccctcccccgccaccaaggcctacgtctactacataaagatggtcagcgagcagcatgactcggtacgcgcaggggggagagcgggtcctgtgtggcagcagcgtggagctcccgcaccttgcccactcctgagagggcctgatgctggggcacagggccgaggggggcatcgatggaaactctgtttgatccaggatacaaaagtcaccctgctctctgatgatgaacgccatccgcagtctctggccgacnnnnnnnnnncggggcattgatggaaactctgtttgatccatgatacttaagtcaccctgctctctgacgatgaacgccatccgcagtctctggccgacgtcatgagcacgctgctcccctgcctccgcctctatgcctggctgggcgcccagctgaatagcgtgccaagtcagcccggcaacccctacaagggtgggttgggcgataagtgtgcgtgtggagggtgcagagcggaggtcctccaggccagactgactcaacctagggtgacagcctggatattgcagtgtagggggcgtgcagtgctgagctggccgaagtgcttgatgagagggccactggggcaccctgtgcatggggaagcatccagtttcctggatccaagctgacaacagcctgtctcagcagagtctggaccccatcccctgcctgcagagtggctgaatacttacagcgcaaaggagtatgcggcactgccccccattgcggaggccatcatggatgaagcgtacgagcccggcacatacggtacgtttacaagaagagaaggaggaagtggtggatgtggtgttgggtgagacaatggtcggggagaggaaggggtctagattgtgcccatgtggtaggcgggctggcgcaggcgnnnnnnnnnngagagaaggaggaggtagtggatgtggtgtcgggtgagacaatggggggggagaggaaggggtctagattgggcccatgtggtaggcgggctggcgcaggcggagctacaccagcgtgcatcggcgtcgcacccaaacccgccggaaggacagggcagccccaatctgccgtggcgtctccccagcgcgaggttatcggcctcaggcgccgcgcgtcagcactcatcctcgtgcagcaagaggttcgggatgcccttgttaacaaggaagcggcgccccgtctcggggcagaccagggcgccctcctccaggtgcagctccagcagcgcatggtgcaaggcctgcaggaaggcgtcgtcctccgtggccccctctggtacggtctctgggagttcggcaaagcctgtggatttggtgggtgacggtgtgtgtgtttgtgtgtgtgtgtgtgtggtgtgtgttaggctgcaggggaaagggcactcaactcccttcttaaaacctcaacaagccccgagcaccacccctcccacaccaggcctgcaccgacctagggaagcggcggcagcacgcagcgccccgtactcgaggcgggggaggatgtggcacaaaaaggtcgggtcgaagtctgcttcccgagtggccacctccccgacctctatgcggaaggggaacccgttctttacgcccttgatggggcaggacagcatgttgtgggttatgagcttcatggcggaggtcccgtggtgtcgaaacggccggcgggcgaggtgcagcgctcgagcccgggccaggatgcgcccgcgcgagtccacagtcacggagcaatgtcggcaccttactggctattacctctcccactttagaactcaggagtactggcgctgtaggtctcttgggacacggcttctgtggtgtcccgacggcacgggcgcgccctgaggagagggcgccgacgggatgccgatgccttgtcgcaatctcgacacagcattggggccggagcaatcaccatgggagcccttaccaatcgccgacagcctgggaagcagtcattcgcatttcattaacttcgattggtgatccaccccggcaaaccggccgtggatgctggcgagcctcctgacacccattttggtgctgagggttgccagggtttacaccccctggagcctagtacctctggccttccagcaccatctccctcgttcagcggcagccctcgcctcgtcactattcacattcaaatccttggcgtccagcgcagccccctgtacgccttccttcctcctcaacaataccgtgcagcagctgcgcgcccatgctccccagcgtgcatctgaacgccagtgagcgcttttgagacagtcatcctctcccatacccctgctctacagatcgcctgctgagtcagtaccggactgccatgcagctcgagaaggagttcttcgccgggcagccactcaattcgcaggtccggcagctgcgactcctggtcatcgactttgatgaaaccatcacgacccgggacacttcaggcaccattgcaaaaacggctatccaggccgtcgtgagcaaggtaggggcatgtgttgcacatggtttgggatcgggacacggggatctgatgtttgccaggccgggtttaaagggagctaaaccatgagctcatcgttacgcgagtctcctgctcgggagaattgacctgcaccactaaatcagtctctggccattccgctgcactcaacagctccctgcaacgtgcgcaggtgtctgaggcatcaaagtccgagcatctggtgcaggagctggcagacaagcacagctggctcatcaggaactacaccgaccggcgcacctccctcctcgaggatgccctgcccccagtgagatgctcactgaccttgctgcagaataaggggtgcatgcggccaggcctgcctggccagctcactcttgccagaactttctacaagaccagcgcacacccaccatgcacctgctgcaggagggggaggtcaggacggagtttgacatgggttggctcggtgactttgtggatcgcctggctgattttgaccgggagatgaacaccgtggtcgtcgactctggtaagggagcttagggatcgtgaacctcttttatacttgtaccccttgctcatcttggcccgnnnnnnnnnnggcttggggatcgtgaacctcttccatacttgtaccccttgctcatcttggcccgtctcccttctgcatccttatgtgcgtgagacatctgcgcagatgctttgctcataagcaaaccgccggccccctcggacatgcaggcatcctgaagggtgtccgccgcgagcagctggcgcaggccggggcggctgtggagatgcagcccgggagcctggcggtgatgcagaaggcagtcaaggcgggcatccctgtgtgagttgcgcggggttggaattttgggggcaggccgagagtgtgacgcccacccactgtgatgtctcaggggagtgggtgcacggtgcgcaaggggggtgtcccatgctttttgccaggtcacatacagatgcaggcatggatgggttggggctgctccttttgtcaccatgctcgaatcccagattggaagccaggtccgctctgggcctgtgtagtgttcaatcgcaccaaccactcatccccaaccccctcctgcagggccgtggtgtcggtgagctggtcggcagagtttgtgcgggcggcgctggcgcagcaggggctgccggtggtcgtcagcgacagcgacggccaaggggccgacgtcccctccgtcagcgccgtcaccgtctacgccaacgagctggagtactttggggacgagtccaccggcaacatccgcaggcgagatggaaggggtttttcttgggatgttcaggattggaagcgggcggaggggtcagagtgggtttggatgccgggggccggtcgcgcgatgcgtccagaccgttggtgcctgcaccgtgcccggcccgtgcccggccttgccagccagcgccggggtcgcaccccatgcgcacgcctcaggcccccgatccggtgcgcatgaagagacccgcccacctcgccggggtgcccgtcaccgtcctccgcaggcggtgcgagtgcggcgcggacaaggcccgcctgctggacgacctgctgctgggcctggccgcggaggccggctccggcggcgacgcggtgtacgtcggcgactccatgaccgacgtgccgcccctcatctccgccgacgtggggctggtggtgggccgcaacccgctggtgcgccgcgtggccgccgccggcggcgtgcgcctggcgccgctgccctgcgcgcccatggcggcgccgggcgaggactcc

SEQ ID NO: 36526 - DNA, 9497 bp, Chlorella protothecoides
  modified_base (690)..(699): a, c, t, g, unknown or other
  modified_base (1603)..(1612): a, c, t, g, unknown or other
  modified_base (2145)..(2154): a, c, t, g, unknown or other
  modified_base (3748)..(3757): a, c, t, g, unknown or other
  modified_base (4483)..(4492): a, c, t, g, unknown or other
  modified_base (5214)..(5223): a, c, t, g, unknown or other
  modified_base (5873)..(5882): a, c, t, g, unknown or other
  modified_base (8742)..(8751): a, c, t, g, unknown or other
ggcgggatgggggagggattggggggtgggagacagtgtgtcgaaaggggatcaagtggcagactttgccacgctgcccaccctggcagcactcgacctttaatcctcgcattcgccgccctgacatccggagcatgcgagcctgtgctgccaaccctcgccgacccctcctactcctgcgcggtgtaggggccgcaagcgctggatcctgagtgtgccctccaagggcgagatctgggtggacgacggcgcggcgcgcgccatcaagaagcacgccagcctcttcgcggcgggcatcaccaaggtggtcggcgagttccagcaccaggacgcggtcaagctgtgcgacgcgcaggggcgcgagctggcgcagggcctgaccaactacagcaacgtggaggtggaggcggccaagggcctgtcctccgccaagttcctcgaaaagctggggtaccagggccaggaggaggtggtgcaccgtgccagcatctgcctcctggtcaagcgggagcagggtgaggcttgttcttgggtttgatggaggccggtgggtggaaagatgagagattttgggtgtcacttgggcggcaggctgctcagggtgggggcaaggtcacaagcgggcgggatgatgggtgaggggatggtggttcggcgggccccagatgggcatgacattgcccacccccnnnnnnnnnnacgggatgatgggtgaggggatggtggtgcgtcggcccccagatgggcatgacattgcccacccccaaagcccacgacccccacccgccatgacatcatgcacagggcggagcatgcggcgcacgcccagccgcggcagcatgaccagcctggccagcagccgcgcgccctcgcccgcgggccccgagtcggggtacgaggactcgcccagccactcccccgcgcccgtggcgcgggggcagtcccccggccggtcacggacgcccccgctcccgcctacgacggggcagcaggagtctggggcgggggagggccaagaaggcccggcactcagcgaggacgacatcgtcacccgcctggcacacctcaggtgctggaggaggggaggtggggcggggggagatgctgcctgcggtggtggagtgaagtcgcctggctgggaacaccccctgtcccttgtcattgcccaggggaaatggggggagaggggccagcatctatgcccaagatcacacatgggtttgttcagaccggtccttccgggggtcgaggagcactgtcaggccttcacaagcccctcctgcctcccacctgccatgcacaggcaacgggcagggctgggtgcgtcgggaccgtcagacgactgggactcccaaatggcgtatgccatgcacgccgagctgcagggcagcatgcacgccaagccggtggcctcagaccaggatgtcgacgagggcggctggctgcccaagtgaggcggggactggtggggacctgtctcctcacttcccggccaaacgacaacgtcaatgaatgtacggctgaccggcgtgatcgtttcacgggtctccaccgagcccagctctctgcgcagggccggtctggtcgcccctcgccttctgcnnnnnnnnnnaaggacggggggtgacctgtctcctcacttcccggccgaacgacaacgtcaacgaatgtacggctgaccggcgtgatcgtttcatgggtctccgccgagcccagctttctgcgtggggccggtctggtcgcccctcgccttctgcccacactgccgctgtccagcacaggggcgaaatgattgattgtgcccttgttcacccccttgcccctctcccgatctgctgctctcctctcttgctctccacgtcccttgcaaggctagtgccgcctcacacttcaaagatattgatagagatttgggtacacttgagggatcaagccagcctacttgccctgctacagcagccttgggtgtaccgcctcctgcgatcgcatctcgccatgggtcaattctacagtgagcagtttgggcttcaataaataggatgttcttctgagtggcaacgggtgcgaatgacagaatcattttcataatccgacggtcatcaggacggcgtgccggcctgcgccctggcagtgagcaggcgcagnnnnnnnnnnaaatgacagaatcattttcataatccaacggacatcaggacggcgtgctggcctgcgccctggcagtgagcaggcgcagcgcgaccagcgcggccaccccccccgccaggctggcgccgatgagcaggccgccctgggacaggctctgggcccagggctccaccgcctccagcgcggcgcggtggtggcgcagcatggcccaggtcatctgcttggccgtgcccagccgccgctccagcaagcccacgcgccgacgccaggtggactccaggtcggcggccgtcaccgcgcgcgcgcagatctgggccaccatgcgcgccaccaccacctcgtcctccaggctggtgggtgaggagagcgcggcgggggaggcggaggccgcccgggaggcgggcgttgcgggtgaggcggggcagcgggacgggcaggggggcggcgacgcgaggcggagggcgtcctgcgccgctgcgaccgccgcgtcccacacgtccgaagacgtgtgccccagacgggcggtgctgcgctgctggggcgtgcggatggcggagccgtcctccgactcgctgtcagcgggagaggcaggcgccgaggcggccgcctcggcgtcgtcggggaaccggtggccgggaaaggggaggcgcaccgagcattcttccacgtaactggcctctctcaggtcgctcaagagaggccctgcgcctgctgcagatgagtgggcgtcgggagggggcgggcgatgccgctccgaggccaccaggcactccctcagctccagcagcttgcgagactctgcgtcgcagaggctgccaggcaggctggggtcgcctggcaggaggggtgtggaccgggagcagggctgtagagagtggcccagacattgagaaacaaacttggaaggtggctatgcgcgctttaccgagcgcatgtgcccttccccacaaccttcagcggacagggtgcacgcagcctttgcgtgccatcttcagcggcagccccgacagatgctctgctcaccagaaggcgcagcggactgggcatcccagtagtcctccacacttgaggcggcaagagagcaggtggaggggtaagtacggtgcagccgtgatcccgccgagcccagtgacagccagccgcttggcgagcgagggctcccaccggcaggactgaattcgtagtgcgacccacgacccgatacctccattgcggaaaatgaatggttggctctttgtgatctgcctttcggcctttcgacttttagccccactgcactcgtcagacgcatgctggagagactcgtgcacggggggttgagtcaactgccctgctggcaatgaaaaggtggtccccccctagactcagcacgttcaagttgaaccaatcacccatacatcgaccttccttaacagctcctgttcaattccattgcttggtaaccagggtacttgtcagcacctatcggttctcactgtatcacatggaaatgccatgactgtgtgatcatacagttgcatagctgtataattgatctctcatgcgtgagtaacgtgagaaggaccccgacttatgccttgcatgatgttgtccctcctgccannnnnnnnnngtaattgatctctcatgcgtgagcaacgtgagaaggaccccgactgatgccttgcatgatgttgtccctcctgccaaagcacagcaccacccacctcatgggcggcgtcgtggaaaatcgcgcgcgttgaaatttcttcatgtgcaactgcaaccgcgctcagtcagcttcatcatcaatcactcaatttcaatacgaccgtaatcgaaaggatgcgtacaagaagcagggctggtgctgtgtcaggagccaaggacccggaggaggatgcttccccgtcgcaggaggtagaagacgccgaggaggctacctcgggcagcgacgacgaggcacccgaggaggagcaatttgaggcttctaaaaaggtccgggagccgcaaccagacatcgagtgtgtaccgtgggccgtgtctgagcggtggggtatcgctttggtgttgctgcccactgaggctccactgctcgcagcgatcgaccgtctctgtccacacgcgcagtcggcggctgaaaaacgccaagatgagaagaaggcgcgacaggctgcctctgcacagaagaagcagcagcggcgcagcagaggaggggccgccgaagcgtcgcaggggccagagcagcctgctgctgaaaacgaggatcgacctggcccgtccgctgaggccaggcttacggttgccgacgatgctgatgcaggggagacgagtggggccgaggaggagttggacctcnnnnnnnnnncccgctgaggccaggcctacggttgccgacgatgctgaggcaggggatacgagtggggccgaggaggagttggacctcctgcctgatgaagtgctcgacgctgtggcgcagaccaggtgggagtgtgtgaatgggcagaacggtgtgcaaagcagtgatggcatgtcgtttcctgcccctgagatactatccaccagcgccactgagtcgacctgcacgacaatcacaccttgctacctggccgactccctccttcaccacgttgctgttgcgcagcgcgctgaacccccagcgggcccgggagcgcagcatcgtctcccagcacctgaggacggggatggggccccagtcctctgcgcgcaagcgtcgcagggtcgtcaaggacaaggccaccggacgcgtcgccggacccgtcacggtcaaggtcctgggcgcggtccagtcgacgcacgcgtcaggtgggcgtgcgaggggatggggtgcggaggtgctggaggggcggtgggaaggaaggcccagccctgtcacggcttggcacgcttgcagccattcctgccacctgagtgcgttgcacaccgttcccatggccccgccgacccattcgtgctcatccatcccttccaccttccccacactctggcagagtctgcacgggccttcctcaagctgcggaggtatggccccagggtgcagcgctccacggccatgctgcggcccgtgannnnnnnnnnttcccttccaccttccccacactctggcagaatctgcgcgggccttcctcaagctgcggaggtatggcaccagggtggagcgctccacggccatgctgcggcccgtgagggtcgacggggtctagatccacccgtcccgcccctgacgcgacagcctgtggcgactgcccccacgccctccctgcactcccttcccctgccctggcctccccctgctctgttctcccttgcaactacattccccagagccccctttccgctgcatcgcgcccttctgaggggaagcctacaaccagtcacagtgcggcggggcggagccccctttcatgcggtggcggcgacagaggtagagccggagcgcagcttctttgccgcctcccgcttggtgagcttgcgtgcccgggtgggctcggcctcggccttgaccgcggagttgcgctccgacaggatcagctcgatgtgcgagggggaggacatgaaggggttgatgcggccatgggcgcggtaggtcctgcggcgtccacgctgggcctggttcacctggatgtgggagatgtacaggttgtccacatccaggcccttaagctgttgggaaaagaggggagggggaaggggttgtggggagcggagggctgtgaggttgggatgcnnnnnnnnnncagctgttggggaaaaggggggagggggaaggggttggggggagcggagggctgtgaggttgggatgccttacaaaccttggtgtcctgcagcccaagggccaccggtccatgcctttgggaggcatgcagacgctcccgcacgcggacagccaccctgccgatccctggtctcccagccggccccctcctggcgccgcctttgagccagcacccccgccacccacctcggcgttcgactcggcgttcttcagcaggttgagcaggaagtccacggacttcttgggccagcgggcctggccaatggagttgccctcgttcttggcctgcgaagtccggcccacgccgccgttgaagcgcaggaaggggatggcgcgcttgtgctcgagcacggcctgcaggtaggccttggccttggccaggtccttgccgcggatggaggcagcggcctcacgggagttcttgaagtgcacgcggaggtcggagccccgggcctgaggggagggggggggaaggggggcggggtggaagaccacgagaactgctcggcacgggcaccccaaggcgggcatgcacgccgagggtggctacgaagagtgcatgttgtagattcgccagctctcggcccgtcagtgtcccgcggtgcgcgctgccagcatggcgttcccgggcctggcgcccgcatcctcacaggcgagcccctcgctcagtccgcccgtcaccagctccggtcgcccgccgtgctccatgtccttgatgcaccacatctgatgccgctgatgcctccccgggccctccgagctggctcgagaacggcatagcccctccccagcacccgtggctgcggcgccaatgcccaccttcgccgacttggccgcgttctccgcgtcctgagcgtacttcaccatcttgaggcggcctggcttgtcgcaaccctccctgaccgcgaaagagggttggtcgggaaggccgccgtgctataactgagacgctggatcaaacacacgtggcccctccctctccgcaggggagtcgcagggcgcgagaaggatccagcaccctcgcactagcgtctgaggggcacagcgcataccacacatgccttgtttccccatttacccttcgttgcaacacctgtcgagcctcacacccgacctgtgtcgttaccggtcacattctctggccgccgcgccagcgcccaggaccctcgtccactcctgcctcgcggcacccacacaatgagcgcactgtggcagagccaggcagctgggccatacatacatgcaccagccacacagagccatgtgtgagtggaggactgcgcgacactgcatgggctcgtttgctgccacattcttgcctgcccagctcaggtcccttttctgtcagagctcttgtgcctaaccctcattcctcccctactcactagtcaacccaccaacccttcctccctccgacgcccacgcaggtcgtgctgcctgtgcggcgtgagcatcctgcccaatgcagcgtccatgtgtgtgaactgcctgcagggccaggaggacatcacccgagacatcaagaagcagatacacatttcctggtgcaagggctgccagcgctacctgcagccgccaaaccactggatgcatgccgagccggagagcagggagttactcaccttttgtatcaagcgcgtcactgggctgaacaaggtcaagctggtggacgctgggttcatctggacagagccacactccatgcggctgaagaccaagctcaccatccagaaggaggtgcatggcgccatcctgcagcaggtgctggtggtggggtctggggggttgacgagggggagggtgggagcatggcctagggtgggttgccgtaggtagcaatcagagtgcatcttggcattttgcctgtcaggagcccagcgcttgttggtttgtccttgcatgccgccgtgggcatgcaggctttgtcatgcttaggttttctggcatgtggctcgaatgcttgctgctgggcttcttgcgcagtgctttccccatctgccctctgtgaatacttacaggcaccccctgacctagtttcattctcaccttccacccaccatacgacctctgcaggcattcgttgtggagtatgtggtggagcgccacatgtgtacggcgtgcaatcgccagaatgcgaacccaaactcctggatagcctgcgtgcaggtgtggcgccagggttgtgttgaagggtgaaacaacctgatgaagggcaggtgttgtttgttgaggtttgaccagggcttctggggtctgcgtgccaggtcgccaccaatgggctttggtattgccagccacctctcctggtgctgaggttgtcaagattcatcccattcctgtcaacctgcagctgaggcaacatgtgacgcacaagcggactttcttctacctggagcagctgatcctgaagcacggcgcagacgagaactgcgtgaacataaagaacatccacaatgtgcgtgaaaggttggtgtgcggatctcgccgatgttggaagaaatgctgtacaacgcatagtacaccctccacccaccccctctccatctcccctcacccaccacacgatacagggagtggacttttacttcggcagccgcgcgcacgcctgcaagttcatagacttcctgcaaagcgtggtgccgctgcgataccgccacgacaagcagctggtcagccacaccatccacacctccgagtataactacaagtacacctttagcgcggagatcgcccccatctgcaaggtggccaggggtgtctggtgggaatcatcatgatctcgagtgcggggcgttgcctgcagcgcatgcggcgccctcnnnnnnnnnngcaggggtgtgtggttgggaacgatcatgatctcgagtgcaggcgttgcctgcagcgcatgcggcgccctccaagggtcctcgtcctccgtctctacctttcctcccccccaccccccaccccacacactcccacgcaggacgacctggtctgcctgcccgccaagacggcgctggggctgggcaacctgggcccggtggtgctggtcacccgcgtgaccagcgccatcacgctgaccgacccccggaccatgcgcagcgcgagcctggaggcggggcagtactggcgcgcgcccttccgcccgctcatgcacgcgcggcaggcggttgagtttgtggtgctggactgcgagcccgtgcagagctcccacggcggcgggtacaaccatggcgggcgctggcagctggcggaggccacggtggccaaggccgcagacctgggcgccaacgacaaggtctccattacgcgcacccacctgggccacctgctgaaggcgggggacacggcggcagggtacgacctctcctccgccaacgtggccgacgacgcgctggaccgcgcgctggcggcggggctggccccgccggagatcgtgctggtgcgcaagtcgtacgaggagaagcggcggcggcgcgcggcggcgggcgcgcgccgcgcctggaagctcaagcgcctggacggcgtggaggcgggggaggaggacgagggcgggcgcggcgcgcggcgcgccgccgcggaggccgacg

SEQ ID NO: 36527 - DNA, 61 bp, Chlorella protothecoides
cctggcttcaaacgggggttcggcgcccccacctccacccctgcgacacgctgtgtctgaa

SEQ ID NO: 36528 - DNA, 66 bp, Chlorella protothecoides
cccctcacctgcctgccggctggttctgcagcccataccatgaccttcctcagcagacaagggacc

SEQ ID NO: 36529 - DNA, 1139 bp, Chlorella protothecoides
  modified_base (345)..(441): a, c, t, g, unknown or other
cgggcgcagtgactggctggtcgggcgcagtgactggctggtctgccggcgcccgtggatgggcgaagctgacagataatactgcgcgggcacagtgggacgaccagttccccttggtgcccaactccagcttggcgttctgacggaggtgccggaggagctccctcttgtagtaggtggccgtcgccgtggccagctcccccgccgcttcgtcgatcaacgggcggatgtgcttcgtgtccggcggcaggagggcgactccatcctgctcgagcgcctcccggaaaagggcgacggactcggccagtggcgcaaacgccgccgttgcgccggtacctgcacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgggtgggttgaaagggtgggtgggttgaaagggtgggtgggtgttcagcacctgccctgcagcgcatgccgctgcaacccgtctgtggttccagacacctacaagcattcccgatccaaccagcacacacgacctgcagacgtgggaccctccattccctatcaaacaaggaatccacggcatcagtttgcctaccacccttttcccgcccacctctgatcgtcagcacacgagacccacctggcgaaaaatatctcgtcaagcggctgcagcgccgcatccgcgtccgcccggccagcctgctttcgccgctcgaactcctccaccatccggatggcgtggaaggtggcaaacaggtcgccgacggtgcgcgactcggagatgaccgcaacgacgtcgtccacggtcgaacgcagcgcatccagcacaggctgctgctgctgctgctgctgccccatcttcttcttcgtcttctccttgggaagatcccggaagccgttccaggtcgtcgacagaggttgtcgcgtagtcgtcgagcacctacaatttattatagtgcgggcgcagggcgtgtgtgattgtcttgtgtgtcttggtcagtagagccatgcatgctggggcccactccagtggccctcaataccccacttcaaaatggcacacccaagtcctcacacaccttcccgaatcggc

SEQ ID NO: 36530 - DNA, 61 bp, Chlorella protothecoides
atgcacgaatgaggccagcttggcccactccagcatgcgcgtggtaccattctccaccccc

SEQ ID NO: 36531 - DNA, 74 bp, Chlorella protothecoides
ctcctacgccaagcgcgccgcggagacgttcggcgccgtcatcagcctgatcgaggcggagctcatcccgctgc

SEQ ID NO: 36532 - DNA, 79 bp, Chlorella protothecoides
cagccatgccgcagccactggatgctctgcgatgggcaaggatgccagaagacagagtttatcgccttcacccagttct

SEQ ID NO: 36533 - DNA, 80 bp, Chlorella protothecoides
taacaataatgagcagcatggagctgtcagaagggggccttgcaccaataggggaggggcagtgtcctgcattgctctcc

SEQ ID NO: 36534 - DNA, 80 bp, Chlorella protothecoides
cccgacatgatcgagtacagggtgtgagagttttattctaaaagttcatttccaatcactgatcgattgcatacccttca

SEQ ID NO: 36535 - DNA, 61 bp, Chlorella protothecoides
ggagccgggcgaagacggcgcgcagggcgggcgccggccactcggcgcgcggcgcggcggg

SEQ ID NO: 36536 - DNA, 386 bp, Chlorella protothecoides
  modified_base (125)..(318): a, c, t, g, unknown or other
cgccggccactcggcgcgcggcgcggcggggtccacgccctgggcctgtgccggcgtgttcacgtgtgtgtcggtgaaggggggggatgactcgatcggggcgaggaggtgatcgaggcgcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcccccctcctcttccaacccacgcaacaaccaccagatccctcacccgcagggcggccttgaagg

SEQ ID NO: 36537 - DNA, 73 bp, Chlorella protothecoides
ccccagggagggacatggggaggctagcatgccaccaggttgacatctacacacacacacacacacacacaca

SEQ ID NO: 36538 - DNA, 91 bp, Chlorella protothecoides
tgcagaccttctccgccgacctgtccgagggtgtctgtggtggcggcgcagatgcggagggggggcgggagggtggcactgaacagaccga

SEQ ID NO: 36539 - DNA, 115 bp, Chlorella protothecoides
aaaggacgcagtagtcggtggcgacccccgtcaccaccagcgtggtcacccgccgcgccctcagcagctccaccaagcccgtcgggtgcgtgtggccgaggtcgaagagcccact

SEQ ID NO: 36540 - DNA, 64 bp, Chlorella protothecoides
gtagtgcccgaacttggccgcgtagtcgtcgccgtcctgggccacggagctgcggaagaaggtg

SEQ ID NO: 36541 - DNA, 67 bp, Chlorella protothecoides
ggtcccataaagcccaagtggctgacgagaggggcgtcgccagccagcatgaggggcggacgagcct

SEQ ID NO: 36542 - DNA, 68 bp, Chlorella protothecoides
tcacttgggagcgcgaggacgcgtcatccgaggcctcggtgggagctggggccactcgcttccgtgcc

SEQ ID NO: 36543 - DNA, 8179 bp, Chlorella protothecoides
  modified_base (582)..(751): a, c, t, g, unknown or other
  modified_base (3500)..(3509): a, c, t, g, unknown or other
  modified_base (3629)..(3638): a, c, t, g, unknown or other
  modified_base (3995)..(4004): a, c, t, g, unknown or other
  modified_base (4554)..(4563): a, c, t, g, unknown or other
  modified_base (4997)..(5006): a, c, t, g, unknown or other
  modified_base (5491)..(5500): a, c, t, g, unknown or other
  modified_base (5746)..(5755): a, c, t, g, unknown or other
  modified_base (6001)..(6010): a, c, t, g, unknown or other
  modified_base (6386)..(6395): a, c, t, g, unknown or other
  modified_base (6807)..(6816): a, c, t, g, unknown or other
  modified_base (7233)..(7242): a, c, t, g, unknown or other
tccacagagttcccaccacatttccagtcgtaatgaggacaaaggtcttcagatcagggtcaagctggggcgcaggtgactataatacggccataatagtcgcagataagaaggcttgggaacccttcaatactgcaagtacccatagaagcgtagcggaaatcattggggcaaataccgactgagggtgggcctgtctccacgcacactgcaacgagagagtcattcttcaaacagatgatgggatagtaattctgcggacagaatccgctggacagagtagagtcatcagggcaggcagcgtatgcagggctggggctgggagacgggctggggctagggctggggctgggagatgggctggggctggactggctgcagtctggtgccgtcgttcccacgacgtttcctgcagagcctgtcagctcaatgactccagtcccacaagcaaatcctgcttcagagttggcggagccaggtgccgtagaattgatggctcccgacacctgcgacatattggaaattaccacattaaattaactcactccttggtatcagatatctccctcctaatcccaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccgcgatctccccaggcgacgcactggtggcctcggcggtccaggctgaagtggctatgccctggggcccagtcgtggttcccgtgaagcttgccgtagcacgtgctggagtgttcccagcagcgctcccctacacaggcatgaaagactgacggacgatgagtcgaaggagcgctgtgcaacaatcatcgtcctctcattccacggaactccaagcagagcacctgctactcggcactccagttgatcctagatctttgacgactcgtgcatcagtgatctgaaccttgtccattgtccacgcacctttccactggctgcgccggtcaccgtggatccggtcttgctggaggatgcggtcatgctggcgctggatgcagcgccgactcccgaggccgacgacgagaccgagccggaggatgcgtagtcacgagtctcggacgacacgatgccagtgaccatgccatctgagctaccggacaccgaagcggaacccaagagcttcctgcaaattcggtccaggaagggctgtctgagctcgctgcatatgacgagaacagtgggcggggttgaggtggtggacccatggattagaagtgaaaccgtagtgaacttctcgaggccgttgaggagccccatcaatggattctatcagttttgtaatgttctttggtgttttctggaggaactcgcctgcgaccagggccattctgcaggctgagcgactgtacagatgtcgagcagacgaggaggacaagtacccctagactgtggacgacagccattggaccttgcagagccgagtcacacctaggaaggtctcacaatgtgctttgtgatgtctcacgaggctcagcgcaattatacagatgcgtgtctcgctctgtacgacggcggaaggcagcgcggaatctcgagccaagtcacatgggctggaccgagtcgtgtcatgagcccgtaattatccggtcgcttcactccgacgtcagtcgtttctcaccttgcggcttgttcacgtatgagaaaagctttggctgtgtatgaccatttattctgtcacagtgagttttaacgcgggccttgtagacgtcatccttgcgggacttggcgaggcccagaacgcggagaagagcagctaccccgcgagcaaagcgcctccgagagtgactacgcccgcgacggcgattaaatcacgctggaaggggtacaagtgtcctacggcgatcaattcataatgagaagctgtgttgtttgccttcgcttctcgaatcgcgcaaacaactctctgtgcttctccaacaaacaaaactgtctgggtcactagcattagggagctcaaaagttcgattatcagcgcttattgtggtgaatatctacttgaaaatacccagcatcaacaaatgaccactttatttcccagatttgtccatgctaggtatcaaaccagcatgactttggaggacacagtgcatgcggctcgacacctccttcaacttcttccataagctatggtgcgaatgagcgatagctgggtagaatctgattgagcgcagtgaaatttgcgtatagagatttgtcaatagatgtccttgtaggattatagagcaggcaaggatgggacgatgggcaagccttagggcccatgcaggatcaggcgggttgggtgctcctacatcctggcgtgggtggctaccggaaagcatcggaaagcacagcaaaggcgtgacagaagcttgtgtgacggttgcagtctcaagaaaacgtaggtgtcagagcttggcttcaagctgaggtgcaatggacgacgtacacattgtaagccaagcacaccacaagagttggatatcctggtaccatgcagacaccctgagaggggttagtagatgcaccgaggcaatatccgaccgagggtggacctgcctccacacatactccaaagggggacccatcctttaaacagatagcggggtagagtcccacttcacaggatccgctggaggggattacgtcttcggggcagatattatttccagggctggggctggggctgggagtcgggctgggagacgggctggggctagggctggggctgggagatgggctggggctggactggctgcagtctggtgccgtcgttcccacgacgtttcctgcagagcctgtcagctcaatgactccagtcccacaggcaaatccagcgtcattgttggcagagccaggtgccgtagaactgatggctcccgacacctgtgacacattggaaataaccacattaaattaactcactccttagtatcagatatctccctcctaatcccaatcaaagaccctcgactcaccacccctcctgcagatgtctgggtcgaggatccctcggcactggacgcgatctcgccaggcgtcgcactggtggcctcggcggtccaggctgaagtggctatgccctggggcccagtcgtggttcccgtgaagcttgccgtagcacgtgctggagtgttcccagcagcgctcccctacacaggcatgaaagactgacggacgatgagtcgaaggagcgctgtgcaacaatcatcgtcctctcattccacggaactccaagcagagcacctgctcctcggcactccagttgatcctagatatttgacggctcgtgcatcagtgacctgaacctcgtccattgtccacgcacctttccacttgcttcgccggtcaccatggatccggtcttgctggaggatgcggtcannnnnnnnnnagtctcggacgatacgatgctagacaccccgccatctgagctaccggacaccgaagcggaactaagaagtttcctgcaggaatgaaacgtgcaaaaaaggctctcagagtatgtcgtcgnnnnnnnnnncgcctcggacaatacgatgccagttaccatgccatccgagctaccggacaccgaagcggaagcaagaagttttctgcagaatggaaacatgcaaaaaaggctctcagagtatgtcgtcggcggctaccatgtgcgggagaatgttccaaatctccaaactcaggaggagggcgcatctccccaggcctcgcagggggcccgaatcattacaaatataacgcacgccctacaacccccccatcaaagcggcgtacctatgatcgaggttgtactggatgccatatacagacacggagccggcaaggacaaggattgtaccccaaacccaagaggtcctcatactgtcgcaagacggcnnnnnnnnnngtacagacacggcgccggcaaggagaaggattgtaccccaaaatcaagaggtcctcatactgtcgcaagacggcattaaaatgctaacaattgcttgtagtgggctcgggggagggactggtgaatgtcgaaccttggtacctgcggcatgtcttacgttgcatgacaaggggtatcaacaacgcaatccgggaggggagtgcatgggatgaaccaactggtgctgcgggttcatctgagggttgattgcgacctagaatgcaagaatctgagcatgttactgcattggaagctggtgtatgacacatcgatatcggtagattacttgtaagctggctgaaagggcatgggatgtcgagaagagctcgccccagtccgtgcactacaggacgcaagctgacgcagtctcagaggccgaccgtcatcactcagctctagactgcactataaactggtctgtaaaggagcttttgtttgaggtgttaagagcttggtgtcctgatggcaaacataaacccaaaactgctgaagtaactcgatattctcgcannnnnnnnnngctgacgcagtctgagaggccgaccgtcatcactcagctccagactgcactataacctggtctgtaaaggagcttttgtttgaggtgttgacagcttggtgtcctgatggcaaacacaaaccctaaactgctgaagtaactcgatattctcgcacattcctgacatgccctttgttcccacccaaggtcacaccgacgtctcagatatcattacgaagacatatgaatgtgtacatggagtggaaggacatgctttatggcccttgaaggtcacccttcgtccttgactggcagccttaggttggcaactcattcgagaacttgcaagtgtgtttgacagttgcaaggacatcgagttgcaaaagcaacagaacataattagcaactcacttcttgaagtttccatcaagccacctctcttaccatcttgactnnnnnnnnnngcttgcaagtgtgtttgacggttgcaaggacatcgagttttcaaaagcaacagaacataataagcaactcactttttgaagttttcatcaagccacctctcttaccatcttgactcgtgcgtgttgggaagaattgcaacgagacgttgcgtctcgtgtacagtagaccctggggccgcgggcctctaccctggctaggtgtacatgcatgcctccagtgccctgctgcagcaccttaccttcgccattccaaagactggttattgactgaccaggttagggctgcattccggttctgagagaacatccagggcagagagcctcgtacgccaccctggcacaccctccgcttctggtacgagaatcacttgcgctgaggcgcagacatatgctccatggtggtgggtcacttgcccacaccggtcttcgcgcaagacaccggatcccgcttcttacagtatgattcttcttccttcaacggatcnnnnnnnnnnctgggtcacttgcccacaccggtcttcgcacaagacacctaccccgcttctaacagtatgattcttcttccttcaacggatcgcttgctgcgttgacggctagtcggactctggaagggtcgacactgtgtcatgcgctggggtggggcctgagccatctggggaaagatcacggggccgacttcgacaaaagaggcagagtccgcaccttgctgccactgttgcctggagtatagttgctctgcnnnnnnnnnncccgaattcgacagaagaggcagagtccgcaccttgctcccactgttgcctggagtatagttgctctgcagatccggtgccttcgtagacgagactttaagcctcggcccgttctctccgttgcggagtgccggaaactccggtgaagaagtgtaaacgtcccagctgatcgcggtgcaggacgacgccgcaaacccaaccttaacgcgaaagatcttcctatgcagtagtcacaggccggattcnnnnnnnnnngacccaaccttcacgcgaaaaaccttcctatgcagtagtcacaggccggattccgttcgctgacggcatgcatgcgccttctccccatctcagtgccacccttccacgagcaagccccgcctttcctcgcccctgcatcgcccagcttcagcggaggccccacatccagcggcacgaaatccattgcagggcagtcacagggtctcgcacttgcctcaaggaatgggcgccggtcgtcgaggccctcagggacggcacccagacggtagggagcgcctggtgccccagtggaggtttctcagtttagacagagtcagggtccacacccactccccgtcaaacaattcagatcctgctccgcaagggtggactgcgnnnnnnnnnntgcgcctggtgccccagtggaggacgcatcgcttttctcagttcagacagagtcagggtctaaacccactccccgtcaaaccaactcagatcctgctccgcaagggtggactgcgcgaacccgtgttccgtccgacagacagctccttcctgctgttccccaccgccttccacaccgaggacgacctcctccggccccacgccaaggagcgctacagagcggtgaggcacgtggcggatggggcagaagggcatgtcccctggacagcaactcagggtggccgtgccttgggggggcctgtggcggcggcggtgacggacaccttccccggtggctgcggcctccggctgcctcccccttcccggcagcccccgcccctccaccaagcgcaggccctggcatacgaccctcnnnnnnnnnnccctcccccttccccgcagcccccgcccctcgaccaagcgcaggccctggcatacgaccctcgcagcgcccgccacctggagctggccacgggtgcggtgctgacgggggcctggacgaccgcggaccccgccgtcctgcagctgctggccgactttcacatctgggcgccgcgcttcctggatgcccggctgaggtggcggccgcgccagcccatcaccgtcctggagctgcgcgccttccggtgagcagtgcagggcccctgcagcatgggtgtcgggcggtgagcaggcgcgacgccgcctgcccgggccaggcgtgtgccgagcgcgcaaacccacaccctccgccccgctccgcccaggctggccacccccgcccgcctgtccaccgccggccccgacgtcttcggctgctnnnnnnnnnnctgggtgtcgggcggtgagcagtgcagggccgcctgcccgggccaggcgtgtgcccagcgcgccaacccacaccctccgccccgctcggcccaggctggccaaccccgcccgcctggccaccgccggccccgacgtcttcggctgcttctcctggctgcgcgacgcgcctggcgcgccccagggctggctcccctccagcacccccgccctggacgacgtggcctttgcggcgcggcagctgcgctgccgccgcctcctgtcggcgctcacggccgacgaaatctgcggggacctggtgcagccagggaggctgggcgcgctgtaaagcggacgggacagcacgagcgctaaggttacagtcgagggaagggagtctggtgaacgatgtcgagtgacctggggggttgggggggcagccagggtggtgctgggggtatcgggtgggtggcctcagggagagcgcgcggtttgggcgagggcccccccatggcgggcccggtctgtcaagtcgggtcggaggtcgacggcacagagcggccaaccccgcggcaagaaggggagcgcacgccgcgccgcccagcgccgcctccacccgcgccgcgtcgcggcgagcggtgccgcccccgctccccgtcacagcgtgccgggcttctgcgcgttgatgatcttcatgatctcctcgcactccatctgctggcgggggcaggcccaggcccgccccgcgctgttggagtcggggtggtacaggcgcagcgcggtgcggtaccgctcgcgcaggccggcgccgcgcgcctcgggtaccccaaagcgcgtgagcagctcctcgaagcgccgccccgcggccgccgcctggtgcttggcgcggaagaaggcgcgccagtcgccctccggcgcctccggcccgggccgggggagggaggggggcgggggcgcccc

SEQ ID NO: 36544 - DNA, 71 bp, Chlorella protothecoides
gtaacactgctctggatgtgtgtgatccctctgtgcgcaaatcagcggacctttcgtccaacagccagttg

SEQ ID NO: 36545 - DNA, 180 bp, Chlorella protothecoides
cggtcgtacgagacaaaggcctcctgtatggagggaagggagaggcagtgcgcatgtggaagggggggtgggggagctgcgctgggctcaggcatgcaagttgcatggcgtgaagcaaagcgccgcacgactcgttccagagacccggcggcagggcatcgcacgatcctggtgactcta

SEQ ID NO: 36546 - DNA, 61 bp, Chlorella protothecoides
atgggtcaagcggggcgtcaagggcccagagagcatcgcggatcacatgtacaggatgggg

SEQ ID NO: 36547 - DNA, 61 bp, Chlorella protothecoides
cacccctcgacacgccatgcccatcccggcacccaccgattcgccgagctggtcaaataac

SEQ ID NO: 36548 - DNA, 67 bp, Chlorella protothecoides
aatcgctttggtggtgactgttgcaatacaagggggaaatggatgagaggggcatgcggtgccttca

SEQ ID NO: 36549 - DNA, 61 bp, Chlorella protothecoides
gcaccgctgtatgaagagaaggggggggggggggaatttgaagtacgggtgtgaggcggtg

SEQ ID NO: 36550 - DNA, 61 bp, Chlorella protothecoides
gccctgctccaccaggtcgatgacgcggcccggcgtgcccaccaccacgtccacgcccgcg

SEQ ID NO: 36551 - DNA, 61 bp, Chlorella protothecoides
aatgaggagtaaccatgtccagagcggaggtgaggtcttgtgggagggatccctgccatcc

SEQ ID NO: 36552 - DNA, 104 bp, Chlorella protothecoides
agtgctcccatcccaatttgaaccttgcactccgtgcgcccacctcatgcatgcgtgcgctgtgcagcgccgatgagagcagggcgccgcccaccaggtagaag

SEQ ID NO: 36553 - DNA, 436 bp, Chlorella protothecoides
  modified_base (116)..(256): a, c, t, g, unknown or other
gccaaaggacacctgggtgcccagctggaaatgggtcatgtgggaggcgcggggcgggggacggctcacgccaggcgtgtagtcgaacacgtactccgaccggcccttgaccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtggggcaggtgccagagtgcaagggatggtgcaactcctgggcaggggcatcttgtgctctgtccattgccagtccacttgcttgtcatcacctcaagccggtacatccgatgcatgcacacatcgcaaccatcctttcccccctctaacacacctgctccacgaggcgctccagg

SEQ ID NO: 36554 - DNA, 68 bp, Chlorella protothecoides
ggcaactggtcggcccaggaccggggggacatcatgcagggggccccgccggggccttggatccgctt

SEQ ID NO: 36555 - DNA, 61 bp, Chlorella protothecoides
gaggccatactgatccccatgcccctctggatcgaggccacaccagccccacgccagcctc

SEQ ID NO: 36556 - DNA, 76 bp, Chlorella protothecoides
tccgaagaccagaccaattctccaagcccctcatgcctattccattacaaacctctgatggaaggggcatatcgtg

SEQ ID NO: 36557 - DNA, 75 bp, Chlorella protothecoides
aaaccaatggcgccacttcacctgttctcaacctcagtttgaagtcctaatacatcgccaaagagccacattctt

SEQ ID NO: 36558 - DNA, 61 bp, Chlorella protothecoides
cagcagcgccacctgctcctgcagcccacggaggttctgcagcagcgcctccacctccgcg

SEQ ID NO: 36559 - DNA, 79 bp, Chlorella protothecoides
gtcaggaacgcaccttgcatcacattgatgattacctggcagtcgtagccactgtcatgcagaaccatcatcagatctg

SEQ ID NO: 36560 - DNA, 61 bp, Chlorella protothecoides
cggtgacgaccctgtgtccaagagtgaaccagctcagggcaccttgaacactgacatcgca

SEQ ID NO: 36561 - DNA, 63 bp, Chlorella protothecoides
cgccaggaaatccccgcccccacccgccaagacgtctccaccgccgccatccagacagtctcc

SEQ ID NO: 36562 - DNA, 194 bp, Chlorella protothecoides
gcatcctgaagttctgcaagctccatcctatacatgatgacacagccccttctgtgcacgtagatacctagcattcctctcctactcacccccaggctgctaccaatgacggcgccatggatgccggtctgaccccagcccaggcagccgatgccctgggcctcccgatgccaggcagcggcccctacacgccc

SEQ ID NO: 36563 - DNA, 127 bp, Chlorella protothecoides
cacggcccgatcccactccgttcggccctggcatgatcatgagacttcggagcgaggggcccgcatacgcacagtccgaacaaaaccagggggaagggagatctttttggttgccaccaggttctcc

SEQ ID NO: 36564 - DNA, 61 bp, Chlorella protothecoides
ggttcctgcaccactccgagccgcccaccgtgggcacacctgggtgtacaggatgccgtcg

SEQ ID NO: 36565 - DNA, 61 bp, Chlorella protothecoides
ccaccctgcacacccgccgcaggcgccgcaggaagcggatccaaggcccaggcggagtccc

SEQ ID NO: 36566 - DNA, 67 bp, Chlorella protothecoides
gagaacagcgggtctggaccgagatcgacgcagcaacctgcacgcgcggcgctggcgtgaggggggc

SEQ ID NO: 36567 - DNA, 68 bp, Chlorella protothecoides
ctaggttcctcttcctgtgtgtggaggaggggtcccagacttgctcatgtttgttcaggagcttatcc

SEQ ID NO: 36568 - DNA, 612 bp, Chlorella protothecoides
  modified_base (117)..(126): a, c, t, g, unknown or other
  modified_base (378)..(387): a, c, t, g, unknown or other
ggcgtgggggaggttgagtgagggggttgggtcttggggggggttgctggcgaggagtggggatgtcgctggtgcagaggacagcggtacagggctgagcagtggggtgtgtccggnnnnnnnnnnttgggggagttgctggcgaggagtggggatgtcgctggcgcagaggacagccgtacagggctgagcagtggggtgtgtccggcttgcgcctgggacggtaacttcccagggaggaaggtgccgtgcgtcagaggcacagccccctcagtggcgtcagacccgacgcctcaccataccagggctcttggcaaccagtggcccagcacgcgcccataccccacgccacccgacatcggccatcccaggccggcnnnnnnnnnnacagtggcgtcagacccaacacctcaccataccagggatcctggcaaccagtggcccagcatgcgcccccttccccatgccacccgacatcggccatcccaggccggctgcacagcgagccccactcctggaggcaaccaacccggcccctccccccctcacacctgagcgacgagcgtggcgaggcggacgtcgcccgccgccgcggccgccgaggcggcggcc

SEQ ID NO: 36569 - DNA, 81 bp, Chlorella protothecoides
attgcactttcaatggaaagcctcctctgtagtttactgtgaacgtattggtgctgactccagttgccttttccacacgct

SEQ ID NO: 36570 - DNA, 61 bp, Chlorella protothecoides
gtctctggcacagcgcatgcaagagcagcaatcccacctatcgatcgaggtgtcatataga

SEQ ID NO: 36571 - DNA, 108 bp, Chlorella protothecoides
atggggaagagggggaggggcagtagccagggggagcaagggggggtgggagtgggggaatgtgggtggggacatgcccctattggtccgcaggcagcgcggagcgag

SEQ ID NO: 36572 - DNA, 500 bp, Chlorella protothecoides
  modified_base (186)..(403): a, c, t, g, unknown or other
ggagtggcaaggtggcacagggtgccataccgttcccccttgaacccattatactcgtcacctctggtgtgtcgccctggattccataagtaccccgcctgaactcagaggcgcccaacagtggatgcatggggttcacagatacccagccccctctgcagtacgcagtcagtcgctgagcaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtactccggtgcgcggccgccggcacgcacggcctcgatctcgcgcgcaaagcgctgccagagcgccgcctcctgcgtcactgcgttcctcaccgtc

SEQ ID NO: 36573 - DNA, 61 bp, Chlorella protothecoides
tcctgatgaatcagagtcatgtatcactcgacctgccgatgtgcgagccgcccttgcatcc

SEQ ID NO: 36574 - DNA, 427 bp, Chlorella protothecoides
  modified_base (172)..(330): a, c, t, g, unknown or other
cgccgcggccgcggccgcggccgcgggggccaagggcgcgctggatgtggaagggggggcgcgcggcgcgggaccacgggaggggtcctcgggggtcatggccccacccccaccccccgcgcccaagtccggcctgcaccacgtcaccgtgcactcggcggctggggggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggcggggggctcgtccgatgcttcgggcgccctgtccacgctggaggccacgtcctcggggcggggcgtgccgccggacctggcggcgttgacgc

SEQ ID NO: 36575 - DNA, 92 bp, Chlorella protothecoides
ctccaacccccggcaatgcatggggcacagagatgtcttggtcggattactcgggctccacggagtccgatcaggcgcggcgcgcagcacag

SEQ ID NO: 36576 - DNA, 62 bp, Chlorella protothecoides
caaatacacagggccccacatatggtgcaataacgagggaaagagttcacaaggtgttgctt

SEQ ID NO: 36577 - DNA, 105 bp, Chlorella protothecoides
cctgaaggttggaaaggggggttgggggttcaaggggtcgcgaaggtgagggctgtcacagtagggaatccgcggcgtcagatgcgacttcccaggccctcagct

SEQ ID NO: 36578 - DNA, 137 bp, Chlorella protothecoides
tggttcctagccacaggctgcggtcgcggccagaggtccgagcatgagatgctcatcagaaaaactttctgtacaattgcaggcacggacggaagctacaatgcggccgacagcagcgtcaaggtgaatggctgtgg

SEQ ID NO: 36579 - DNA, 61 bp, Chlorella protothecoides
gctctgtttcccattcggtggtgcggcaggggtttgatatgaatgacacaccagcgtcaaa

SEQ ID NO: 36580 - DNA, 112 bp, Chlorella protothecoides
cggagtgatgcaagccgctcaccaatccgagagaatactcacaagatctgtgcttaaatctgactgatacactccttgtgtacttgtcaggcgatggaggtgcggtcctgtg

SEQ ID NO: 36581 - DNA, 61 bp, Chlorella protothecoides
gggttctcgcacgggccataatcttacttctcagatgccatggcccgcaagccctggtccg

SEQ ID NO: 36582 - DNA, 99 bp, Chlorella protothecoides
ctccagagaacttgctacccctcattctcatacaaccctgttccacatctgcaaaatcgaggcctaaaccccgctcaaccccacctgcgtggcgatgcc

SEQ ID NO: 36583 - DNA, 94 bp, Chlorella protothecoides
gggggagggggaggccaacgcccaccaaggcgctgagctgggtgtccaggtggtcccgcgccgcacctctgtgacaccccgcagcgtctttgac

SEQ ID NO: 36584 - DNA, 61 bp, Chlorella protothecoides
tgatccactgcacgggcaatggggcgggggcgggtgagtggacggtcgaaagggctctgcg

SEQ ID NO: 36585 - DNA, 77 bp, Chlorella protothecoides
gccagctcggccgccagcgcggcgtcgtgcacggcgcgaagctcacccggccccgtgggggcggtgaggaaggtggc

SEQ ID NO: 36586 - DNA, 80 bp, Chlorella protothecoides
gccgcagcggggggaggtgagcggcgaggggtttgtggggggagggggcaaggaggagctcctcggcttgaaggggcttg

SEQ ID NO: 36587 - DNA, 137 bp, Chlorella protothecoides
gagcctggagcccagctgtgatcttcagtcacgaatgctgagttgcatgcttgcctgttgctcaatcctccacctaccgttgatggcccaaactttcttgatgcacaatgtcaagttttctccagcgacggtgctgt

SEQ ID NO: 36588 - DNA, 61 bp, Chlorella protothecoides
aggagtattatgtctgcgagtggtcgcagcacccggccacaaaggagccctggctgctcgt

SEQ ID NO: 36589 - DNA, 69 bp, Chlorella protothecoides
aaacgcgcgcccgcgccggcccgacgagccggcaccagacacgcccacgccgctgccgccgctgccgct

SEQ ID NO: 36590 - DNA, 61 bp, Chlorella protothecoides
ccttcgacactctctgccgcccccttgcatgcgcctgctcctctggggcccggtgacgtcg

SEQ ID NO: 36591 - DNA, 71 bp, Chlorella protothecoides
cacagcgacctctgaacagggcatgataaaagaacccccttgtcacttgacgccggccactgccttggcgg

SEQ ID NO: 36592 - DNA, 13997 bp, Chlorella protothecoides
  modified_base (487)..(496): a, c, t, g, unknown or other
  modified_base (735)..(744): a, c, t, g, unknown or other
  modified_base (1332)..(1341): a, c, t, g, unknown or other
  modified_base (2766)..(2775): a, c, t, g, unknown or other
  modified_base (3061)..(3070): a, c, t, g, unknown or other
  modified_base (4368)..(4377): a, c, t, g, unknown or other
  modified_base (4457)..(4619): a, c, t, g, unknown or other
  modified_base (5585)..(5594): a, c, t, g, unknown or other
  modified_base (7364)..(7373): a, c, t, g, unknown or other
  modified_base (7619)..(7628): a, c, t, g, unknown or other
  modified_base (8322)..(8331): a, c, t, g, unknown or other
  modified_base (9366)..(9535): a, c, t, g, unknown or other
  modified_base (9616)..(9625): a, c, t, g, unknown or other
  modified_base (11483)..(11492): a, c, t, g, unknown or other
  modified_base (12080)..(12089): a, c, t, g, unknown or other
  modified_base (12471)..(12480): a, c, t, g, unknown or other
  modified_base (12555)..(12564): a, c, t, g, unknown or other
  modified_base (13168)..(13225): a, c, t, g, unknown or other
cgccggctgggagcaggtcgcgcgggcgctgcgggagaactgggcgacgctgggggccgagcgtgggtgcgccgcgctcggcgccctggccggcgcgctggcggggcagccggcgggcgccgtggcggcactgactacgctgctcctgggtcccggccaggcctgccctgcggccctgcaggcagacgtgctggccagggccaggctggctgctgacgtggccccggcgctgagcagcggggcctgcgcctggctgagcgtgcgggcgtgacgcgggcaggggagctggtgccctgttgtgccatgaacaatcgtgtccagcggcgcaggctaggtccccattacatgattccaatagactgcctttcctggtcattactgctgggctattgggcacgcaaaagccgggcagcttcatgagaagcacgatcgttaattttcccgtgccatggtcatttggaggacgtgaaaggccgcgtcagcacgnnnnnnnnnngtgttattttccccgtgccatgatgagtcacttggaggacgtgaaaggccgcgtcagcacgcggagaaatccagtgcgctcgagtactgggggaaggcctgtcagccatcccccaggtgagggctgcatgcgtcctccaggatctccaaccgctctttcaacgttgcggcattgccaaaagccttccagggggccatgcaccaccgatgggaatcttcaatccgacgtcgggactggtnnnnnnnnnntttccaacgttgcggcattgtcaaaagtcttccagggggccatgcaccaccgacgggaatcttcaatccgacgtcgggactggttccgcatggatccccggcaacgcgttcgaccccggccccaacactgtttgtcttgtggtgggcgtaagagtgccagcccagcgtccctgccgtccttcacaccctaacatccagatcgacgcgcacgagccactggggctctcacccaccatgagcgccacctggctccccgatgcattcgccaccatcttcaccccggtagcggcaacggtgtccgtgctgtttgccctctggctctggtaccgtgtcagcctcattaaggtgagggtatggggaattgacgtgcgcctgaatgccaagggtcgagggactgggtgcgaggccgcccccccaccacaacgccatcaggccgtggcccggcgggcccccggcgggtcaccccttgtcgagcaccctcaagaccccggtgcatgatcttcgaatgcacctgcatgcaatgcgatggggatcgtgtggggttagtggagtcgcgtcccgccaccgggtttcggccccgatcacccnnnnnnnnnntaaggccctggtgcatgatcttcgaatccacctgcatgcaatgcgatggagatcgtgtggggttagtggagtcgcgccccgccaccgggtttcggccccgatcaccctcgttcccccccacggcccgctgatcctgcgcgatccaccctaccccatccaacaggttcgcggcggcgccagctccgggaactccaacggtcgcgagtacctgctggaggaggagcagcgcggcgaggccgagatcgaggagaaggtggccgacctgcaggtggccattgccgagggcgccacctccttcctgttcaccgagtacaagtacgtctcgttcttcatggccggcttctccgtcttcatcttcgtcctgctcagctcccaggacgggttcaagaccaagtggcaccgcgacgagtccggcgtgctgcgcgccccggccctgtacaacggcgccttctccaccatcgccttcatcgtgggcgccgccacctccatcgtctccggctacctgggcatgtccatcgccacctacgccaatgcgcgcacggcgctggaggcgcgcaagggcatcgcccccgccttcatggccgccttccgctccggcgctgtcatgggcttcctcctggccggcaacgcgctcctggtgctctacctcctcctcgccgtctactcccgcgtctttggcgacgactgggagggcctgtatgaggccatcactggctacggcctgggcggctcctccatcgcgctgttcggccgcgtcggcggcggcatctacaccaaggccgccgacgtcggcgccgaccttgtgggcaaggtggagaaggacatccccgaggacgacccacgcacccccgccgtcatcgccgacaacgtgggcgacaacgtgggtgacatcgccggcatgggcgccgacctgtttggctccttcgccgaggccacctgcgccgcgctggtcgtctcctccgtctccgccctgggcgtggaccatctgtgggtggccatgaacttccccctgctcatcaccggctccggcatcctggtctgcatcgccaccacgctgctggccaccgacctgcgccccgcccgcgtcgtggccgagatcgagtccacgctcaagctccagctcatcgtgtccaccctggtcatgacccctgtggcctacctcctggccgtcgccgccctgcccccgaccatgaccggcctcttctccgacgaccccatgcgccccgtcaagaactggtacctcttcgtctgcgtcgccgcgggcctgtggggcggtctcgtcatcggcctggtcaccgagttctacacctccaaccgctacgcccccgtccaggtgagcgggaggaggcgggaggggtggggtggctgtgcgtggtgctgtgggtgtgggacggtggtcgacgcccagcggcgctgggaagcgtnnnnnnnnnnacgggaggggtggggtggccgcgcgtggtgctgtgggtgtgggaccatggtcgacgcccagcggcgctgggaagcgtgggtcggtcgacgcgtggcgctgccgacacccgagggtgctccttggccccctgagatcaggagacctacccttctccaccatgtcggttctcacctcactaaatcaaacccaccgacatacatcccccaccccaaaaatcaaacatcctcacgatcacacaggacgtggccgacgcgtgcaagaccggcgccgccaccgacatcatcnnnnnnnnnntgcgtggcgctgccgacgcccgagggtgctccttggccccttgagatcaggagatctaacccttctctgccatgtcggttctcacctcactgaatcaaacccactgacaaaacacccccccaaaaataaaacatcctcacaatcacacaggacgtggccgacgcatgcaagaccggcgccgccaccgacatcatcttcggcctggccctgggctacaagtccgccatcatcccctgcctgaccatcgcggtgaccatcttcgtctctttctccctggcgcacatgtacggcatcgcctgcgcggcgctgggcatgctgggcacgctggccacctgcctggccatcgacgcgtatggccccatctgcgacaacgccggcggcatcgccgagatggcggccatgggcgaggacatccgcgagcgcaccgacgcgctggacgcggcggggaacaccaccgccgccatcggcaagggcttcgccatcggctccgcggcgctggtgtcgctggcgctcttcggcgcctacatcacgcgtgccggcatcaccatcgccgactcgtccatcctggacccagaggtgttctccggcctgctggtgggcgccatgctcccctactggttctccgccatgaccatgaagtcggtgggcaaggccgcgctggccatggtggaggaggtgcgccaccagttcaacaccatccccgggctcatggagggcactgcccgccccgactaccgccgctgcgtggagatctccaccgccgcctcgctgtcggagatgatcccccccggcgccctggtcatgctcacccccatcgtggtgggcgtgctgttcggcgtgcgcacgctggccggcgtgctggccggcgcgctggtgtcgggcgtgcagatggcggtgtccatgtccaacaccggcggcgcctgggacaacgccaagaagtacatcgaggcgggggcctcggagcacgcgcgcgagctggggggcaagggctccgacgcgcacaaggccgccgtcatcggcgacacagtgggcgacccgctgaaagacacctcggggccctccctgaacatcctcatcaagctcatggcggtggagagcctggtgttcgcgcccttcttcctggcgcacaccgccgacggcctcatcttccgcttcttcaagtagaggcaaggagggttttatgtgcggggtgggggaggtgctcgggcgagaatgcgcgcgcgcaccctcccgtgcgacgatccccccaccgccctcgtgtgcgagagtcgccggcctgctgcgactgcaggactgtnnnnnnnnnntgcgcacaaggctgccgtcatcggcgacacggtgggcgacccgctgaaggacacctcggggccctccctgaacatcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcaagagtgcgcgcgcgcgcgcggcctctcccatgcgacgatccccccgccgccctcgtgtgtgcgggtcgccggcctgctgcgactgcaggactgtctttaatgcaaacctgttccgacggacgagagatagaagggggggagggatctgtgactggcttttcaagtctggagggcgggacgaggcatataggtgggccagacatgcagcgtggacctgcatctcaaacggcgcaggttgccgtggcggggtgggaaggctgggaattggacgaccaggggatgaagctggtgcttgtttgtggcaatcgcaaatatgcgagtgcaatccacgcctccttgatgtgacccacgctggacattacgtggcacgttcaaccatatcccacccaaatttgcatggggcagggagaatcgcacggggcaagaccagcttgtctgaggccctgacaatctgttgtatggcagacatacttctcactgtggttctgaaaagactaggacatcatttacaggcgctgcacacttcgtgcacgattccaaaggagtttcccaaggtccaaagtggcgctggggatgcgtgcgagatggacacagcatggcgtttcccatcgcccagacacggtgtcttcccaacaagacaggcggaccctacccaattcagtgcataggctgagactttgcacgtctgaatacccatctgtgatccatgcagctcggtggagagggcagattgtcgtactgaacgtcgctgcgtacagttccagatccgcggtaccgattgcgtaaaccgggcggctgagcggcggagaggccccgataagcatcacaaacatacacaggcttcatattctccgtcatggcgtggcggaatgacgagattattctggtgatatgcccctcgcgacgcgaccccgtcgcagctcgagaagattttttgaatgcctgaatcggatcgcccgnnnnnnnnnnagcggacaggccccgataagcatcacaaacaaacacaggcttcatattctcggtcatggcgtggcggaataacgagactagtctggtgacatgcccctcacgacgcgacccccgtcgcagctcgagaatattttttgaatgcctgaatcggatcgcccgtatcgacggcaagcacgtgccagtgcgcccatacatggcgagcatgttgtcaccccaagagcttttaccgagcgatcttctatgcatggtgggaagatcccgccttctcctgctccgatcgggccgggttcagcttgctccgcaaagacctcgccgtgccagctccgacagatgcacccccaaagcaggcgcagcatcaccggatcgagccggctgggccccgggtcccccgctttcgacagagtgtcaagttcatgcacggccaatcagtcgtcctgaaacacaccctgtcacatacagtgcctggatctacccgaccagactctctgggctctgcgaacccggggtgctggctccgctctcctcctgaaggttccccgacgtggagcacggtggacccccagcagcaccatcattcccgcgcgccgagaccccagccaccactccgggtgttaccctagtctcgaaggcagcgttgcatccttgtcatggctgcagtgcagaagggcgcgagaagccgcccggtgcgtaccactgctgcgaacgtcgcccgctacagtgcagactaccccaaggacgtcagcaacggctactcctacaaggaggatcaggtgagtcagcaccgagggcgagccgtctgccccgcctctacgccctctttgaccggacaaggcgccctctccaccccacgcagtacattggcgggagcgcggacggcaccgctccacgggtggatctcaccaagctcaaggtgagtggcctattccacgggcccgggacctctcgctctcatgtgcacccgtctggacccggtgcactgtgcgtgagggtgcctggggaacctggctggaccccacaccccatgccccacccggtctcctccccaggtgcacgcgctacgcaagtacaccaaggtgtacgaggtgcccggcattggaccgcagagcagcaaggaggacctgacgagcgccgtcagcaagcactggaacacgatggtgagtcgcgatggctgcgagtggtggtgtgaagaggagggaatggggccgtctggcgaggtcctcgcagtcatgcccaattccagccccttgcagcgcctctgcgtggccctccctgcagcgcctgtccggagcttgcttacggtccttccaccatgtcaccaccccacttccccccttccccccgattttccagaccgtcagcgaagaatccgtgctgcagaacttgatgcgggttcgtggcaggcactgaggcccctgtgcactgcggcaaatgcgctcggttgagctccatggttgtgggcgtcctggccatcgtcccctcgtcaccaacatggggctcatgtttggcaaaaccccccccgctcagccaatgcgctgccccattgaccccgaacgcggatcccgggtggggccaggctccccaccccttccccgccttatactgaagcttgacccttgacacgaccttgtcacgagttcctacacaatcgcaagtctgggggaagaagggtggcagacacaggggaatggtttgtgcccagagtctctatgggacaatgactggggcagtgtctgctgatatgcacaagtacaggggccgccgatggagtgnnnnnnnnnncgtgcccagagcctctgtgggacaatgactcgggctgtgtctgctgctgtgcacaagtacaggggccgccgatggagtgagcggatggcatccagggacagcggagggtgtgcggagttccacaccgaacgtggaaaggccaggttttcctctgcgccatgcgcctctgcgccctcataccatggacgtgccccggagcagcgggaggtgcaccggcgcgcacctccaccgcgcccatgccacccnnnnnnnnnnaggagagcggagggtgtgcagggctccacaccgaacgtcaaaaggccaggtttgcctctgcgccatgcgcctctgcgccctcttaccatggacatgcccaggagcagcgggaggtgcaccagcgcgcacctccaccgcgcccatgccaccccaaacgtgttcacatctccgggaacgtccgcgccaggggcacccggaagtagcggatgcagagcatggtgcccaagccgatgcccatggacagcaggtcgctggtgagcgagaggccaaccaccgtgtccctgcaatggccagggggaaagaaagggcgagcagggcctgcgcaccggcgttcttgggtccaatggaggcagctcccttgcgccagcaccggcaaagggcgttgagtctccgccttcacccacacgcacactcatgccatcgatccccacccacccctcgcaccacatgttccagaccccccgccagaagaggatgacgccggtcaccgccaccagcgtgcccaggttggcctggaaagcagggcaaaaggggtccttcatggtggtgcggcgtgccggatgggtggttgctgctcgtgcgcgggcagctgccggcggtgcacccttcctgcacatgtgatgccggacatcagatggccactcccgcatcctctccacccatgcgcccctctcaatcaacacctccactccannnnnnnnnngaggggtatttcatggtggtgtggcgtgccggatgggtggttgctgctcgtgcgtgggcggctgccggcggtgcacccttcctccacatgtgatgccggacatcggatggccactcccgcatcctctccacccacgcgcccctctcaatcaacacctccactccaggcaccttgacatcaaagtgaatgttctggtcttctatggcggtgtgcacggcagccgacatggcgtgctccaccgtgccctccaccgccaccgcaaccccccgagccaccaccccagagagatactccatctgccacgggtgaaggggggttgaggagggtcaaatctgctgccgggcattcatggtgtgtcatggaaattcttctctgaggcatagctcaccccaacccagtgtcatgcaccctgtcatgtaccacacctctggggagggcttggctcctgcccctccatccgaggccaggcccataccctgcatcgcgcctagcagctggaggatggatgcatgggacgccggtattggccaagagtaccgagtatcagaattccatagacccccctcacaccctagagcattgcgcgaggcaaagcgcggggttggccccatgccaaacccatccctaccagccctacgcacacgggagtcatctggggtgcgatccaggctattctcgggggcatgctgcatgcgatgagtcagccatgttcccgatgccgtgctgctgccgttctgcagggattgcaggagccccgactcctcgtcacggaggtgctgcgagggcatgccctcgctgaggactcgtgcccagcgatgccgatgctgtctgggccggtgtgagcgggaattaaatatgggtgttcttctcacggcgcattctgatccgtgcacgtcccttgtgcgggttgtataatcgggcccctccccggcgggagtcaaaccgaccgccgaaacccttgctgcagttttccccctgatgtcccccggtcccccctgtaccttctctgtaaatctctccatgactgatgtcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaggattattgcgcggtgcccccccacggggccggccctcggccccgatcacgcccacttcccgatcacggccatcacnnnnnnnnnnatttcccccctgatgtccccctgtcccccctgtacctactctgtaaatctctccatgactgatgtcgccattacatactctgagcacgactgacacaggctacgggtagaagacactggattgggagacaaatgcgctgatgttggcccatgtgggcgtcccacttttttcctcaaagaatgggtttgatgtggtgatgcgacagtgttgccagccggggctggtttgggattgcaggtcaaaggaacaaggattattgcgcggtgtggccccacggggccggccctcaggccccgctcacgcccacttcccgatcacggccatcaccgcaaagccgccatagagggctgcgaagctgagcagcttgaccagcagggattgctgcgtcagccacttgttgtgcgtgaactggggggtgatgagctgcaccagggccacgtagatgaggatgccggcggagacggcgtcgaagatgccctggaccaggagcgtggtggcgtcgttgccattgtaggtctggcggatgccgatgccaatggccacgccgatgggggtggtgagggagtagatgagccctaccacgaagagcttgagcccgttgagccgcgcgtccacggcggtgaagccgatggcaaagccctcaaaaaactgatggaaggagagcacgatcatgagcgtcttgaactgggcgccggtggagacgccgagggtgatgccgatgaccacggagtggaagacgatgcccgcctccatgaggtacacgctggccacgcggctgaggctggtgcgctccgcgtcctcctccgcgtcctcctccgagtgcgagtgggagtccttgcgcagcggctgctcaagcgcgcggcgcgccgcgctgtgggcaccgccgcccgtcccgcccagggccatgccgcccaccgcgccgccctggcccagctccagcgcgcggtcgatgttgcagcaggggtcgccgccggcgaggtcgcccatgcggcactggtactgctgcaccgcaaagtcgaaggcctgcatggccaggatggccagcaccgcaaacagataggcgtacgcctcgtacgactcgttccaggaggcgggcaggcaggccgaggtcagcgcctcgttggcgggctgcagcatgtggatgaagcctgtggccagcaccgtgccaaaggcaaagaaggtgccgatcctgggtgggcgtggggggtggagaggtgggggtctagagtggagggagttctggaggatgggaatcgtgttgctggactgaggattcctgggtgctggtgacggataggcagggggatgtcgccatgatgtgcgcgcacgcccaacacacagtttgcaccccaaaccgcccccttaaccacgtacttgagggctgtgcggaaggtcttggagcggatcacccgtaggaggatggggccaaaggcgcccagggcagagacggccagcagaatgaacaccgcgccgatgtggatgcccatgttgtaatcccccaggccctcgaactcgcagccgccctcgtcatcatcgactgcaggaaagatgggttgagggggtaggagattgggggttgcacggtaggaaagggcatggatgcttaattagtcggccgttggtcacgtgaatcgcaggtttccctgccctacacgctcagaagcccggctccatactcacgcaggcgcctgaaggccaccgcggtgtgtgctctatgcatggaggcgggtttaacacagaatcggagggtgaattgtaagggtgtggcccggaggtcggcgcgagccggctgggtgtacgagcaagggtagggcacggcgtcgacgtaattcgagcgggggcgagcacgggggtgcgnnnnnnnnnnctgtaagggtgtggccacgaggtcggcgcgagccggctgggtgaacgagcaagggtagggcagggcgtcgacggaattcgagcgggggcgagcacgggggtgcggatggcagggcgagtgcttcccgactggtggcgtggggtgggacgggcggtgtgcgaactgtgcggcgtcgaatccccgccgcagcctttggggatagcgcggccccttcaattggtttcccgttcgacccgggtccctccctgggatccccgggattgccccggcgtccccagggaagcgcctgcgccagcacccctgtttccgcgcgtccctcgcagatccagtttttctggccttgtatccagacgccatactttgcaactcggggttgaaatcgaagacccagtaccgggaatgtaagtacaagtggttgacctgcatctgtacaaggtgagcccagctcgggcccaggggcagcgccagtccgaggcgcggcgatggcgccgcgctcgcatatgccgggcttggtgtgcccagcaggttctgtgctgcactcggcgagcagcacacctacgcgagtggcgctggggatggggtctgggnnnnnnnnnnggcccgggcccaggggctgcgccagcccgaggcgcggcgatggcgccgcgctcgcagatgccgggctcggtgtgcccagcaggttctgcgctgcactcggcgagcagcacactgacgcgagtggcgctggggatggggtctgggagagagctcctcgctctccccacgagccgacggggagcctgccgccgccgccccacacccacgccatgattctccacccccttcggcccatttcacttctccggcggcttgaagttgaaggcgtgcacgttcccgctctccacccccgcctgcgggtcgatggcgacgttgatcaggctgggcccgtccgaggccagcgcctcgcgtagcgcggcggccagctcctcggcggtgcccnnnnnnnnnntgacgtcgatcaggctgggcccgcccgaggccagcgcctcgcgcagcgcggcggccagctcctcggcggtgcccnnnnnnnnnnaaaggcctgcgccagcaggtcgtagcgcgagacgggggcgaagtcggtgggcacggggtctcccgcgtggcccacggccgccagcccccgcgccgcggcggcgcgcagctcccgcccgcggcggtcgccgccatagatgccgccgttgttgaagatgatcagcgtcaccggcaggccgtagcgcacgatggtctccacctccatgcccgagaagccaaaggcggagtcgccctccacagccaccgtcgcgcggcccgggtcctgggtggccgaggcgatggcgtagcccagccccacgcccatggtgccccaggtgccggcatccagccgagtgcgcggcacggtcaccggctccaggagcaggcgcgcgttgtccatggtgttggcgccctcggccaccaccagcggggggcggggcagcgtgcccagcgcgccgcgcaccacgcgcagcgtggtgccgtagtccagcgggtgcgtggtgcgcgccaggcgcgcgcccagcttctcccgcgccgccgcggacttggccgccaggcgcgacgtccagtcgcgccactcggggcggggcagctccgtgcctgtgtgtatttgggggggggggggnnnnnnnnnnnnnnnnnnnnnnnnnnnnnnnnnnnnnnnnnnnnnnnnnnnnnnnnnngggagaggtattgagtgggtttgggggtggtattcagtggggttgggggaggtattgagtggggtgggtgaggacattgagtggggttgggcttgggtgggtggagttgggaagagaggaggaaactgcgcaggggacaagtggactttgaccccgcgggaaagcacggcttcgacgagggcggaggggtgccagggggagcggggtatcgcctgctcacactccattgcagcagtcgtgtttcgaccatcgcgcgccatttgcctgcccaggtcccgccgcgtccatccagccctttttccccgccccagcccccgtggcaccaccaaagcatcacccactccaatgccccttccttggcccccccaaccttggagtgcatccaggagctgcccggcgaccacgccggcgtcgccgcgcaggacgaggtggctgacgcgcgcgtcacgctccgacggctccaagtccaccagcacgaacttgacgtcggcggcccacttgggcgcctcgccaaagtgcagctgccagttgaggcgcgcgccgaagaccagcgccacgtcggcgccggccagcgccagggaccgtgccgcgttggcgctgtgctcgtacgtgtcgggcaccaccccccgccccatggccgtgcccaagaccggcagccccgcgccgctggccagcgcgcgcagcgggccctccgcccgcgcccaggccgcgcccttgcccaccacgaggagcgggtgccgggcgccggcgagcaatctggccgcggcggcca

SEQ ID NO: 36593 - DNA, 64 bp, Chlorella protothecoides
gacacaacacaagatgctgccgagataaagtgacaggtactattgccaccgcgctcccaggagc

SEQ ID NO: 36594 - DNA, 147 bp, Chlorella protothecoides
gccggcactcagagggattgcagtggcagcgcagatgccatcacaagggtgattggacttgtgcagcaaggcatggggtttgcaggctgcgtgagcagcaagcttggcaatcacatgcgcacctcactcctcgtcatcgtcatcgtc

SEQ ID NO: 36595 - DNA, 78 bp, Chlorella protothecoides
ccgcagctcactgccgcggttaccccccaagaacacgcatcacagccttcacagccttcacatggccatgtccttctc

SEQ ID NO: 36596 - DNA, 61 bp, Chlorella protothecoides
aggcggcagacgcgggggcggcacgcccgatacgataggtatgtaggcattgcggcccgag

SEQ ID NO: 36597 - DNA, 61 bp, Chlorella protothecoides
gagtccgatcaggcgcggcgcgcagcacagacccgccgctcaccagctcgttacgcaggag

SEQ ID NO: 36598 - DNA, 61 bp, Chlorella protothecoides
ctgcttcactggatcggctgtgcacaggagggggggagggtaacatggtgggaccgagccg

SEQ ID NO: 36599 - DNA, 79 bp, Chlorella protothecoides
gtcgagctggcagtttgcggggctgcaggagctgtacctgcaggacaacgacctggaagggggcctgccctccgcctgg

SEQ ID NO: 36600 - DNA, 61 bp, Chlorella protothecoides
tcgggcacacaggctgcggcagcaaaggaggctggactgtttgctccatgttggcttccat

SEQ ID NO: 36601 - DNA, 94 bp, Chlorella protothecoides
gggggggaccggaacttgcagtacgaggatactggcgagtacgaggatactggcgagagggatgggaattgctctggatctatctatcaacaac

SEQ ID NO: 36602 - DNA, 98 bp, Chlorella protothecoides
cgctgtagagttcagccagcccccataaaccaacttgccgtctgtcaatacccaccgtctaattaatccatcgccaggtcagcgaggtgtaccgtaag

SEQ ID NO: 36603 - DNA, 111 bp, Chlorella protothecoides
cagcaatccactccgctgcaggcgggcgagagtcaggtgcggccagccgctcctcctcctgctcctccagagggctcaattcgatgggagcggcgggtgcagcgctgggtg

SEQ ID NO: 36604 - DNA, 73 bp, Chlorella protothecoides
ggcggtggtggaggccgcgggcgccaagtctgtgccgctctttcttgtcatggccgccctgcacgccggcctg

SEQ ID NO: 36605 - DNA, 110 bp, Chlorella protothecoides
tccgccatgattagaccttcatgtggatgagggggagtgtcttttctggggtaggggggtgggtcatttaagctgtagggagtgctgaggacgagggggcctgtgatgcc

SEQ ID NO: 36606 - DNA, 79 bp, Chlorella protothecoides
caccctggaggcagccacgatgcgctgcaacccctttagtacgcccgctcagtctctcatccctcacactcagagcccc

SEQ ID NO: 36607 - DNA, 63 bp, Chlorella protothecoides
ggtaggacggttgctgggcccgggggtgtggttgcagggccgggggtggcgccatcgtcctgt

SEQ ID NO: 36608 - DNA, 430 bp, Chlorella protothecoides
  modified_base (96)..(338): a, c, t, g, unknown or other
cctggcccctgcattgttgttgcgggcaaggatccagtaacggagtgcaaaaaaggttgcaaacacctttttcaaagcagcaggggtggcaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggcggctgcagacacagcggcccggatggcgagggccgcatccacgcacccctgctcatcttgcagtgtgagggcgagcctgcgccgc

SEQ ID NO: 36609 - DNA, 78 bp, Chlorella protothecoides
tatcatgatcagcatcacgggcggcggcgacgccccgcccaaaggaccggacggcagactcgcacacccctcggacat

SEQ ID NO: 36610 - DNA, 69 bp, Chlorella protothecoides
tttacgaccaaaagaaacccattcacaaagtaaaaaggaaatgataccacaacgtgccgtcctagccac

SEQ ID NO: 36611 - DNA, 17112 bp, Chlorella protothecoides
  modified_base (531)..(540): a, c, t, g, unknown or other
  modified_base (1227)..(1236): a, c, t, g, unknown or other
  modified_base (1481)..(1490): a, c, t, g, unknown or other
  modified_base (4993)..(5069): a, c, t, g, unknown or other
  modified_base (6361)..(6370): a, c, t, g, unknown or other
  modified_base (6574)..(6583): a, c, t, g, unknown or other
  modified_base (7006)..(7015): a, c, t, g, unknown or other
  modified_base (8031)..(8040): a, c, t, g, unknown or other
  modified_base (10878)..(10887): a, c, t, g, unknown or other
  modified_base (11367)..(11376): a, c, t, g, unknown or other
  modified_base (11867)..(11876): a, c, t, g, unknown or other
  modified_base (13111)..(13120): a, c, t, g, unknown or other
  modified_base (13476)..(13485): a, c, t, g, unknown or other
  modified_base (14849)..(14858): a, c, t, g, unknown or other
  modified_base (14956)..(14965): a, c, t, g, unknown or other
  modified_base (15819)..(15879): a, c, t, g, unknown or other
gggctggtcgcagagcggcgtcaccgcgcgcgcgccgccggcctgcgccgcgccgcgctgcaggccaggctcaccgccgcgcggtcccgcctggcggcgctggagggcggcagggtggtggtcacggagggcacggtctgcgcgcgcagcggcgcccgcatcgggacacgggtgttcaccgtgcgagccgagccgccggagggcgggccggggctgcggcccgtcagcctgaaccacgccgattagaccttgaacacgcaggccgctcagagccgccaaggggtgtggtctcggcgggccgcctgcccagggcgccatcggtagcctcacctgcgatctgcgcattcctgctgggtgaatggcttttttgagcggtcagatgcactgtccctggagggatcttatcgaagacggatgtctttgggacgaagcatctctgcttcggcatcaccgcaagcaggctaggtgggagtcaggtggaagggcgcttgtgacatgcagttgcaacatcggggaacccaaacagcacgnnnnnnnnnnagctgggtgggagtcaggtacaagggcgcttttgacatgctgttgcaacatcggggaacccaaacagcacgctttccagccgggaaaatttgagcgcacccagaacacggctggtcacccagccgctggtgacgcataccagggcaaggtaggttcgcgctgtgccatcatagttgtgctagtttttgtgccagagaggatcgtctgcgaccccaccttgcggaaatcagggaggcccatacgagactagggcacccgcgccccggcagaccgctcagaagccgtagccatggcgtcaaggaagcgcacccttctcaaagtcattattctgggggacagcgggtgagtggcgtggacggtcggcactgcagaggcgcacaattcaatggcgtcagcgactggccggcaccctctcccagtgtcccctccccctccctccctctgctgcgacacagggtgggaaagaccagcctcatgaaccaggtgcgatggatgtgactgaaaggtcgcacatccgcatcccggaggttcgatgttgcacccagaatctgtcctctgctggatgtctgaccagagggcatccctcaagctacttgaggccccaccctcacctcgtctcactatcaccgcagtacgtcaacaagaagttctccagtcagtacaaggccacgatcggcgcggacttcnnnnnnnnnncagctgcatgaggcctcaccctcatctcgtctcactatcaccgcagtatgtgaacaagaagttctccagccagtacaaggccacgatcggcgcggacttcctcacaaaggaggtgcaagtggatgacagactggtcaccatgcaggtccgtgcatgggagcgccaggggagtggatggggtcatggggtcctccacatggttgtacgagtgcacccggggaggcttcatcatgttccagatgtannnnnnnnnntgtgcatgggagcgccaggggagtgggtggggtcatggggtcctccacgtggttgtatgagtgcaccggggaggcttcatcatgttccagatgtatggaagacgctcccgtgctgtcctccgaggctgtggcgatgtaacagcaccccacgctcggcaccgtcgcatcccctctcccctcttcagatctgggacacggcaggccaggagcgtttccagtccctgggcgtcgctttctaccgcggcgccgactgctgcgtgctggttcacgacgtcacctcctccaagtcctttgacaacctggagaattggagggatgagttcctgatccaggcctcccccgccgacccggagaccttcccctttgtggtgctgggcaacaagatcgacgccgacggcggcaaggcccgccaggtcagcgagaagcgggccaagcagtgggccgccgccaaggggggcatcccctactttgagaccagcgccaaggaggatgtgaatgtggacaccgcctttgccaccatcgcgcggaacgcgctcaagaacgagactgaggaggagatgtgagtgtggggtggggtgggtgtgatggcgtcgccaagggaggacacgattgacgcggtgacctgcttcctgtgttcttctgccaatgtgcgtatgtcgtcgcctccgccatcatcgtatcgctcagtatgcgggaatcatgcgtctggcggcccacctcaccagacctcacaacacctcacatctcccacctcatactcaaccctgcaacccttttcccctgtccttccagcttcctgccagaaacggtggacatgcaggcgcacgcaacccccaggcggcagcaaggctgctgctaagcctggcaaaccttcgcgggaggatggagggagggattgctgtggcgagcttgaggcagtgctgctgtcaggactgcagcacgcttgaccccaccattcatcctctccgttcgcacacacctgaaaccccctctttctttgcttgtcctggtatcctgcttgcagcggctaccttactcgtgcgctggaatgcccgcctgtaatcgaacatacgagagagcttcgcatcagcacccggcataagggcgcgccaggcgcgagacccaacttggcccacgacagattcgggagaacatccgggaggtcgagcgaacccaacgttcattggttgttgcagggcgttcgagagcgctgctcgatcaggaggtgcggctccgtcgccctaaggaggcccgagggaattttaccccactgccatgcacgggcgccaataatgcagggatccacgcctcaagccagggtgcatgcccatgtccatccgcgatttgtggcgcctcgtgtcctcaatgccctaccgccccatcacatcggggcacggccgcggaaccggtcgagcagggcggagcctgtgcccgcgagtctcgtggtcgagggcatccagtatgccacaggggtagggatcgcactggggatcgcgctgtccagtctgcccatcctgagtggggaggctcgagaggccaacgagcggcggtacctgcagcccaccgaggaggaggaggccaacagcattcggtggggggtgatgagcgtgctcagcttcatcccctacctgagccccctggtgagggagggctggtggcatggcatgccttgcacatcgtgtcatggaccaggtctgtccttcctgcgccgaccggctggttgccgagggttgcatgagaagaggcagcgccttatgaccaggcggcacatcccaccttcgctccacatcttcgccaggcctgggtctttgccggactggacgacgagacatacagctccctctactatgtgtatgccgcgctctataccctgccgtacctgaccaacggcctgcagctcaactcctttgtcctcctgtccatcgccgccggcatcgcacatgtccaggtaggagtgcctgaaacgttgttgctggaatggcctggatgctggctcagctgtgacgaggagtggcacctggctacctggcgaagcactgtccccgatagttgtggggtgcgcaatggtgcttgagacgctggaacgtcgtcatggcctccccacagttgcatcccactcctctcagattgagcggctggcgctgacggagcctgtggaggtcgagttcccggagacggccggctggctggcccgccagggctccaacctgctgcggggcctgctgagctcggggctggaggtcagcgaacgcgtgtctgacaaggcggagcgcgcacagcaggccagcaccgccagacctgacaggaaggagctggccgagaagtctgcggaggcgcgggcggagctgcgatactttgacaggaaggcacaggacgcagaatcgagaaagcggcccgtgcccgaatccctgcgccgcgccaaggacaggagcgatcctcgacccaagtgatggcgagctgggccttcggcctgatggagtttgtcacgcacccactcttgtggtgtatcccaggcacaagcaatgcaagccccagcctccaggcgcaatggtgttttggctgcaggagcctccagcttcagggaccccagaccagacaccgtaccgtgaacagtatgctcgacgcatgcacgttgtctcccaccctctgttgaatgatacccgttgtgattcgctcattacagtgcacaccagtccccaattcaggcagtggcctccaccatcgaggcatccgagtcgccacccactttgtcacccaacgccgcggcctggctctccagcgtgaggcacgccgcctcgatctcggcgttcttggcaaccagctgcgtgtactcggcctgcagggaggacagctgccgcccggcttccagctgggacagcttcctgctgcggttcaggtcctccgtctccttcttgacggccgccagccgccgtttcagagcctcgcactggaccgtgagggtgtcgttccgcacgcgccaagcatccggtccaaacttgagcagcagctccaggttgatgagcctgcggcgccgaggcagggcaacatggtcgcagagtggacgctgggcagcagggaggcctgacagcgccatgtttgctattcgcttgcatccaccccgccatcaccccaagacccacctcgtatactgatgctccagctggctgtgggaattgtcaagggcctgttgccaggcatccacactctctcgtgagctgggggagggggggtccaggttgtacctcacggtgtccatttcagccatctgctcgccgcgagccaccctttccagctcctgggcgacgagggagccctcctgcgtgggtgcatagaagggtggaggatgattcagcgccatgcctgccagccgtgcactggtgtgaatgccgccagaggtgtggagcttacatctagcctggaggccaggagccggggcagctctgccaagtagtctgcgggggtcttgtcgctccgagcgagctgcgaggtgcagggatggtaannnnnnnnnnnnnnnnnnnnnnnnnnnnnnnnnnnnnnnnnnnnnnnnnnnnnnnnnnnnnnnnnnnnnnnnnnnnngcccgtgttcctcgtgccacgccaagacacacctcctcctggaccagcctctcgacagcggcgcgactttcggcagtcagggcatctacatagggaagcgccgtgatgaggtcctgacccctcctccaaccaatctctgcgccatgcgctgtgtcgctgatggccaagggttgctgggccatcgccttgcgctcaggctgtcggtgatcgcggcacagaagggtgtcaatgtgttccttgccaccttgactatatgagaggagagggtagcaacaggcacggaccgtggtgccgcatcccaaaagaatggcccaactggagttaccacccgaccctgagccgatgcgcgcgcgcgcatgcgcgttgctgccctctccagtatctgttgaaaggcttgcaatatatcaaagttacctcacgtcgggtcctgtggtcaagccggtgaaaagtcagggagctgcacatgctgcagaatggtataatctccccactcgcccattaggaagtgctgggagactagtgtacttgtcaaggggtccttgtcatgaaagtgtcctccagtggccccgagtccaggccatcttctgtatagattgctggagtagggacccctcggtgctccgcaaaccagcttgctcgtgtggccctgacgctgtcggcaacggccgtgacaccttcccagcgatgagctttttgcgttctgtcccgcaatgccagtggcttggccagcgcaaatgcggcgctcgacacgcaaagcctcctccttccggctccaaggcctctcctcatcccactgagggcacagctgtgatgagctcgacaaactcctcaaagccgagggcgccatccccatcggtgtcaaactcctccatggtggcctccacgaccttccacagcttgtcctccggcagtcctcgcgtgttggtctcctgcaactggcggtgaagatcctgggcggtgacaaagccgtccccatcggcatcgtatatcccgaacacaaagcggtgcttggcttccaggtccctcagctccgtcaggcgcagcatgagctccctcaggtcctgggaatccatgtagccatcacagttgcggtcggaaagctggaagatgcgggccaggaaggggttgccggcaatctctggtatcagttggaagtctgtgagggccagctccgtctccccgcggcccagccgtttcaacctgtcgtttgattcaaacggtgttgtggatcttggtgctggagacgggttaaaggaaatttcccttccacagcatactacgtgggaagcctnnnnnnnnnntttggtgctggagacggattaaaggaaatcccccttccacagcatactacgtgggaagccttggcgccacatctaagtctcacaaaagatgtctgcttccactggcccatctcagtacagaaagcttcctgttgcaaattatactagcacaattctcaccgtcgctccatccgctcgagttctgccttgctaagagaatgcttnnnnnnnnnnctgctagcacaattctcaccgtcgctccatcctctcgagttctgccttgctaagagaatgcttctcactcgattccaggctctggaggttccccatatcctccgaggccctgccagactgggcaattacgacgttgttggtcccaaggaacagatttatcttcctacatgtctgattgtgtacacccaggccggtccgcaacgccaggatagatgtttcggagcggtctgtccgcatcagctgcagggttttgaaggtgggggggcgccagcgctctcttgtgaagatggatgtggacccagtggctctgcacggcctgcagggaagagcacgccgctcggccaggacacacctgaaaagcttgggaatgacaatgcatgcgcatgctctgaagtgcatgggtcagcattgagacgcctgtgnnnnnnnnnncgggggggcgccagcgccctcttgtgaagatggatgtggacacagtggcttctgcacggcctgcagggaagagaacgccgctcggccaggacacacctgaaaaggttgggaatgacaatgcatgcgcatgctctggagtgcatgggtcagcattgagacgcctgtgtagaagtgcgtgcgctgggtggctacctcctctccggaaattcccacagttccagccgcccagacagcctcaacccgtccgaatttcattcaaatggtgagaagcctcttgctacatggcttcgcggcctatgcacagtgccttcgacggtacccattgcgtacccaggttatcagcactggagctctatggtgagaccttggcgctgcagggagctcttaaagcaatccaacggggcaagagcaggcagtgaagaccagggttatggagttgagagtgtgcatatgaaatgataccacttactccagttgtgcacagcagcgagacacccttgcctctacaccccactcattcattgatctgcagggcggctggcgacgcgttggcgcagcgactggacaagaggaagctcagatatgacatgcacaggacactgatcactgccgcctatggtgcttttgccgtgggtgagtgcggatggctgtcatgggatgggttggtcacacctggggccagtctatagcatgcctcaagccattcagggtggagccttgcatgcaccctcagcctgcagcttgctttgcagtgggtgtgattgagattgagtttatttggaattcaccattccttctatccatatccattacaggtccaatcggccatgtggtgaggagagcggggggcttgcaactttgttggatatctcttatgagcttcagcagagagggcctggctggctgaggcaagattggcagattgcatgggcagagaagacatgacatgcttgacctcatgcaccttcttgcccccctccccacgatcagtggtatcacaagctcgactccatcgnnnnnnnnnnagcaaagaagacatgacatgcttgacctcatgcacgttcttgcccgcctccccacaatcagtggtatcacaagctcgactccatcgcgacgcggtttcattcccccggctccctccgcttcgtggcgctcaaggcgaggggactcgaggcaatacaagctggactgggtgactttacgctcaatgctccgcccctgtctgctgcccttgccatttgcaagtcatgttgtcgtcttttccagatgctagcgaccacctcaatgtcaacatttccatctcaaccccaaaagtgcaggtactgttggatactgtcattttctccccgctccacattctgggctactttggcgtcatgaacgtgggcgagcgaggcagctgggccgacttcagcaggaaggtggaggtggacttcgtgcccaccctagccgctgagctggcggtctggcccgccatccaggcggcaaacttcaagttcatccgcgtggactaccagctgctggccgtgaacctgctcacaatatttggtgagccgtgcatgccgtgttgggggcgcatgatgcgaaggagtccaaacccaagggacattcttgtttggagttctgccccagggaggtgggtcctgagcaagctgtgttgtgttgaatcagactctggccagggtgctccaggcgtctcacttttacaactcccttgccacggcacctcatttttgcagacagtgcattcatgtcttggtgtcgagccaccgaggactggatgtccgttctcttcccggggctgaagagtccagcaccagctcgccccgtggtggccggcttggggcagagcagcagcgtcgtggatgggccgcagaaataaagtcagcacctcgagacctggttctgcaatattctttacatgcaatccacactgaattctttcacgagataccaccctgatttaaagctatcaaggccatgggtcaatgcactgagtgatgcggctgtcgccgcgaccagatcaaattgcccagttgcgcgctagcctagatgcacagctcgcaggccgttaacagattatcgcgcactggtgaaattcgacaaaccattttagatcctgcgttttcttctcatcaggagttcagaagcagcgccatgggtgagtgcacgattggcgggggttcacacagtcgcccttgccagtgtggctcgccctaaggagtttccacgcacctcccttcgcagcctccaaagaaggcaaccagattttcatcactgttaggagagggaagcaataccctcccaagaccatcgatgtcaggtgtgcacccgcgcccctcgtgcgccatgtttgacccgtgcaactgccggacctcgagtaccctcacccgccccttttcccccggccaccccgccctcaggatcaagtatgagcagaccatccgcgacctgagggaggctgccgccgcctccttcggcctctccctggacctgctgcagctgttctggaggggcagggagctcacctccgccaccgatgggctcaccctcctggaggccaacctccacaccggcttctccctgcagggctacgacctgagcgaggcaccagactactggccagccgtggtccagaccccggagggactggcctttgagactgtggctgcggctgcatcttgaggggcacaatgtagttggggccctgcacatggttgtcagcggagagagctgaatggttgtggtgaaccctttacaatgctgtaccttgcaccaaggtgtacgtatagatgtctgcctcgcctgagtgccagctgcatgcgtcctcattgccaatcgctctcccgtgcaagcaccactacagcgctgggctcaagaggcaaggcgtgcctgtcctgtccatacttctcattctacagatgctgtggcatgaccacccgggacgggcgccacaacttgagcaggcacggcaggtgccagaggcgcagacagtggtccacgcgtcacgcgttcaaccgccctcatgccagcccagcacagtttgtgtacacggcatcgacgtcatccacggcgagcagtcgctccatcaggacctcgtttgctgcctgggcctctgcgcccacatcgacgggggcggatgggaggtaggccaggctcgcgtcctcgccatccacctcgatccccgcctccgccaggcgggagcacaccgctgcaaagtccgcaggcgcggtgaggatctgtgcagcatgaagacgagagctgggcatgggctggctggcaggggatggcaggcggcacagcaatcccaatgaacagacagttgagaggaccgggcaccatggcattgtgggggccccagagcagcatggcgttggctgcatgtgccttgcacccagccaccctccaccactattccatcccatcccaacagcttgagggatcaaatcttcccagaaccacccaccttgaactccccatcctcctcgccaggcagcacatcctgggcaccggcctccaaggcagcttccaggatgtcatcctcccggccccccacgaggatgactccctggcgggcaaacgcgaagagcacggagccggggtccgccatcttgccgcccgccttggtcaccgccgcccggacggtggaagcggagcggttggtgttgtcggtgagggactcgatgacgtaccccgtgccgccaggaccatagcactcatacaccacctgccagagggcatgaggtgggtgggtgagggatacatgaggaagcagtattgacagcacggcaacagcgacggctggctggatccctacccacccttccctcgccagtccagcacacctccgaaaagttcgcggnnnnnnnnnnatacatgaggaagcagtattgacagcatggcaacagcgacggctggccggatccccacccacccttccctcgtcagtccagcacacctccgaaaagttcgcggcggacttgtctgttgccttctccaggtttcgcgtgacgatgtcgtttgggagggaggcgagcttggcctggtgcaagacctcccgcagccgcatgttggtgactgggtctgggcccccggcccgtgccgcctgggcgatgagtttgccaagctgagggaggaggggtttggggaaggggctgtatacagtattccgagggccgcatgggaattcgctcagctcgcacaagcatcaatgaaaccaccagagccttcaagggctcagatcatacttgctggcgttgcacgccgtggcacccatcatggcaagccatgaccaagcgctgcagtgaatcaacggctcccaaactataccctctacaccaagcacctttccnnnnnnnnnntcttactggcgttgcacgccgttgcacccatcatggcaagcccatgaccaagcgctgccgtgaatcaacggctccccaactataccctctacaccaagcacctttccgtagagcttggccttgttgccgtcggccttcccctttttgagggcgattttggcggaccgtctgcccatcatgatggggctcaccgcccgaaaccggcgcgggctgaggcagggagacgaagcccacacagcctcccgtccaatacagcttgcattgaggtgattgagtaaatgtaccgatgcatgggtttgtggtcttagtgggtcacgagtggagctgcgtaggatgcgggcgaaggacccacaccatgtgtgtgccatccgatgagggtgccagcaatgctcgcgcactgtacactccctgaagactttggcacaggagactgtagtaccttcatctaatcaatgttccctgctccacagggacaatgctccgcgaagagnnnnnnnnnngtactttggcacaggagattgtaggacgttcttctaatcaatgttccttgctccacagggacaatgctccgcgaagagtgatcctgaaatgcacagttcatgcggagcctccgcatgcccagcaggcgacgaccatcagcttgcagttcctcaaatatgaggggcagcttcctgatcctagtggcgccatgagcctgctgatgagtgagcatcgtctatcaagccagttccagctgtcttctgggcatttgtggcgtcgagccccgcacatgccacaccctgcggaccgcatcctgggctcggctagttgacttgcgcactccggtgcaaatccattcgactcccacagatccaggttcaagattcctctagcttcccggatccctttaaaacgtactccggcgagcggatcttgcacattgcacaacgccactgcagtcgtgccatctttgacctctgaccacggcccagggtgcgggcagcgtgcacgagctcggcactctgaccggcacaactgaatggaggttgaatctgccaaaaggctactcggtgagagcctcgcggctctcaaggacggtgcgttggcgacgggtggctggtcgattcgagtgtgtacctgcacgaagtgctgcaggcccccatgcaatggctcaccaacgatcctgcaggagcgagatcagattgtctcagtgccacaatttcccccccatcccaggcaatgccactacctccctggcggctgcaaaccgtgccctgactgccctggcctccccagaggcgcgggaccagccgagctctgccgccctcctcgctcgcgccttccaccgcaaggcggccgcgctgggggcgctgggcgactcggtggaggcggtgcgcgtgtatcgctccggcctggccgcctgcgggggagcggcgcccgccctggcggcggcactgcgcttgaccctggagaacctgcccgccagctggcacgccgcctactggtgcgggcggatcgaggcggggcagggacccgcccccttttcctccagggacggcaggcgcctggccggcatcccccccgacgcccgcctcgctcccggcgagctccgtgccgccctggagcgagtgctcgcgaccaggagggacgtggcggacgaggccgccgacttgctttgccagacgtggtcacgaggtggggtgtgtggcagaactgaaagccgcatcggcgggggagcagggaagcagatgggtcnnnnnnnnnngcgtggcggacgaggccgccgacttgctgtgccagacctggtcacgaggtggggtgtgcggccgaattgaaatccgcgtcggcgggggagcagggaagcagatgggtccatttccagtcgttcccacgcagtggatgcctgtctgaacttcgtcatgctcacccaaatcgttgtcctccaggcccctccacccgcaccagggtacctcagctgctcggccctttgcctgcccccacctgcctgcctcccacaagcccatcctctgcctgggtacacatcgaggcagcacagcaccactacaagctacacctccaccgccatcttgcctttgcaggccgcaagcagcccgggcgggnnnnnnnnnngactcgtgtcctcctggcccctccacccgcaccaggctgcctcagctgctcggccctttgcctgcccccacctgcccgcctcccacaagcccatcctctgcctgggtgcacatcgaggcagcacagcaccaccacaagccacacctccaccgccatcttccctttgcaggccgcaagcagcccgggcgggcggagctgtcgtacctgcgcggcgccgcctacctcgaggccggcgacgccggccaggccctgcgagacgcacgctgtgccatcgtgttcggcccccgcgccggcccggccgccgaggagcggaccccggaggccgacgccggggacgcgggggaggaggggtggggcgcggcgtcgccctggctcaccgccgcgcgttcctccctctggccggcggcgctgggcctgctgggcgccgcctacgaggcgacgggcgacaacgtccgggcactgctgctggcctgcctggccgcggagggggcgggcggccacgagcgcgaggggagcgacgagggggcggggggggcttgccccgaggtgcccgccgtcggcggcagctcggcagggcgggccgtgtgcggcggccctgaggagggccaggacggcgggggcctggaatcagggcagcaagaagaaagcgtgcacgaggcggcacggcgccgcctcctgcgccgcgtccccgaggagtgcgtggccgccgtgcgggcgcgcgggagcgccggcctgctggcgctgctgtccgcggcgcacacgcaggccaagccagaggtgctgcgcaggcgccccaagtactactactactacgagtggatgaagaagcgcatccttgagcaggcaaggccccttgggtggcgtcgtggagagggctcccgtgtttggctgggtgacggagggtgcagggggggctgcatgcagggggggctgcatgcaggggggggctgcatgcaggtgtgcccagcagtggggaagaggtgcaggacatgagggggaggtgggggatgctgaagtcgtgagggtgggagtgggctgatgcccttgctgtgcagcagcctcccacaacaaccatggaccctgccccgcccatccccggcgcagtaccccgcactgcctgagccggtcatggacaagctgctgacgttggatgcgaatgagctggacctggtgctgcagtacccccaggccacgcggcagatggtggggtgggggtgaattgccctgttatccatgaggcccatgaacccctgaatctggctggttgggtggaatggtgcgtgcctggacccagcgtgtcccaatcccaaggctggcacggcctggctgggccgtgcacgaaacagtcggtcccccatcatgannnnnnnnnnggtggataatctgctcggagtgctggagactcgaggctgtgcggccctggaaacctaccgcgtgccactgctgtcgtgggaggaggtcaaggcgctcnnnnnnnnnntccagcgtgtcccaaccccaaggctggcacagcctggctgggctgtgcacgaaacagtcggtcccccatcatgaaagatttgacagctccatgacccaagcgaactcatcatgcatcatcgctcaccccaccccaccccacacacaggtggataatctgctcgaagtgctggagactcgaggcagtgcggccctggaaacctaccgcgtgccgctgctgtcgtgggaggaggtcaaggcgctcaagggccccggcaccgtcggtctggctctggggtcctctgccgacgctccgcccacgccccccaagctccatggcagggccgccgcccagcccctggccgttgaggcgggggaggggggcgctgccctggcctcagagatgccgggggacgagtggagcccccctgccgtgggcactggcgcccctttctttgaggagctggactgagagaggggcacgattctgtcttgaaatatgatccaacagctgtctgcatcctaccctcacagatctttacaagaacctgttgggcccttgaccagggcttggcgatgggtttgccatgtggcatggagtagcttggcaagaaaatgcaggaaatggtgatggggaaccgaagggagcgtacagacatcatggactggaatcttgagaaaacggggaggggtaatcgcttggcacatcgacctccacctgatcggggcagggatcacagaaaccatggtgggcagccgctcccacctcagcgacgctgcagtgtctgccacccctggaggaacaccgtggtgatgcagagggtggaggcagaaacacgcctgggcaccccccccacaaaatccctcagtggcggnnnnnnnnnnnnnnnnnnnnnnnnnnnnnnnnnnnnnnnnnnnnnnnnnnnnnnnnnnnnnggacaaacagggagggcgggatgcactccgggtgccccgccatgctggccaggaaggcgggcgtgcccaggcagtcgtggtgcctgccggcggaggcggcccgccgccgggcctcggccgccacgaccccggcgccctgcgggtcccgcgccagggccaccaggtccgggtggtagtagtgcttgcggtgggctacggccttgatccggttctccgccatctcctccatcatccagtgcaccgtctcgtcgtccatgttcttgcacagcgcagcgcgcagcttctcgttgccgccgtgcttgttgtagtgcccaaagtggatctgtgacgagggggaggttgcaaagtggggtggggctggggtttcgcagggccaggggatgctgatgcgaggagattcagggggttgaaatcatggcacctgccataggttacctcaagatcaccctgtatgcacccagcccggcacgagtgccgtcatgcggaggcgctgcacgcccgaccatcatcagacctgctggtcagcccctgagacatttgctaaagcctgccaccgctcggttggccccctcccccttgccacccaccatcctgctcctcccgccccaccttggccttggtctttgcgtcgataaagggggagatggagtgccagaaggtggagaagatgcggggcgcggagacgatgtaggcctgtgccaggcgctccgggtagtgcgcggcggagaccttgaggaaggcaaaggcaatgcgcgggtcaatgtcgcgcaggccgaatccgtgcatgtccagcacccagacccagtcctccacgccccccgccatgcaggcgatggcctgctggaaggtggcaatcatatgcgcgcgcgtgtcctccatggtgcggcaggtggggatggagaggcaggagtagatggtggggcgccggccccggtcccaggccaccacctgcatgtagtgcgacttggggtcgcgcgcgcaggcgcggcagtggaggtggtcggggcgttccgcctcgaaccacgccagcgtgtccctgatgcggcgcagcgcctgttggggggaaatgaatttggattggtcaggacttgaagggtggcccacaagcgaaaagggctgaggaacggggactgtgaaggaagagggggacacaatgccctttggcaccatgtacacagggtcaacaggatgcctgcagagcgcggcactctacagggtcgagcaccgcacacc

SEQ ID NO: 36612 - DNA, 11708 bp, Chlorella protothecoides
  modified_base (110)..(308): a, c, t, g, unknown or other
gccccagccgcggccggaggccggccccgggccggcccccacgccggcgttcaggctgatggcgccctcattggcgtggccgttggcgcccgcctcgccggccccgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggtgggggagtcgccgccgccgcgcgccgcgcccggcgcggcctcgcgtgacagcgagcgcgtcatgcgccggccctcgggcaggggcgcctcgggccccgtccccggcgcggggcccagcgtgttgctcagccaggagacgatgtcggccacgccgctggcgtccggcggggtgggctccaggccgccgccctccaccagctggcgccaggacgtgcgcgcggcgagctggaggagaggaggagaggatgttggagggggtggagagtgggtttgcagggttttgttgggaggggggaggaggacagggcatcgcgcagcggcgccatccgccagtcaaaccactggcggacggccgggtccacgaagcgagcgagccctcgcgctgcggttgtctgggcggagccccatgcgtgctccagactccacacgcaccggcagaggcggggaggtccgaccaccccccacccccccgggtcccaacccttgcgcctcaccgggtcggaggccagttccggcagcttgtagtgcgcgggcgggggcggcagcgccccctgctccgggtccagcatctcgatgtggatgggcgcagccatggcattcacctgctgcgccagctgcacctcccacggcgtcagcagctcgcggctcacgcggatggccagcggcgcgggcggcccctggccgtgccccggcgccacgttggcggtgcccatgccgtggggccccagcaccgcgccgtgcggcaccgccatgctcggcgccaggctgttctgctcaaagggggagggcagcaccgcaccgccacgaacccccgccacggggtacctgcgggtgggagggaggggggtggggggtgttggttcgagtggcaaccagccagttccattcaggcgcgtggtgcctaggcagccgattcccgcttaatatccccccccacagcccccggggagggagggccaggcgcccgaggagggacgcacaggaggaacctgtcaggctggtcgccgcatgactccagggtgcctgatgcctgcacagagtgcgccccccccccacacacacacaaaaaggaggaaagaacaaggaagcagcaccaccccctagcgccacgccgcacccctgctgttgctgatggtggtggggattgagctgatgccccgcggcctggcctggcggcccacgccgcgcccgcttcgggtcggtgcttggcgagcccatctcggtcaggcgcgggtgcttgcggaccagcgcgtgccagcggttcttcaccgcgttgtcggtgcggtcgccgaagatgcgggagatctcggtccagcggttgcccagctccgcgtgcgccgccatgagctgcgcatcctcgtccgtagaccagctgcaggtcttggcgttgatgctcaggaaattcttccagcggcgccggcactggacgtggggcagacaagtggggggggaggggcttgctgagggggcaaggacgggctgggaaaggggcttggggcgatggggagggctgggaaggagggacggcaatgccggggaggaggttgcagacggggacaggagggtctgtgcctcgagctgtgcagatgtacttccagagcatgcaagcggaaggaagggccgcatacgcactggactgagctctgcagcagtcccaatacatcacctccccacctgcttgctggacttgctgcggagcttggaggagatgagcgcccacttcttggagccgtgggcgtcgacgaggtgctgcagctcctcatcctcctgattggggggagaggagcaagctgagcacaccccggcctcactcagcgaggcaggcgcagggtgctactccacccccccaaacactcagggcataggacctcacctctggcgtccagatgagggcggtgggcatcgccacagacggtgctgggatggtgctgcagtggtggccggaagggaatggtccccagagtacctctctacctgtggggaccgtgcaccgacccagcgccttgaattataagaaaattgcatggctgcaaagtatgagctgcatggcatggccatgggccggagggtggccgggctggcgaggaatagggaaagagtccagcgctctcacctcaagcagggaagtccagacgacgcatgcgggtatcaacagctcccaaattgctgtatatatagaggaacttgaagcaagccactgctggcttgagagccctcctacgagaggtaccaacgacaggggccggcgaactccaggcacagcgtcgccggggctctcaaggaatttgcactgcacagaaatgagacacaatcctcctcgagccgttcgacaagccggtgcgaccagtatgacggctgctcggagctgctggcacgggtttgccccgatggccgtcccgcgacccagcgagggtgggacacacggacatggattggaaagtcggaaatctccttttaacatgctcgcgacaggggacaggaatggatgcgagggatccagcctgctacatgctaagcaaggaagccgactcaaatgagtcgtttatcaaggcacacgccactctgaatcagtctgcgctgctagatggtcgactccgaagtgatcgcctccttttgcggggtcaccggcgcagacagcgatgtggccattcagatgctggaagcaaccaatggagatctagaatctgccatcaatttctactttgctgccgagggcgctgcaggcggtccagatcgcgaggacgacgaggcccttgctcgcaggctccaacagtgagtcatgcctgagggcgaccatcgaccagaataccatgcaccgtgccttggaggcgagcatctgaatccaaatccaatgtgcagggaagcgaacgagccgctagaagatgctgtgcgggctcccatgcccgtcgtcaatcagaggcttgtgggggatctcctgccggggcccattcagactcgacgcaggtaggaggagcaagggccctcggaggctgactcaaatcatgaagtgctccctccagcagcgctcagtgttgtgacgacagtgtgcatgccgcacaggccatggtccatcaaagggtggacctccgctggcgctgatgcagttgctcctctccaacttgtcgtgcagggctgtgccgattccccaatcggttgccaacacattcagggaatccatgtgagtgttgggcacgtgctggtttgtggttgcgatgcgtgcctcaccacaaccccgctggcgatagccagggccgctgcatgacacattgatagtggcctgactgccgagggtgcgctgagatgctcaacacccgctgcctgccgacagggacgcatctgagcagccctccagcgggggactggcggcgagctttgagcctccccgcgagctgctcttccacggctcatttgaagatgccaaggagtctgctgcctccaaggagcagtggctggtgagactgatgggagcttgccagtggtgtcctgaagtgcaacagctgccgcccaccttgttgatggcgcccatgcgggcttcgcctctgcgcgatgtccttgcacgtcttcatgcgcactccacatggtccaatgcccctcccactcatccctcgcacacccctctcccttcccccaaccagttgctgaacctccaggcggccgaccagtttgcttcccaccagctcaaccgcgacacatggcgggaccccatgatttccgggctcgtgtcacagaactttgtgcttttccaggtagggctgcggggcgggcagggcatgacacctgggtgctgctgcaacccctagcgtgccgccctttcctccttgggagagcctgcagcctgggcacacaggtcactggtgccctgggcatgcaggtcaggcaccaatgcccccgctgtgtccccggccttctgtgcccagcaacgatgctgtttcctcccctcccccccctccccaatgcaccatgccaggtttaccagggggtggaggaggcggaggtgctgtgcggggtctatcgcgtctccaagctgccctgcatcctcgccatcgacccggccacgggggcgctcatgcggcagtgggcggggttcctgccgccagacaggtgcgtgcgaggaggtcctgggcggctggcggccgccaggtgctcaaagggactgccaggcagagtgtcgctgctgggcctccgttccacttgacaagttccggctgggactgcgggacctgacagcagtgatgccacgctctctatcccaccatcccatccgcttgccccgccaggctggcagaggagctgatgcccttcctcgagcacacgttccttgaccccggggcgagcgccctggccgcaaaccggcggcgccgcgctgcgccgagcgcgccagctgggagccttccgcgtgccggagcggcgagcgaggacgctgagctggccgcggccatcgccgcgagcctggagccaaaggcggagtcgggtctcacgagcgcaggccgtgcggccggcgcggccccagcgcaaccttccggctctgacgcaccccctgctgcggcggcgaggggggaggcagctgcgggtccaataccagcggcggcggtggcggcggaagccgccgcgcgtctgcctgtggagacctctggcccgggcagctgtagagtaggtgaggcttggcttcacagcgtccagagcgggaagagggttgaagtcatggggcgcccagctgaagtgagaggggctctcgcatcccgtctcaccctcatgaagccctccacccacccacagccgttcgctgcccagacgggtcgcggctgcagcggaggttcgagcagaccgcacccctcgagaccctgcgggacctctgcatcgcctcctgccccgaggcggcggctgggcgtcccttcttcctcgccccctcctttccaggcacgcttcggttgccagggggtgggcctggaagtccctcagctggtcaattgacgcaaccatgcgggggaccctgcgcagctcaattcatgctaggaaggctgtggatggcacatgggactgtggtccgatggtgggtagcttacagtctctcaggcctatccaacaccctttccaccctgctcacaggcgcccagccgctgctcgacatggctgctgacctgacgacctctggcgcagccgactccatgctggtcatgaagtgggcggagtgaccctgtgccgagtgcaggagcggcagccagtcccttgttctttggcaccattttcacagccttcttgcggacagcaatgtttacctgtcatgttacactacaagagtcaggcggccacccgaacgggcgggagtcagggcagagagcaatagactttgcagtcagtagaaaggaagggggtgcgcatgtgtcagcacggccccgtgtcagttgggggtgggtgtcgtgtgtggcagtgcatggagccgggtggtgcaaatgggagggggggcctgggtcatccaggcgtcgatgatcgcttcacttcttggatgccgtcttcttcggcgcagcctgaagtggggaatgaggcaggcgtggtgagatgagtgtctgcagaaagcaatcaagcctgggtgccagttaatcaagcagaaagtttctgcaaagtttgtccaaagcatccgattgtgacataccttcttggtgggtgccttcttcaccgccgtggcctgtagattggcagggcgtttgagctaatgagtttaggctatgctctgattagcaagacgcatgggtctaccacaacgactgttctctattgcccaccttcttcgctgccgcgggcttggcggtcttgggcttggcggcggtcttcgccttgggcgtggccttgggcttggcagcggccttaggcttggctgccgtcttgggcttggtggccgccttgggcttggccgccgtcttgggcttggtagtggccgtcttaggcttggcggccgccttgggcttagcggctgtcgtcttgggcttggcagttgtggccttgggcttggcagctgtcttgggcttggtcgtggtggccttgggcttggcagcaaccttcttgggcttagcagcgggcttcttgggcttggtggtctgtgtgagcagtggcgaaccagcagtttcaggcggcatcccgttctcgagattgtggttgtctgctggctgccgttgactgaggtccccatctcagtacgttcaaaaaatggtccgagccgaggcatcacggcatgtcagtacccaccctcaccttggtcgcgggggctgccttcttcacgggcttcttcgcgggcttcttcagagcatcggacagcttgaaggaggacttcaccctcaccagcttgcccgcgcccgcctgcttcttcagctgctgagccagcaccttctcccagccggtaggaagcttgtgcttagagccaatgaacttcttaattgccgggtagctgcttcccgtgcgctccttcaggccggagatggcctcgctgatcagcgacaggtacggcggatgcgcgggtgcggatttcggagccattgcgtcgggcgatctgggacgtggggaaaccgaaatttggatgcaatgaactcgtggaagtatgttgtgcactcttcggtgcacggagtaccatttggggcgagcctgtgcgacagcccacgcccgatgttacccaacgaccgttgggccgacgctggggaggaaagaaggacagcgaaatctcaacacaaaacacaagatccaggtctcatgcgggatgcacgtcgcctgattctccatcacaccaatacatatgatcccatcgtgtcacctgaaaccgagaagggccgcaagccttgctaattggtggactgaggggcatgcgacgggtccgccggaaaacacatggatcggtgtgcgggatgaccgccgttgtgctcaggcatctcgctgcatgcagcgagcggcctgctcgaagcgagacatccagaattgcaatttgcgagcctgagaatttctagaacactgtacaagcacgatcactctcttccagggttgtattgttgacgaggctggctaggggtgtggcgctcactgaaacactacaggagtagtgcccacacgtgagatcatcctcaccacattttcgatccatcaaggagacaaatgatgggagcccatgtagtgggcattgcgagagcatgccatgggctcccacccacgttgatgttattgggactgcagcacacacgctaagttagaaggtgtcacagccgcgttggactttgacgttactcaatatggtacaaattatgccctgaagattctaggagtatgtccatatacttttccgttgtcaattctctgaatgagtgacttgatggcggaacatattgcaggcccaatcatcaaactagtttcactcacagactcagagcgagcttgtccgattgtgagactatggcgtgagttctgcggacgattgtcaacaaaagagtagacttctcatatttatacacacacgcaatcctggctgcacctgcccctctaggggacccccctccttcgactccggcgaggcatgtcgaggtcgaggcagcttcgcctgggcacggcgcgcctggcacccctcatgacccggcaactcgctttctttcccacatgttttgatatccgaaatcgtcagctgcatcagaggccccacgacacctcctgcaccctctgccgtccccttcccctctgcaaacgcatcaactccgacatggttgccaagactaccacaaccaccaaggtgcgctcgggaaagtgtcgaatcttgcatacccatcattaaatgccgctccacggtcggcctcggaccacgacgtccccgcatgctctgcgcacctgtgtcggagcctggctccctcgccattctgggcacgcccgagggctttggacacaacatgtgttggagtgtctcgaacgccgcataaaccctcacctggcctccatgcccacctgtaatacgcgcagcgcggtgccggagtgaagcccaaggcggtgcgttccggcaggggggaaagggggccaccccgttaacaaccagctgtcggaccccatacccgccctgtcgaccttgaatcttcctcttgcaggctcccaagaaggccgctgtcaagggcgaactccagaaggcaaaggccaccgtgaagtctgcggtgaggcagcttgggagggaccctgcgtcaaccagtgtgatactttgtggggtgggaatgaaagtggtggccgctgcagaagtactggtgccgagtcctcccgtgtcgcgccctgacatgtgcaggtcaccaaggcgaagacggctctcactcccaagaagacgactgccaagaagaccacggcccctaaggtatcctgggtgtgagactgcctcctgcatcccctgtgggagcatgccctttcctccagagctggccgagtcactgtctacccccaccagccaagaaaagcaccatcctcccatccaccctgcagaagacgacgccgctgaccgccaaggtgaaagctgcgctcccagctaagaaggtgcgggggccataaagagttggtttcttcctgggcactacctgtgaatgagggtctgggaaaaactacagcgactttgatctgcatctggaacgcaatcactggctctaccatgccatgttttccgatgctgtgctcgttccacgcaccgacctcgctcccacttcctccatctggcagaatgtgaggaaggtttgagcccacggcaagcccggcccacctctggcatccacccggcccccgttcccctgtgcctgccatccgcatgtctgacaccctgaccctggccaatcgaccctgactctgtgcgacctgaccatacaccatgtgtacatccccgctgtaacatgcctcctgacgatctggagcctgcagtgttttgaagggtcgaaattgaaggcaggcaaagatgcagcgtctggcaactgcgacccctgctgagctgggggcatgggaaggagggctcgaccgaagtgactgctcagccgctgccgcccgacacgagaaagcgggtaaaagacgcgccacgccgcttcccaggacaatggaaaggagggagtgcgctcacgccgtggcctccgcaggcgccgcctccacgagcgccagctggtgcccgtcgtccacctgtgcgcccacatgcgccgccagctcggcgacgttgccggagaagggcgcgcacacggcgtgctccatcttcatggcctccaccgccaccaggggctggccctcctccacccagtcgcccacgctgacgaataccttgagacagggttgaagggggcaaaggtggctgtgctttgaccgtgcaggtacgaggcgattctggccggtgagagagtctgaggaggctttacaccagagcgtacggcaggcactgcccgctggctaccccagcgtcgtgccacccctgctccatcgtccgatggccggagcaccacagcccagcccctccgcaaacagaaaataccaccccgcgcacgcaccttcacgaccttgcccggcatgggcgagcggatcctgcccgccgccgcgccggcggaggccgcgccggtgcgctcccagcgccggaccacggtgcgccggaactgggaggcccggccgcccacccacaggtccagcacctcctcctcgccggagacgtgcattacataatcgccgcgcactcgccgccccgccagctcggcgctgacacggtcggccgtcacctccacgtgccgcgcctgcaatgaagatggcgggtgggaggggcgacaggtgctgggatatagcattccaaggtacgaagaaggcggcacgatgtgcctgagtccagtggaaggcttactttcagatgccgccccgccgtccaaccccctgaccctgcccgccccaactcctccctcgcctcacctccacgcgggcctcggcgcccagaccggacccctccgcgagggcggccccctccagggtcacgccgccgccggcccccaccaggtccagctccaggccgccggtggcgggggcgtggccgaagcccacgctcgcgcgcgccgggtggttgacgcggaaggcgctgggctggcgccagggctcggggcagggggccttggtggaggccgagggctcgccggacgcatgcggcgccgcgtagatcagggccgccagacaaagctcgtcggtgcccggggcgaccctctccagcaggctgtcctcatgctcggcgatgaaggaggtgtcgacgccaccctggagagcaagaggggcagggatgtgagcgtgtgtgggttggaattcgaaggttctgattttctctggatcatagggcgcattaccctgcaggtgcattccgtggcgcggaaacaaccaggtgcggtccttggtcacgcgtgcttcccttgccaggctcggagcaggctccaggcctggaagcaggcccaaaggcctggagcccgctcctaggcctgccccattcctagcatgagctgaacaacccctgcaagacacaaacaaccatcaccagccgcatgacccccacccccaacccccccccgggcgcttggacccacaaacacacaccgtctggaaatctgggtcctgcgtcacgcggcgcatgaactcgatgttggtgggcaggcccgccacctgcgtctcgcccagggctgcatgcagcgtgcgcagcgccgcctcgcgcgtcgggccgtgcacgatgagcttggcgatcatggggtcgtagtggacgcccacctgcaggggaggagggttgggttgcgagggagtggggccgggggaggaggagggagagccttctgcaacacaggcccagggccggtcacgagcatccttgcccgccatgcctggcccgcctgagttctgggcctgtgactccccaccgctgactcaccgggctctacatccactggccaacctcctccccctggacaccgcgccccgcagatcccctggccccctcccctcccagatctcttccccaccccacccccacacacctggtccccctggttgatgccgctgtcgacgcgcaccgcgcccggcccgaactcggcggcgccgggcgggggccgccaccgcagcagccgcccccccgccggcaaaaagttgttggccgggttctcggcgtagatccgcgcctcaaaggcgtggcccccgatgcgcagctggtcctgggtcaggggcaggcgctcccccgcggccacgcgcagctgccactccaccaggtccacgccggagatggcctcgctgacggggtgctccacctgcagccgcgtgttcatctccatgaagaagtattctccagtggcagtgtccatgatgaactccacggtgcccgcgttgcggtacccgactgccagggggggggggg

SEQ ID NO: 36613 - DNA, 79 bp, Chlorella protothecoides
gccggggatggcgaggccgccgggctggattccggggatggggaggatacggggctggccgctggagagggggaggatg

SEQ ID NO: 36614 - DNA, 76 bp, Chlorella protothecoides
tggccagcccggctacggccagcccggctatggccagccaggctatggcggtgagcttgacaggcagaaatcacca

SEQ ID NO: 36615 - DNA, 61 bp, Chlorella protothecoides
cagtttcaaagctacacacaggtgcactcatccttcatctatccctggcagactcacatgc

SEQ ID NO: 36616 - DNA, 78 bp, Chlorella protothecoides
gcagggagcccccaccccacccaatcgccctgctcccccctcacctcggcgctgccgatgctggtgacggggaggacc

SEQ ID NO: 36617 - DNA, 79 bp, Chlorella protothecoides
cttggcccccggggagaagctggtggaggtgatgcgcgtgaaacgagcggcgcacaccagcaccatctccgccaccaag

SEQ ID NO: 36618 - DNA, 61 bp, Chlorella protothecoides
gcggcctggcggtcggaggggtgtcatgtcagctttcagcagggttgcgcgtcagctgtac

SEQ ID NO: 36619 - DNA, 8262 bp, Chlorella protothecoides
  modified_base (168)..(212): a, c, t, g, unknown or other
agccgccggctgcggcgccatagcccccgcccggggcgcccccgccgtagccgccgcccccgccgccgtacccgccgccgccgccaccgcccgcgaaggggtccagcccgttcacgatgtcctccaccatgcgcttggccgcctcggcggcggcggggggcccccccnnnnnnnnnnnnnnnnnnnnnnnnnnnnnnnnnnnnnnnnnnnnnttgcaggggtcgccgccctgatcgatctggatggtggcctgggaggcgcgctggatctgcttgatggtctccccgccgcgcccgatgatgcgccccacgatgcccttgggcacggtgaagctgtggctcttgccgatgccgttctcggcgcagacgcgctggatgatggcctgcgcggagccggcctcgcccacgatcagctcctgaatgagggccaccgcgcggcgcgcggcgtcggcggtgccggagatgatcaccttgcgcggctggccctcggggaagttctggtccaccgtgatgtgggcctgggaggcagactgcagcgcgcggatggtctccccgccccgcccgatgatgcgccccacgatgccggcagggcattccatcgtctcctgcacctcctcttccccggtcaggccctccacctcacgccggcagcggtccacctggtccctgcaggcgtgggtgggggtgaggttgggcggtggggatccggtgctgaagacccacatgtatacgatcgctcggcgggccgtttgcgccagatgggtcccccctcccttccattccatgcattccctctccccagcactcctccactcccctgcaaagtcccccccccctttcacctcccaaacaagccacctccatcaaacgcactgcgtcatgccggtgatggtaatgcggcgcgtgtcgccgccgccctcgtggtccacctggatgcgcgtgtcggtgctgagctgcaggttccggatggtctcgccgctgcgcccaatcagcttgcccaccatgttggcggggatgtcgaacacggtgctggcggtggtgctcgtgctgaagtcccccaggccggggccggggttgccataggcctcgccctccgcgccgcccgggttctccggcgcggcctgcccctcggagctcaggaagttggtggaggcacgtttcttgtcggggccatcctcctcgtgctcgacgccctcaccatcccgagggcgcttgttgttcccgtcggcgccgtccgggcctgggaacccttcgaagccggcagcggtctgtgccaagggcagtggaggtggggtgaggaggagcgggtgggaagaaggagtggcacccgggacctgtcacgacgcagatgtccggatcaatcaggacagatgagacgtatgatcaggttcaaggctcggatggggccgggaaggcccgttgggatgcctcacctggctgacatcgtaggggttggagccatagacagcaccggcctgctcctcgtgctgctggatgagcctggctgctactgccgcagccgtggcagcggccgcatcggtgtcaggcgcagcggggttcccagcttccttctcctcctccccagcaggctgggtcgcgccatcacccgtggatgggtcctcgacgggggccgtgacctcctcggccgcgggctccaccagttggcccactgtggtatcggcttcagacatattgaagcacgtcctctggattactcgatcggacagacctggcgcgatgcaagtgcacgctccaaacaccaggagtagaaatctcgtcccgggacgaacggcgtctgcccctttcgggacacccggtgctcccgtggggctggacttttaaaaggatcatcctcgagctgatcccgtcccccttgccacgcctgccatgcgtccctgctcactgcctgggatgcgaagcgttgcctacacagctcaaacacccacgacaagaccccggacgagaggaagacgcagtgtcccacccgtggtacgtgcggacgcatgaacgcgtctgtcagaggcccacatcgtgcatcgagtatgtggatcaagcatggcaacctttcctcgcacatccctgctgtgacagaacgcccgaggcaggcatcgctggtgggagggctgtgtgccagaccctgccctacaggagcaacaggtgggacgggacccctccatgcacggagcctgtggagcctgcaaggcgaatacccgcctgtggaggtgcattgatgttcatgcccctcctctcgcaggagctggtgaccgtctttggactggatgggagtgtgaccaccttccccccgaggccctggccactcgatgaggcaaggcctggtggagggagggtctggtggggctgccctccgacgccaggatttccctctcagaggcttgcagtggactcaagttgcagcaaccatgacactgttcatcccgtcactctgcgcaggcattgtctcttgaggcccggcccccgctcctgagcctgcccctcacggaggagcagggcctgaccatcggctccgtcttcacgatacgcgcctccaacggcgtggactcctgccgccgcctgagcctgctgggcttctgccacagtgtggaccacctgcacgagaaggtggagctggtggtgaggcagcgggggggggcggtcgtgtcgtcagagcgccagctcaccaggtgtggaaagggtggagagtgtggagtctgctgcatgcgaggagggtgcaagaagggtctggcagtttcactgaaacactcctctcaagcgttctcctcctgcgagttgcgaggcatacccccccaacctggctcactgcgctccacgcgcagtgccctggccgagcgactgcacatgtgcatcgccatccccctgctgtttggcgtcccgccggagcatgagcgcctgcgggccggcgtgctggcgggcggcggcatcatcgaccgcgtggtgcagcagtggctggtgggctgcgtcccgtgaccaggtttggtgtgggggctggctgggaggccccagccccttgtattacattctcctcgtcaggtttgtacctctctttgcgacaacgctcctatttggtcctccgtgagaggctcggcgctcttattaaatcaaacttaagtatccaagtgtaccgttgactgtgcaataactttaggagcagatgtccacccacccaactgtttgtaaatacaccaaagcctaccaaatccatgaccgaccaccgcggcgattttggcaccgaggccctgtcgcgtcgtaatcgccgatgagcgtcacacatgctaataagatgggctcaagaggcgcacattctgcgtgtcgaggatgttgagtgcccagacgggacaccggtatgccacccggtgtccagcaccgggtgtggccacctgctcggtccggcctcgacggaggtctacgtcgagactcgcagcgctgttccgagggtcccagcaaaacatggaggccggcctgtgtggagcggctgtcgcggtggtgttgtggggcgcgacactcccggctgacgccagcagcagcgacaggtgcatgtgcttgggaagtgctctcttgatactttgaggcagtggcgcaacttccatgcaccatttccttcttaagaagcctacgagtccctcccacgaacacagagtgtctgtgcctttgaggagggagtttgtggaggagctcatcatgcggcagctgacgtccaggtgaggcctcagagcggcgtgtgactcctccgcctgcgctcattcaagagtcacgtggagctcagtgcgggtgcagctgccctgcaccatgcagggtgcatgccatgacagatggggagctggccagcgcgctcgagggcgtgctggaggggaaggccggcgactcgctcgagacccctgctcccgctgccgcgactgccgcgccgcgggagggtggcgcgcagggggaggcggctgcaaggcagagcctgctggacggtcagaaaacgctccagagggagttcgaggccctggcgggcagggtgcgcgtggggctggatgaggggcacgctccggcgccgtcggccccagagcagctcaatggccccagccaggggctgggccccccagcggacctgccactacccgcgccagaccacccaggcgtcccccagggccccggaccaggtgaatctctcctttcaggaggccccaacgtggccagcgccgcgacagaggcggtgcggggctttgcccgcgccacgaccacaatcctccgcggcgcttcggagtgggcgaccgttgggctgcacggcgccatcacccggctggagaacatcccagacagacaaaaggtggccggcggcgccgtgctgggcctgggcgcggctgccctcctcgccctcggcctgtggcgagggtcgtcggatggcgccagctcgggtcaggcagcccctggcgacgggcggggggcggggagcgactcgccggcgggctctgcagccgcccctcccccgcctccggtgcctctgcctccggtcgcacagcaggggggcgaggggccggtgctgtggcagcgcagggagggcgtggcggcgggtcccagtggccggtccttccccgcggccagggaaggggcctcaggctccgagtcacctgccccccaaggccctcaagtcgaccattggcgggtgccgctgagctctctcgacagcaaagaagcgagcgcgtcacctaccagggatgctgctgccgacgctggaggtgagaggggcgacgtcgaagcctagttttggggatgtgtctgaactagccccactccccaacctggaagcggacccttgagctattcctcaaaaccccctctacacgaccgttacatcgcacagtggtggatgaaaggatcgtgacgtcaaggcggcatgcaaccccagacacactggacaacgctgagcccgagaagccacccgccctgcctcccagactccagcgaggctggcgaggccctgcaggcagagactgagcgccctttcagccccagttcatgggcagcccagccatgcagtgtaaattggtggtctttgatgcagcgggagcctgattttcagcgctgttgtcagctttggtcttacgcctagcaaccccatgcctgtcgcaagggtcccgggacaattgagttgtcggagataggcatgggcgctcgagggtcgaggggcgaccttggctttctccatgtcgcactgaacagtgccataagttatcgggcgcaattcatcgtccaggattgcaagaagccgctgcgattggcctccccagtcctcgacaggcatgcccgtctggcttcccccgggcgtatttgcgacaggcagcgcgcccgggccattaatcccgcatcaactcccagtacgggtcacttgagtgtcgagaacagtatctgtgccctattgagggcgggaggagctgcgcatgtcggtcctggggacccacactggccgggcgcaggacgtgcctcaggcagccacacagcacttcacccccgcaggattgcacgtgaggcgggcgagattggctccgggtagacatgccaggacatttgcaggacaagaagttgctgcattccctcaaggcgccccctccttcgcctcgcaggtgctgctcgtcgatgacgacccgatgtgtttgaacgtcgtctccgccatgctgcgacgctgcaactacgaaggtgcgggcctcccgctgggacgtcatccccgttccatgacccggtgttcgcattgttagccacattatagggacactcgctccggttgagcctctcatgtgtcgggatctggccgaaagttctcccggtgtccgctgccgggagtacagcggcttgccccaccaagtttctcacctccccccctgacatggcacgttccctcccttcgcccacaacccacagtcatcacggcatgcagcgcgggcatggccttgcaaatgctccaggacagcaatacgtctgctcacatagacctggtgctctgcgacgtctacatgccggacatggatggctttgagctcctggagatcgtgggcctcagcctgggcatccccgtgatcagttcagtgctgtgtgtcggctgggtttgtggggggatcgttggcggacacctgtgctcttgcatcgctgccacttgtctcccatcatcccttccaaaacccacccgttcctttcctcattactgctacagtgatgtctgccacaggcgacaccgaggtggtgctgaagggcgtgacacacggcgccgtcgacttcctcatcaagcccgtccgcctggaagagctacgcaacgtgtggcagcacgtggtgcggcgccgctcccagcgccgggcggagcccgccccccccccggccgcctctgaggcggcgccggtggcagctagcccccgcgtcggggccccagctgcggtccacaacgcggaggctagcgccgggtcccagagcgggggcggcgaggaaagcgggagcgggggcccccaggcgcccgtcggcacctgggccagccacgagctgcgcggcgacgagcgcggcgacgagcgaggcgactcgctggaccatggcagcgggccggcctccgactcacggcaccgccagccgcgcaagccgcgagtggtgtggacctcagaaatgcaccgccaggtatcagtggtacttttcgtgggggtgggatgtggggtcgagcgaggcaggggccagttgatgccggcagggtgtgtgttgtaggcggcaggcgggccgggggcagggggaggacgtgcggcgaggggtggaaattgggcgtcaggcgttcgaaaatcagtgtgttagattgctttcccagcgcccacgcccccactgcttccctcaatatctccacgcagtttgccatggcggtggcccagctggggattgacaaggcggtgcccaagcgcatcttggagctcatgggaacaaagggtctgacccgcgagaacgtcgccagccatctccaggtcggttggagtacttgaggcttgatccggatggggtgggtcgcaagtcgctgctgcgagcttgcgtgtgtggatggcaagctgagagggagagggggaggggcgtgggtgggtgccggtgaatctgccgtggacatctgttgggtccagggtcactgccctgcctgtgcggtcaaggcgagctgtggctcaccctcaacataggtacgtgactgggcctccccacctcacacaaaccctcacactctcctgacgaccacagaagtaccgcatgtacctgaagaaggtgcagcagagcgacagctcgcgcggcgcgacggggcaagacgccgcgtccatcggcagcgccttcatgctgagcgagggagagagcatggccagcgagcccaccgccgcggcctccctggccaccgatctggccagcccgctgcgtggcaacccggcctccggcgtggggctggggccgggggcggggagtgcgggcgcgcggcaggcggacccccgatcaagcgacgcctccgacccggtcatgcccggcgggctctttcctttccccctccaggtgggtgccgcgggtgggtggcaggggcgactaccgttggcaggcagtcgctggcagtgcaggcggggatcgtcgtggcctgccgctgtgggagcagccggctgacccacccctgcagctgcgcagagcccaccaaaggcccccttccccccctctgtatagacccccctttccccccccctttcgacccacagccgtaccaggtgcaccagggctgggctcccgagtccatgcccggagcccacatgcagcagtacgggggcccttcggccgccgcctcgctgcagatgggcggcggccggatgccgccctggatggggatgccgcaggcagcgatgcacatggccatggtgcggtgagggggcggggcatgcgccgctcccattaccactggtgcgctccctcctccggcctcacgcctgcccacccccccatccccgccccaccctcagttccctggaccctttatgccccccggttacggcgtgcagcagccgcccggcatgttcccgcccatgtggcagcacgtgcagcccggcaaagtcaacggcaggcacacccccgggagcgttgagggcgcggccgggaggcccagccaacacgaggaggccgtgcccgtgaacgaacctgcgcgggacgggggccagcggcgctcccgagacggtcgaggggtgagtttgtctcgggggggggggggggggggggggggggg

SEQ ID NO: 36620 - DNA, 75 bp, Chlorella protothecoides
gcgaaacaggctgaggaggacggcatagccttgtctctggcgccggcctcggcaagcaaggcgatcgagcaatcc

SEQ ID NO: 36621 - DNA, 62 bp, Chlorella protothecoides
tcctgtcgcgggtcgcgtggatcgtccccaacctgcgagagggcctggcctggcacatgcac

SEQ ID NO: 36622 - DNA, 92 bp, Chlorella protothecoides
ccagggcgcactcagcaaacgccgctgaggtgtcattacttgaagggaccacggcctcatcagaccgtgtgaggcccaccagggcgctggcg

SEQ ID NO: 36623 - DNA, 110 bp, Chlorella protothecoides
ctggcgtctccacagtggctgtgaccaatggcagatgccaggtgagcacatgacacctggcacaaagtaagagcatgcgatcagccagcctctgacgcaccacccaaccc

SEQ ID NO: 36624 - DNA, 76 bp, Chlorella protothecoides
agtggtgactgatccatgccgtgtgtgttttgttcccgacaggttctcgatgggatgtgtgtgtgccacgctggga

SEQ ID NO: 36625 - DNA, 61 bp, Chlorella protothecoides
ccagccgccagcaacgtcgcagcggcccccgcagcccctaccaccggcagcgatgcagcac

SEQ ID NO: 36626 - DNA, 140 bp, Chlorella protothecoides
gagccactcctgcgcacgggggtatccggggggactttcttttcgcctcgcgcatgtgtgcgggctgcacgcgggcatctgtggccatccagcctccccccgcctcacacctcccgcctcaccgggccgtcagggagggg

SEQ ID NO: 36627 - DNA, 167 bp, Chlorella protothecoides
ttgcagacctgagagagggaagggcaggggagggtcaggggcggttccctaaccaggcgctcttcctgagtgggcatgtttggacggacacagggctcgtcgaggatgcccatgctgggcatggcacccctgcgccgatgcatcacttgcaccactgcatcggtact

SEQ ID NO: 36628 - DNA, 61 bp, Chlorella protothecoides
gacctcacggcggctgagaccgtggcggggtacaggccgttccccggctctcagccagtga

SEQ ID NO: 36629 - DNA, 115 bp, Chlorella protothecoides
acctcccacgtgagtctctagcatgccttggtcgtaatgtcgccccagtggcgctgctgcggcgtggagcgacagtccgtgttgtccacgagctcactgtgccccctccccatcc

SEQ ID NO: 36630 - DNA, 73 bp, Chlorella protothecoides
cggcccgcagtgcactgcagggacccttgtagagcccaccgaccctcccgtactgcgccggccatggaggtca

SEQ ID NO: 36631 - DNA, 61 bp, Chlorella protothecoides
ataggtatgcagcattataaggggcatgatggcgcaagacgacctacctcggcgtgcgtcc

SEQ ID NO: 36632 - DNA, 68 bp, Chlorella protothecoides
tcgtggcactgcctgctgccgacccgccgatactcccacacccccgcagggagggctcctgagcgcca

SEQ ID NO: 36633 - DNA, 61 bp, Chlorella protothecoides
gctggtgcggaagatgtgcctgcccgtcacgggccggacaactggctgtgcttcgttatga

SEQ ID NO: 36634 - DNA, 79 bp, Chlorella protothecoides
caagagtctcatgcacacatgaaaccacacctggatggaagaacagtggtccaccaggcctaccagtgcagggtcaagt

SEQ ID NO: 36635 - DNA, 426 bp, Chlorella protothecoides
  modified_base (130)..(322): a, c, t, g, unknown or other
ccgcctcgaaggcggccgccgtgacgaggcgctcggcgcccgcggggcgctgcgcggcggcgccgtggtctggaccgccgaccctgatgcgcttgggcgcgggctgcggcagcgggcaggccggggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtggggtctgcgcagcgttgaaggccggtgataacgtcccccagcgcccccgccacgtgcccgctcacgtcgccctcccccgcaacagcctcccccccctc

SEQ ID NO: 36636 - DNA, 70 bp, Chlorella protothecoides
gacgagtgactgagcggctgaccccccccccccccccccccccgcctgcctcgcgcggctggcgtcgccc

SEQ ID NO: 36637 - DNA, 101 bp, Chlorella protothecoides
tcctggcggccattgacgtgttttggggtggggtgggggggtgacgtttaggctagactgtctctgggctagttgctgtgatgtgcaagccctgcaggagc

SEQ ID NO: 36638 - DNA, 61 bp, Chlorella protothecoides
tccatggcggcgtgcgccggctggtgagggtgtgcaagcatcctgcggccgtcccaagatg

SEQ ID NO: 36639 - DNA, 165 bp, Chlorella protothecoides
tccacttgaagccctcgtattgcatgctgctagctgtggccgcttttggttgcccatcaatatggccctgacaatggacaccaagccgccagccaccctgcagacctgttcaaattctgcagaaccctgaccccgcttcgatctgggtgagactctttcggagga

SEQ ID NO: 36640 - DNA, 11116 bp, Chlorella protothecoides
  modified_base (512)..(521): a, c, t, g, unknown or other
  modified_base (1763)..(1772): a, c, t, g, unknown or other
  modified_base (2153)..(2162): a, c, t, g, unknown or other
  modified_base (2908)..(2917): a, c, t, g, unknown or other
  modified_base (3641)..(3650): a, c, t, g, unknown or other
  modified_base (3729)..(3738): a, c, t, g, unknown or other
  modified_base (4003)..(4012): a, c, t, g, unknown or other
  modified_base (4156)..(4165): a, c, t, g, unknown or other
  modified_base (4708)..(4717): a, c, t, g, unknown or other
  modified_base (5851)..(5860): a, c, t, g, unknown or other
  modified_base (6195)..(6233): a, c, t, g, unknown or other
  modified_base (7600)..(7609): a, c, t, g, unknown or other
  modified_base (8112)..(8121): a, c, t, g, unknown or other
  modified_base (8486)..(8495): a, c, t, g, unknown or other
  modified_base (8718)..(8727): a, c, t, g, unknown or other
  modified_base (9925)..(9934): a, c, t, g, unknown or other
cgaggcgggggtggccgccgagacgctgcgcgccgcagcgccctcgctcaccgcgcagtacgagtacgcggcggcgcgcggcatccccaccctgctcgtgctgcacggcagcagctacggcgcggacaacgcggtgcacgtgcgctgccggctgtgccgtgcggaggagagcgtgccggcgggggaggtgccgcgctacctgcgcgcccacgcgcgggccagccacggccagggcggtggcaggccgggggaggcggcggccgaggacgggcccgcggggtggagggagcgcgagaggcggcggcgggaacgcgcgcgcggggcctgaccccggtggcggcattctttctttcttcttttttcaaacgcggcgcaggagcgtgcccgacccctgtcctcaccccaccctgcccaccctgtaccccatgaacccctccctgtggtcctgcccaaatgtacccctcattgaatgtgaatgcctccttgaatcaagcacgttcgaccgacagggnnnnnnnnnnatgcccgacccctgtgctcaccccaccttgcccaccctgtaccccatgaacccctctctgtggccctgcccgaatgtacccctcattgaatgtgaatgcccccttgaatcaagcacgttcgaccgacagggcgccgggcagggcaggcgcccgcggtctcagtcggcatttgcatgggcaggggcagggcggaggggattcgaaatataaagatcccaggcaaccccaacgccctgcaatgaaaaccgcactggccgtctgttcccaagactggatattcgcggctccagggagcgggacgaatctcgcgaggaatgtgtccatggggaccagatgggacacaacgtgaagggatgcgcaacccggcgtgtccgttgaccgcctcacccgacgtagccgtccccttcttcccgggaagggggggggggggcgcgggcagctgcgattcgaggtacgaatcggaagcaggatgccgtcatgggaatggcaaaacacacactgcggagcataatcttaaaaccaaacccatgatatttgagtgtgaatgtgctcgtttcagcacggccctgctcttcgtacacggccatactgacatgggacacggcgcgaccctaccattaagcaagccacgcgttgcggcgagcatgagctgcacccttaccgctgcgcacacctcgcaataaatgaagttacgtgtgcagaggagggtctggctcctcacgctctttctggctgggttggcggtgtcagcgggcgcgcagctggacgataatggattccgcaccagcgtctcgaccacaaacacgaccgagggccccgacgccgcccatgatcggtgggagcaactcctccggtgagtacaatctagaattatggtgggctgtcatgcttttctgcacctggaagcgcgtcgccgacccctttgccctcacccccgccccccctctcgtgcagtgagacggggggcgcacttgccgtacgcgaaaccgtggtcacccgggtctcgggtccgagcatcatgccattcacactggaaaaacaggcgattatcgccaaggccatcgagaatgttttgattcctgccttaggtgcgcggggctggtgaagtttcgtgtttcgggctgcgagattccttgcaccgctgaggcggagggattgccggtcgggacacttgcgatggagatgggtttttgagaggatctcaaggtgcccctggaaagacacatcgccctgatcccactnnnnnnnnnnacttttgacaggatctcaaggtgctcctggaaagacacatcgccctgatcccactgtgcaagctgttgctgacggaattcctctccattctccggtgcaggtcccgtaaccatcatcagctacaggtggggaggaagccgcttgggggtctcagctacctggctgcatacatttttgccatagtaatactgctttcctgctgtcaaagcacggtatttgctctgcaagagacaacaaacatagcgagcggtgcctttcccatgtggtttttattggcaatgtatatgtgtgccctgcagcagaagtcacccactcttgtactgctcctgccccgctcccaaacccactttgtccgctcatgccccgctcccgcccatcctnnnnnnnnnngcacccactcttgtactgctcttgccccactcccaaacccacttcgtccgctcatgccccgctcccgcccatccttcccctccatttcccagggaaaactatccggagcctgggttctcagaggaggctggcgtgacagacccctacgtcgactttgccggcaacatgtaccgtctgttcaacctgtccatgccggacctgaacgacagtgcgacatggaccaaggcctggaccaaccagatgcccagcttcgggctgtgggtgtctgaggtgcagcgcctgggcctgaacgcctccttccgcctcatgagcatcaacatcgcggaggagatcatgactcaggtcgtccgcctggcccccgtggtccctgttgaggtcatggtcgcggtgagcaccgcggcaggcaccaacctcaccgccctgcaggccagcacgattgccgagacgctggaggatctggtgggagcccacattgacatcatggcctggagcacacaggatgccctggtgtgggggggggctgggctggagggcatgaggaagggtgtgggggggtgctgggctggagggcataagggtgtggcgtgggtgcaggcaggtgccctggggggttgtcattgcatgtcaaatcccagcctggggtgggccatgttcacctccagatcttgggtgcattgggcttggaatctgaggggctcatggggtcctgcatgaagcaacgtccggtgcccatgggcgcctggctnnnnnnnnnngtgatggcacgcatctcatgcagccaaccccctctcactcccctgttcctcccaatcgtgccagggagaactaccccaagcccggctactcggataaagtggggtctacagaaccctacgtcgactttgcgggtaacctgtaccacctgttcaacctgtccatgcccaacctgaacatcagcgacacctggacccaggcctggaccgacgagttcaccaacttcctcatgtggggcgccaaggcccagaccatgggcctgaacgccagcatccgcctgatgagcgtgaacatcaacgagatggtgatgacgcacagcgtggaccttgtccccgtcgtcccagtggaggtcatggtcgcggtctccaccctggacggcagcaacctcaccgccgcgcaggccagctccgtggctgagggcctgcaaggccagctgggggcgcacatcgacgtcatggcctggaacacacaggatgcactggtgagccctgctttcttggtttagttgtttgttttcaatgtgtgtcaggggagggggctgttgagaggaaggtgtgagtggaaggcaggggtgtttggtagggcgagggatgggggtgagggcagtgccccttctgtgtccttttgacgagtcagaggtacaggtatgtgtccccaagggtagccttctctggccctgacagcatgtcttgcaaacaatcccccccccccccccccccccccccnnnnnnnnnncctgcacaggacatgtttgacgccacctttgactacggcaacggctcgcagctgatggtgctggacatctcgctgcccnnnnnnnnnnagctggaccccactttcccccccatacccccatctgtccagaaattctttgacgccacgttcgactacggcaacggctcacagctgatggtgctggacatctcgctgcccgcgtgcgagagcgccaacggcacggggtgggagtcctgcgcgctgagcacgctgcaattcaagctcctggacctgtttgtgtccaacgccgtggtggcctggctggaccagaacggcatgtcctccccccgcctggcgggcatccgcctgcgccnnnnnnnnnngtctttgtgaacgacaccgtgctggcgacgctggcggccggcggcatggccgccccccgcctggcgggcatccgcctgcgcccctcgccgcagccaccggcccagccgcaggtccccgccgccgtgccctggcacctggaccgnnnnnnnnnnctgtttgtctcaaacgccgtggtggcctggctggacaagaacggcatgtcctccccgcgcctggctggcatccgcctgcgcccctcgccccaggcccctgaccagctccaggcccccgccgccgtgccctggcacctggaccgcctggaccagcgcacgctgcccctggacgggcagtatgccgctgacaacctggggtcgggtgtcagcgtgtacgtgttgtcggcaggcatcgacgccacacattcggagtttcaacggaccgacggcgtgcccgggactcgcatcaagccggggtggggattcaacgggaccgacccgctgcaggactgccccgacgcctttgcctggtacggtttcggcacctactacgcctccctgatcggcgggaacacactgggcgtggccaagaacgccaccatcacctcaggtgaaggcagggcatgacttgcgggaggttggggtctagtaacgcaacgtactccattagaaatttgggttgcttgcctctcgactcctccccccgccctttcccgtcctgcnnnnnnnnnncaccgccgacaacggcgggctgggggtgaatgtgttcctcctctccggcggcatcgacgccgcccacaccgagttcgagcgcaccgacggcgtgcccgggacgcgcatcaaggcggggtggggttacaatggaaccgacccgctggaggactgccccgacgccttcgcctggtacggtttcggcacctactccgcctccctgatcggcgggaatacactgggcgtggccaagaacgccaccatcacctcggttcgcttccgcacctcgtgcatgctggagtccaccaacatctgggcgccgggggggctgccctcggccatcgacgcggtgctctcgacggccgtcgcccccgccatcatgatgattgagacctggtgagggaaagagttggtcgagtggggacgcatgtctgtgctagaggcccttgcacgctgagggaggacagcattgtggtgcgtccctggcctgacccggaccacagtggcagtaactttgaccccccaaccccatccccttctccttgccatcacccaggtggtcacccaaccgcttcagctcggacgacgaccagtggatcgagcaggcgctgaagagccggctggaccaggccatcgctcagaacatcaccgtcatcgtccctgccggcttcggcgacgcgcccgcctgcgacaacgtgctggccgcccatcccggcaccatcgtggcctccggctttgacgacttcgaccgcctcaccctcttcggcgcggccaactcctcctgcatctccctgtgggcgcccggcggcggcctgggcaacggcgtgctgggtgccatggcctacagcgactacacctccattatcccacggtgaggctggggttgcttttccaaggatgctgggcatgcgttcctccatgggtccaggaggagagcagtgtgttgggagggacgcatccgaggcggcatctgtcccttgcatcacccaccgcgcccctgccggcatgcagcctgccatgcagcccctcctcctgctcctgtcgtggcttgctggaaagcgaccctccagctcccctctccctctccccaccccctctcctcacccctgaaactaatcctcaaccaccagggcgttcggcgcgacgccgctggtnnnnnnnnnnctgctggaaagcgaccctccagctccccactccctctgcccaacccccctcctctcccctgaaactaatcctcaatcaccagggcgttcggcgcgacgccgctggtgacgggcctggcggcgcaatacctgtccaacaacccgacggccacacccgcggaggtcagacgcgcattagaggaagccgcgacgcgggaccgggtgctgatggcgggcatcgcctcccccaacctcatggggtacaccaacctgcggtacaatgcgacgacggcgagtgcgggggacgccgacgccgcggcggccggcgacgacagcggcggcggcggcggcggcggnnnnnnnnnnnnnnnnnnnnnnnnnnnnnnnnnnnnnnnccgctgcgatcgtgggcatcgcggtgccgctgggcatcatcttcatcatcgccaagacggggtgcatgtactactgcttcatctggctgaagaagcaccgcgcggcgcaggccgcggcccagaagatggacggcgactgggagattgacgagaagcggatcgagatcgtgcaccgccctgacggcgagccctggcagctgggcgagggctcctacggcaaggtgttcaaggcggtgaaggacggggtgcaggtggtggcggtgaagacgctgcgctgcgaggaggaccctctgcgcgaccagttcgtgcgcgagatcgcgatgatgcgcttcgtctcccgcgacgccaacatcacccagttctacggcgcggtggtgggggccaagagcctcatgctggtggcggagtacatggagggcggggacctgcgcaaggccatcaccgccgacgtgcgcaagcgcctggtgtggggcgcggggggcaagggcgtggcgctggacatcacgcgcggcctgcacttcctgcacacctcccgcgtcagccaccgcgacatcaagtccagcaacgtcctgctcacgcgcgacggccgtgccaagctgggcgacgtgggactggcccgcatcctagaggaccagcaccagagcgacggcttcgtgggcaccttcgcctgggccgccccggagctgctcatggggcagcgctgcgacgagcgcgtggacatatggtccctgggcaccgtgctgtgggagatcgtgacgcaggagatgcccatgcgcggcatgctgcgcccgccgctggtccccgaggagtgcccgcaggaggtggtggccatcatccacgcctgcatgcagcacgaccccaaggaccgcccctccgcgcgcgcggtgtacaacatgctgctggccgcgccgccgctggccgggttcgaggacgccgcctccatcaccgagtcctcccctacctcccagtcccccgccgactccatgcgcagctcctccccagattcacgccccacatcccccgtggccgtcgtgcccggcaccgccggcgagcgctcgggggcgatgtcctggcccgcccaggccttcgactcggcggtgctcggcgcgcagggcgccatgcgcgccgtcagccccaagctccactccgtggtggcccagatccagaagcggctgcggcaccacgaggccgtggccgcgggcggaacagatcggtccagcccgggcgacagtggggccgagggctcggtggcgcaggagggcgagcggcaggacaagtcgcccaggtcgcccttcgagaagcaggacctggcggggcacggcatggtgtgagcgctgtgcgctctgagcccaggcggggcggcgggnnnnnnnnnncggcgcaggagggcgagcggcaggagaagtcgcccaggtcgccctttgagaagcaggacctggcgggccacggcatggtgtgagcgccgtgcgctctgagcccaggcggggcggcggggcgctgtggcagggacatgctcgcggcgaggaggccgtccccgcacacacaaccccgccgcagccgcctgcctacctcccttcgccgcgcctccggtaccataaagtcgccgtcaacacccccttcgtcgccgtcatcaaccccttcgccgcagacgccgctgcaggccgcccggcgcaacagaaccccctcccaaccccgaaccccagcgctgccctccgacccccctttcatgtctcatcccacgcacctcccatgcatccaccagggcagtggcgtgccccaaactggcgctctagtgctgcctcaggcgcaatagctgctggtccctggcccgccctttgatgagagcgcctccgcatgttcgacggtcaggctggcaccnnnnnnnnnnagcgtgccccaaactggcgctctagtactgcctcaggcgcaaaagctgctggtccctggcccgcccttcgatgagagcgactccgcatgttcgacggtcaggctggcaccctcctccccgacttccggtggaaacagcaacttgcgccaatgcgagccattcctggcccctttttgtttccgctggagcatcttgtattgcaccggaacccttgtgcacaaagttctacttgctccctgcttccccattccctgctatttccccttcccatggcaacgagggagtacactttgctagtcacgtactgggcgccttacttgggtgggtgtttaaccccgtggattttctcgctatttctgtgtaannnnnnnnnntttacttgggtgattgtttaaacccgtggattttctcgctatttctgtgtaatgtcaggctatgcgatgcaatgactgaggatatgggccgctctcggcaggcaggggatgtgggtggggaggatggccatgagaatccattcgagcgcgcgccaagtcatttagcaatgcacggcaatactcgtaggctgacctgagcaccctctcacagcaccgtatggcnnnnnnnnnngggcaggggatgtggtggggagtatggccatgagaatccattcgagcgcgccccaagccatttcgcaatgcacggcattactcgtaggctggcctgagcaccctctcacagcaccgtatggcatactgaatatctggtaattcgcgtctggatccttggctggtactggcctgcccaagtactgtggtgggaatgctggcgctctcacctgggccgtggggccttggcaggagcagctcgacatcccgcattgcctgctttcgcagtcctctgagtaaatcgcacatgtcttccatttcaataccatgcacctgcattcgtggcggagttcgaagtggagagaggagaggagtgtcggccactgtgcaggcgtccgccgacccagccctgggagcacccccaactgttggcagcggcggggcctcccgatctatgaagactgtgggtgtgcttggtggtggacagctcggcatgatgatggctgaggcaggggtgagtcggtggcatgatcttgagggaggcgctgaggttggtgggtggcgacaccagtacgtgagaacactttcctggcaccacatcggtctgaggctctctacttggcagatgtacttggtatgaaaagccctgtgcttgctaagctgtcttcctgatgtgtggggttgccattgcccctctcaagtccagtcattgaatgcagcagtcttcgtgaatcgcattccccaccactcactcctctcccaggcgaccattgacctggcactcaaggtcctggaccccaccccgtcctgccccgcctcctccgtggcagagcaggtcctcggcagcttcaccgaccccgccgccatcaaggagtttgccaagtcggtcgacctgctgaccgtggagatcgagcacgtggatgccaacgcgctggaggtgcgcgcggggtatgggtctggctgcattgcatcacgtggcaaggggcccagctgagatgcccttgtcacttgcagacagccttcgtgcccagttcacccagcctgtccccggctcctgcgccgcgccattgcgtgcatgttatcccttctcgcccagctgcggggtcctgtcccaggtcctcacccctgatggagttccattcccacatcatctcaagctcgcccgatgactgatcctcttcagaccccccccaaacaatccccaggaggccgcgcgcgannnnnnnnnnggccgcgccattgcatgcatattgtcccttctcgcccagctgcgggtccctgtcccaggtccttacccctgatggagttccatccccacatcatctccagctcacccgatgactaatcctctttagaacctcccaaacaatccccaggaggccgcgcgcgaggcgggcatagaggtgcacccctccccctccgtcctgcgcgtcatccaggacaagtgggcgcagaaggagcactttgcggcggcaggcgtgccctgcgcccccgccgccgccatcgccagcgaggccgacctggcgcgcttcggcgcggcccacggctaccccttcatgctcaaggcgcggcgcctggcctacgacgggcgcggcaacgcggtggtgagcgaccctgcgggcgcggccgccgcgctgtccgcgctgggtggcctgggccagggcctgtacgcggaggcctgggtgcccttccgcgccgagctggcggtgatggtggcgcaggggcgcgacggtgcgctccgcgctttccccgtcacccagaccctgcaccgcgacagcatctgcgtggtcaccgagaccccggctctgatcgaccccgggctggcgcgcgaagcggagcgcgtcgcgctcgccgcggtggccagcctccccggcgccggggtctacggcgtggagatgtttgtcgtcggggacggggatggggagggcggcccggcgcccgggaccgcagcccccagcgatgcggcgccggcgccggcgccggcggcggccgccagagacaaaacaccccgcctcctgctcaacgaggtggccccccgcccgcacaactcggggcactacaccatcgaggcctgcgccacctcgcagtacctggcgcacctccaggcggtgacggggcagcgcgtgggcgacacctccctcaccgccggcgccgccatcatggtcaacgtgctgggcgacggcgcgggccaggcagccaacgccgagcgcatcgctgcgctgcggacccgcgcggcggccgagccgcgctgcgcgctgcactggtacggcaaggccgagttcaaggccaagcgcaagctgggccacttcaccatagtcgccgacgatcggcgcgaggcgcgggcagcgctcgagcgcgtcgacccccaagcggcgcgcgagctggagcgcgccgcgccgctcgcgccggcg

SEQ ID NO: 36641 - DNA, 79 bp, Chlorella protothecoides
gtctttgtttggggtgagagccttggacagaaggtttgtggtccgatagtggaagggggtggaagaacaggggtccgag

SEQ ID NO: 36642 - DNA, 61 bp, Chlorella protothecoides
cacgcccacgatacgggcccccttccgttcacccctgccccgccagccatctcacccagga

SEQ ID NO: 36643 - DNA, 105 bp, Chlorella protothecoides
actcactctcacgagcccactgtaacctggaccggcatagaggggggtctcgtaagtggcaggcaacatgcctggaacgcagctatgtatgtggaaccccagctc

SEQ ID NO: 36644 - DNA, 86 bp, Chlorella protothecoides
acaacacccttgtgttcaagcctcacattgagtcccctcccaaacaccccctcccgccacccaggggactgccgacggcttcaagg

SEQ ID NO: 36645 - DNA, 71 bp, Chlorella protothecoides
aatggcatccccgggacctcctcccattgacacgaacgaacggtctccccgtgacgccgacaccgtctctg

SEQ ID NO: 36646 - DNA, 73 bp, Chlorella protothecoides
acgatctcaatccgtgcctcctctgccagcatgcacccctgcgccgcaccggaactgtatgtcgatggcgcct

SEQ ID NO: 36647 - DNA, 1204 bp, Chlorella protothecoides
  modified_base (101)..(110): a, c, t, g, unknown or other
ccccctcccactacaggatgcgctggacgagatcgcgcggcagaagcccaaggacctgttcaagcccctacgcgtgcacttcatcggcgaggatgggatcnnnnnnnnnnaatcgcgcggcagaagcccaaagacctgttcaaacccctgcgcgtgcacttcatcggcgaggatgggatcgacgcggggggcgtgaagaaggagttcttccagctgctggtggcggaggtgctgagccccgactacggcatgctgtcctaccagcccgagtcgcggacctactggttctgccccgtcacgctggagggcgagggcgccttcctcctgctgggcctggtgctgggcctggccatctacaacggcgtgctgctggacttccccctgcccctggccctgtaccgcaagatcctggggcaggaggtgcgcctgcgcgacctggaggacatgcagcccagcctgggcaagggcctgcgcgcgctgctgcagtacgagccgccggtggaggaggtggtggagtgcgaggccatgcaggttgaggtcggcgtcggcgggggcgacgacgccatggaggtggatgctgccacgagcagcaggcacgcggcgtccagggtcgacggcgcggcgaccacgcgcgccacaggcgccccggcagcccgccccgcccccaccccgtgcgccctcccgggccactcggtggaggaggtgttctgccagtcctttgtggtggaggtggcggggtggggcgagcgccgcgcggtggagttgaagcccggcggcgcgggcatcccggtgacggaggacagccggcgcgagttcgtggacgcctacgtcgacttctggctcaacacctcggtgcacgcgcagttcgaggcctttgcgcgcggcttcctcatgctctgcggcggccccgccctccagctcttctccgccaccgagctggagcgcctggtctgcggcaacccctgcctggacttcgagggcctccagcgctccgcgcgctacgagggcggctactcggccgaccaccgagtggtccagtggctctgggatgtggtgggcgagctggacgccgacgagcgtcgcctcttcctcaagttcttcaccgggtccgaccgcgcgcccatcggaggcctggccaacctgcgttgcgtcatccaggtgggccagggtgttgtgtgtatgaaggagggggtgtggggggggg

SEQ ID NO: 36648 - DNA, 146 bp, Chlorella protothecoides
ggggggggggttcagggacccgcatggcacctggaaagcgacgctctctcgagatgacattcctgtacgcaggatcctttcaatcagacctcttcacccacgacatctcccgtggacaggcattgtacaaggccaggccacggtgc

SEQ ID NO: 36649 - DNA, 123 bp, Chlorella protothecoides
cccaacccacccccccgggcgcgcggagcgcccttccaaccccaaaacccaagtccctcccctcagcccctgcgacggctgggcatgcgcagggccaaatgcacctctcgcactcacctttcc

SEQ ID NO: 36650 - DNA, 73 bp, Chlorella protothecoides
gatctcctgctcggtgcgccccactcacccgaccacccacgccgaaaaacaggctgcgccagacggtgttcct
